United States Patent 7,560,542 (NUCLEIC ACID MOLECULE SEQ ID NO. 68811 AND OTHER MOLECULES ASSOCIATED WITH PLANTS) - sequence listing, part 9

SEQ ID NO: 50912 - DNA, 472 bp, Zea mays
  unsure at all n locations
  Clone ID: LIB3067-030-Q1-K1-D11
caggggtacaatctaggataacagagaaatatttggcctctttaacaatctttatgatggatcttgtaatattagaagacaaaagaactatcaactcattctgaatcttaggactgagataatggtaatgaatttctttgttctgaatacgcctaagatggtcttgcattaccaaatcaaactctgcaatcatctcaacacaggctaagaaatttccattactatcactataaagctgctcaatgcttcctctaaaagccaagttgcgtttaccaagaaatttcacaattgctattattcttagcaaaacttgtctcaaacgttctttctctttattgatttgcttttgcaagtctttatcaatagtttcctctttctgcattcgtgtcctcaattcattccacttgntcatgttctgaaaatgctcaacactattttcatggtctctaggctttgtactaatatttcctcc

SEQ ID NO: 50913 - DNA, 362 bp, Zea mays
  Clone ID: LIB3067-030-Q1-K1-D12
ggagtcttgacctgcttcattgccatcaccgctctcgccttccgtccctgcgcatccggcgtgcccatggacggtggctggtcgaacggcggcgccacctggtacggcccagccaagggcgctggatccgacggtggtgcgtgtgggtaccagggtgccgtcgaccagcctacgatctggtcaatgatcaccggcggcagccaatccatcttccaggacggcaagggctgcggcacctgctaccaggtgaagtgcaccggacacgcgtcgtgctccggcaatccggtgacagtggtcatcaccgacctgtgccccggcgttggatgccaggtggagcccgtgcactatgacctgagctgtac

SEQ ID NO: 50914 - DNA, 435 bp, Zea mays
  Clone ID: LIB3067-030-Q1-K1-D2
gttatattattctataatagtacatacatatttcataatccatcgtgcatattcatgtcagggtgactgatatttcatagagctcagaactattcgtgaaaatggacatcgaatttgtaggaactgacgatgtacatattaattctcaggcacacgtggtttagtgacgatgaccaccctggttagactaatctgcgtaatacaaaaacggagtcggtctatgtaattaaaggctctagtgcttgatgatcaacataattatttgaactaatatatttctctagtgtgtatgtttatagtgtaaaggatgcggcgtggatttggacgaaagcaaatgggtgagcatgaagattaacacctcaaagaaatacattagaaaacttattgaagatctgtcaagatcatgcaggagtataaaacatgagacaatagaag

SEQ ID NO: 50915 - DNA, 444 bp, Zea mays
  Clone ID: LIB3067-030-Q1-K1-D3
tcgcggacgcgtgggctacaaagctgatcttgaggatggaaccatagttgctgtcaagagattgaaggaagtggtggttagcaagaaggattttgaacagcagatggagataattggtagggttggccagcatcaaaatgtaattccattgcgggcttactattactccaaggatgagaagttgttggtgtttgattatgtcccatctggtagccttgctgctgttttgcatgggaataaagctgctggaagagctccattgaactgggagacaagagtcaagatatctctggacgtggcccatggaatcgcccaccttcatgccgagggaggaaggaagttcatccacggcaacatcaaagcatcgaacgtcctcctatcgcagaacctcgacggctgcgtctccgagttcggcctggcacagatcatgaccaccccacagac

SEQ ID NO: 50916 - DNA, 308 bp, Zea mays
  Clone ID: LIB3067-030-Q1-K1-D4
gaggaaatagaggatttaaagaagacaccataagaaatacatgccctccttcactagctggtaagcttcaatcaggatcagcacaatccagggccataaagttcctaagcccccaacagtgaactattgcaggacgtttctgttttgaaatttggttgttggttgaactatgtctaattgttttatcaataatttgttgctagttgtttacaagtatgacttagtaggtccaagtttattgatttttgttactggtacctccaagttttgttgaacattgttgcttcttgcaagacgtattgtgatct

SEQ ID NO: 50917 - DNA, 440 bp, Zea mays
  Clone ID: LIB3067-030-Q1-K1-D5
cggacgcgtgggcggacgcgtgggcggacgcgtggggcaaaaccctcaaagactagctagggaaatctgtggtgcactgcatgctagcattcaacctgctggtgtggctgttgctctgcagtgctggcacattcctttaccagaaaacttggaatgcaaaactttggaaggttggattagaacttcacattcatctcgctctggagtctttgaaggtgaaagcagcactttctggagtgacttcttggctcttgttaagcttaggggcatagacgtggaggctaaggaccataccgtttctattccttggtgccctttaaggtctcatgaggttccactctctaacgggctctgcaagaaaaactcaactaatggcatggtttctgctgttacctcgatgctcttatcactcggagaggaccccctcaggaaagagcttt

SEQ ID NO: 50918 - DNA, 286 bp, Zea mays
  Clone ID: LIB3067-030-Q1-K1-D6
cccacgcgtccgatcgtcctgaatgctgagcagccttgtacagctcagggaagcgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgtattacgcatgtgttttctagtgtccgtgcggaagctgtattataagctgaaatatgtgcgtttgaaatttactagtt

SEQ ID NO: 50919 - DNA, 440 bp, Zea mays
  Clone ID: LIB3067-030-Q1-K1-D7
cccacgcgtccgtgcatgaagtagaagatttcaccaagagaaaatttggcaaggagaacgtggatgaaggtgcacgagatgcgtctgagatcttccggtacatagaccatgtccgaacatatcctaccataatgtttggaggaattgagggctctcaagtctgcactgtggcctttcagcgggtgtgactgaaagctgaggcacacatagttcttggcctgacgtgtcacgttgggtccagaagaaatggataaaaaattttgtgcttcgcctgtgggactgttcctaccgtattaaggaacagtccaaactgtgtcttcttctgttgttagctcatctatccaggatggtcgtgtaattttagatggaccagactatgagacgaatcagtcctgtattgttgtcaccgtgaacatttccttgtatttccgttcctctta

SEQ ID NO: 50920 - DNA, 313 bp, Zea mays
  Clone ID: LIB3067-030-Q1-K1-D8
cacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggagggggtggatcgggtggtgggagtggaggcggaggatctggtggaggcggaagtagaggtgg

SEQ ID NO: 50921 - DNA, 435 bp, Zea mays
  Clone ID: LIB3067-030-Q1-K1-E1
aaaattggaactttgggaagaaaatctcagtactgctgtgagcctcgaagtgttgagaatgaccgagaagttttcagctgctgcaggcactagaagcatcagctagttttaaaatgtattgctcgtagcaggcagactgaaactagctgatgctttacaaaattacaatttgtatttcccaacgtttttggactttaggggacgaaattaccgatatggtccttttcattaccacgaacgagatcttgttagatctctcatactctttgcgcaaagtggggtgacagatacacccccagataaaggtagtcagggcatacgaacctttatggcttcaacagctttccattattccaaatattggaagaattataatgaaggtataatatgggttattaaaaatatacatgagtgtcctgacttaaatagtaataa

SEQ ID NO: 50922 - DNA, 405 bp, Zea mays
  unsure at all n locations
  Clone ID: LIB3067-030-Q1-K1-C5
gtctctatatgccctagtaggcattggctctcagatggctgctcttatactacttgcgattgtaccgtccattgttgctatgttatatgtggagacaagaactatcataacttccttatattgcgtgctactctcttacatctttcatgtctacgatattgtagtgnatggtctgtattgactgaatggtcgtaaacactgtataaaagctactatccttacagcatgacttcctgcattctggtatctctcgattggactgctgacacacactattgctatcttataccaatcatctgcaactataccatttggcacaatggatgtcatgaatatgctctgacctttcatgtacatcatgctcgtcatattggaaactgtagctgatctaaattaggaatgcgc

SEQ ID NO: 50923 - DNA, 230 bp, Zea mays
  Clone ID: LIB3067-030-Q1-K1-E10
gctacacatgttcttgcatcttctggtgtccttacgacgactgataaagcatcagcacggttaaagggtggtgcaaagaaagctgtgatatctagaccatcagctaatgctcacatgataggagatggtgctaatgagaatagctatcatccatagatgaatgttgcttataatgcaagttgcactaacaactgccttgctccagttggcaatgatgaacatgacgaatt

SEQ ID NO: 50924 - DNA, 399 bp, Zea mays
  Clone ID: LIB3067-030-Q1-K1-E11
cttgaggatgagacaatagatgcagagatattgaactcgatggctgttacaaatgaccagtttcaagactgcgcttggaacaagcaacccatctgctctccgtgaaactgttgttgaagtcccaaatgtctcttgggaggatattggtgggctggagaatgtcaagagggagctccaggagactgttcaatatcctgtggaacatccagagaagttcgagaagtttggcatgtctccatccaaaggagttctgttttatggtcctcctggttgtggtaaaaccttgttggcgaaggcaattgccaacgagtgccaggctaacttcatcagtgtcaagggtcctgaattgcttaccatgtggtttggtgagagtgaaaccaacgtccgcgaaatttttga

SEQ ID NO: 50925 - DNA, 457 bp, Zea mays
  Clone ID: LIB3067-037-Q1-K1-A6
cacggacttgtgctcaggcaacaagaccttaacctacgacatctacggccaactcgtgctggctgcaaacgtgagctacgcgctgtaccactacgcccccttcctgctgaacctccaggactgcaagttcgtccgggccaccttcagcgccatcgcctcgcggtactgccctcctctggggcacgacctcgtgctggtctccgcgggtctggcgctcattgcctcggcctttgttctctgcctcgtctggatgctcttcgcggaccgcccccgaagggaggaggtgtccgatctggcgtcggggtcgaggatcgcgccggtagacagctctccgtcgtagaagcaagcaagcaagcggcgcaacgggatgtctatgactatgagtgaagctgcttggtcgcatggtgaccagagtttagtacagttcccttccatggctatgtaaaatagtttcggt

SEQ ID NO: 50926 - DNA, 457 bp, Zea mays
  Clone ID: LIB3067-037-Q1-K1-A7
cttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtgcggacgcgtgggcagcaaggttcggcgaggtcacgcatgtgaggtgctgtccagcattgagcagaataatgcagaatacttgcgggatgagccattgacggctgcttcgctgatcaaaacacctccgtgaacacaaacatgaggcacagaagaaatgatgaaaaataaagggattgtaacagttttggtgcctttgactgtaactggcagagtttctggggacagagtggcatggattaattgcacctgatcactctgtatgtcgctgtcatgtgtgcaatgttcaatacgta

SEQ ID NO: 50927 - DNA, 283 bp, Zea mays
  Clone ID: LIB3067-037-Q1-K1-A8
gtcgtaagggtcatgctgtgggagacattcctggtgtcaggttcaaggttgttaaggtgtctggtgtgtcgctgcttgcactcttcaaggagaagaaggagaagccaaggtcttagatcactttcggtagtcaagaatggtgtaaactgcccaaggctctattgtcaaagttaaagttctgctagcaactcagctgttaaatctgagctgtacctttttgttaacattgttacagtattacagagttctgtttccattttgaagatattaatattgcatcggc

SEQ ID NO: 50928 - DNA, 433 bp, Zea mays
  unsure at all n locations
  Clone ID: LIB3067-037-Q1-K1-A9
cccacgcgtccggttgactgcttcaaacgtaccattaaggatgagggtttctctgccttgtggaggggtaacactgctaatgttattcgttacttccctactcaggctttgaactttgcatttaaggactacttcaagaggttgtttaacttcaagaaggatagggatggttattggaagtggtttgctggcaacctggcctctggtggtgctgctggtgcttcctctttgctttttgtgtactccttggactacgcgagaacaaggttggccaatgatgcgaaggctgccaagggaggaggtgaaaggcagttcaatgggcttgtggatgtctaccgcaagacactcaagtctgatggtattgctgggctttaccgtggatttaacatctnctgtgttggaatcattgtttatcgtggtctgtactttgggc

SEQ ID NO: 50929 - DNA, 421 bp, Zea mays
  unsure at all n locations
  Clone ID: LIB3067-037-Q1-K1-B1
atcggcccccaggtgctcaggaactcgacggtcggcgtgctgctgccccccaagcagaaggacgcgacgtcgccgctgcccggctggatcatcgagtcgctcaaggcggtgcggtttatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgctggtggaggcgttcgcgggcaacgtcacgcagaaggtgccgttcgattccgccgggaaaggcgggttcaagacggcggcgttcaggttcgtggccggcggcgtccgcacccgnctcaccttttacagcttctactaccaca

SEQ ID NO: 50930 - DNA, 445 bp, Zea mays
  Clone ID: LIB3067-037-Q1-K1-B10
cggacgcgtgggcggacgcgtgggcaccgccgttgttgcagatgttgggggacggctccggggggggacaggttggattcggatctgaggggcggcagcggcaggggcgggaggcgagcgccgccggaccaggtgttggagaacgtggcgtagaggaggaggactcggactcgtataattgaaatacgaagggacccttctgccttctccgtaaacgacggcgaccctgtgagccctcgcgccaaggatagggagcaacaggagaagtttggcggtccacgtcgacgagagcaacagtggtgagcctcgccgtgttgtgtcccgtcttcaatccgtgggcttgaagatttcctgttcacctgctgttctctacagcacactcattcctcaacgtgcctctaattgatgcaggattatcaacaactagttttggaaatcttgcaag

SEQ ID NO: 50931 - DNA, 407 bp, Zea mays
  Clone ID: LIB3067-037-Q1-K1-B11
gtcagtcatgacaactactgagctatgtatgtttaagcgcatgttgccgaatgcagccgtgtgacggacatggtctcgaccatgaccggtgcaagacgcatggggaaccatggtgccaactctcacaaggtcaggagtcccaggtcgaagtcggtgattaggcgcctgaacgcgcttacttcatgggcgtatcaggccgtgatctttcggctactagcacaaggttaggtgctcgcagggcttctataccggcagtattctctacgactccgcatgctttgaataatatttcggtgaagatcatcgatctactttgcaatgctagatctgacttcacttagactcgacttatgagcagacaagtgatactgggcatcctgaacaactactagctggagatgctgctg

SEQ ID NO: 50932 - DNA, 445 bp, Zea mays
  Clone ID: LIB3067-037-Q1-K1-B12
cccacgcgtccgggtattgtttggttgccagcaagcaaatggtcggtatatttctgaccatttgggtgcgcagcgaaataagaaatgatgtgagaaacctgaaagtttcttgcgtgggtagaggactaatgggttatcttggaaataagggttctatatccataagcatgtctttgcaccacacaaccttttgttttgtctgttgtcatctgacctctggtgaaaaggagggagatgaactacggaggaactctgacgttatggaaattctaagaaagactagatttccacaggtccgtggtgctgctgatgtcaagtcaccagaaacgattcttgagcatgaccgtatcatttggcttggggatttgaattatcggattgccctatcgtactgctcggcaaaagctcttgtcgaaatgcataactggaagcaactgttagagaa

SEQ ID NO: 50933 - DNA, 410 bp, Zea mays
  Clone ID: LIB3067-037-Q1-K1-B3
gttgcatgtaaaaggaagtcgtaagaattgtggtgtgcacaagcaatttggctcatggcaagggagaacagggattcacgagaagctgtggccacgatagaagcaggtgctgctgcgatcggtgtaaggacattcaaatgatgttaccagccaattgccaactgaaaccaacgtcctggatcaatagcaggaatcttgtgcccaatagtgttgcttggaaacaaaactgatgctcctcgggctcaagcctagtgtaggctgcattattcaaaggcggtatcatatcatttttattcctccccccaccaaaattcttgggagatgtcacttctgattttggaagctcatcatatgagttagtgcggtggactttgtagagacaaagtattttgaaaggatgctttgtcatc

SEQ ID NO: 50934 - DNA, 460 bp, Zea mays
  Clone ID: LIB3067-037-Q1-K1-B6
cccacgcgtccgcaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaag

SEQ ID NO: 50935 - DNA, 459 bp, Zea mays
  Clone ID: LIB3067-037-Q1-K1-B7
ccgccctcttcattaggaccaacagcttgagttatagtcttcatagcctctgccttcatctgcatgactaacttcatgtcatcctcagaaagcccttcaagtggctgcaagtcagtcttgttgcacacaatgaccaaaggcttattcataaacagagactttatactgtggaagagtgcagcttgctgagcgatactgtacccacaagatccagaaatgtccagaaagaacaacactgcagccctcaagtgtgccagcgcagtgatgctacacatttctatgatgttcctatcttcaaaaggccggtcaagtatacctggtgtgtcaatcacttggtagcgcaggtacttgtaatctgtgtggccaacaaacagggattttgttgtaaaggcatatggctggacatccacatctgcccttgtaaccttgttcatgaacgaactcttccccacatttgga

SEQ ID NO: 50936 - DNA, 450 bp, Zea mays
  Clone ID: LIB3067-037-Q1-K1-B9
cggacgcgtgggctgtcagatccatcccttccccgggctgttaagatctgccgtggcggacgccctgcaatccgcgcgcttttcgtcgggtgggtgcaacgaatcgaccatgcttcaggaagctttggctttaagacgaaggtatacgtgatatggaaatacaacccgaaggtaggatgaacgagcgccgaagctgtggctgaaggagctttggcttagtatgatgatgaaggtggaagatgaaaccgacctaaaagggaaaagactactcagcccttgatagctcaccttatgattagcagtaaatgtcagggatatgaatgtaagtttgtccgggttgcgtcccgtgcctataaatagatgaacagtaacaccgtactgttcacgcggcattgtaatcttgcgtcactctcgcattttcacgttctagcaagccgaaggtattaatgt

SEQ ID NO: 50937 - DNA, 446 bp, Zea mays
  Clone ID: LIB3067-037-Q1-K1-C10
cccacgcgtccgcccacgcgtccgccaaggccaaggccaagcctgtcgctcctggcgccgcgtggcccaagccccgcgggcgccctcccaaggtcgccaagacctccgtcaaggcctcccccgccaaggcagccaagaaggcggctgctcctgccaagaagggaaaggcagcggcggctcctaagaaggtggcaaccccgaagaaggctgctgctgctgccgctccggtcaggaagggcgtggccaggaaggccaagaagtagtctgcccgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatggttgatcgcgtgtgatcag

SEQ ID NO: 50938 - DNA, 456 bp, Zea mays
  Clone ID: LIB3067-037-Q1-K1-A5
cccacgcgttcggccggctcgaaattcttcatcagctaccagcactggaccttctacccggggatgtgcatcgccaggataaatcttctcgcgcagtccgccctgttcgttctcacggagaagagggtgccgcagcggttgcttgagatcgcgggggtcgccacattctgggcttggtacccgttgctggtggcttccctgccgaattggttggagagggtcgcgtttgtgcttttcagcttcaccatctgcgggattcagcacgttcaattctgcctgaaccacttctcgtccgacgtgtatgtcgggccacccaagggcaatgactggtttgagaagcagacggcatgcacgctcgacatcctgtgctctccttggatggattggctccacggtggcctgcagttccagattgagcaccatctggttccccgactaccttggtgccaccttcgc

SEQ ID NO: 50939 - DNA, 121 bp, Zea mays
  Clone ID: LIB3067-036-Q1-K1-G7
agcagatctaagctccaggcagcgttgagacatagtgagctagtgagtatcacgacatcaacaatgggttccctgaaggccgcgaagcccatcggagttgcggcgcatggcaaggagccgg

SEQ ID NO: 50940 - DNA, 470 bp, Zea mays
  unsure at all n locations
  Clone ID: LIB3067-036-Q1-K1-G8
agaaggggtcccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctggcatgggagttgctcctaacattagggagacattcgttgagcttcaaatgaagaaggcattccgatatgttatcttcaaaatcgaagagaagcaaaagcaggtggttgtggagaagacaggggctactactgaaagctatgatgattttttggcctctctcccagagaatgactgccgatatgcgctgtatgattttgattntgttactggggagaatgtgcagaaaagcaagattttcttcattgcctggtccccatcgacatcccgcatacgtgctaagatgctgtactccacgtcgaatgaccgcatcaagtacgagcttgacgggt

SEQ ID NO: 50941 - DNA, 437 bp, Zea mays
  Clone ID: LIB3067-036-Q1-K1-H10
cccacgcgtccgcttctcctccccctccggttcgggttcgggttcgtgaggttctccggggggcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcg

SEQ ID NO: 50942 - DNA, 447 bp, Zea mays
  unsure at all n locations
  Clone ID: LIB3067-036-Q1-K1-H11
ggctccaacaatccaccggcaccaacccagcgcggcgccaccggcgacccgtaccccctcccgcggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgcccgactcgccgncgacgcctgaactcgtcagtctcggtctaaatttactctgtcctgcctcttgcggtgttcagtgctgtgc

SEQ ID NO: 50943 - DNA, 401 bp, Zea mays
  Clone ID: LIB3067-036-Q1-K1-H12
aaaccagaaatgaacatcgagatgctcccggcccagctcttcttccgattgaatggcagctgggctgagccatacctcctcccaacaatgtcagcaaaaccatcgccaccgctcatcatcgacaaggagacgatcccgatgggggactcacgccagaagactaaaacgctgaacagcagcaccaggacataatagagtggacctctcagcaattcctctggttttccttcacgtgtcactgattttaccagagcttcatcagtgtagagacggagtccatatatcagaagcctcatggagttcaggaacgggacaaccgcggcgaaataccgtgcttctgtcgaattgctgaacaagggccaagatgacatgaacaggacgccggatagcacgtgcacaac

SEQ ID NO: 50944 - DNA, 163 bp, Zea mays
  unsure at all n locations
  Clone ID: LIB3067-036-Q1-K1-H4
cggacgcgtgggccgagatcgacngcgcccttgggatgggcccgacgttcggcgccatggtgatctgctgccagaatgcggcgcacctggcgctgtaggcactgggcaggcccaacgccgtggacgtgaccatcccagaggtgtcgccagcgcttctcgagga

SEQ ID NO: 50945 - DNA, 266 bp, Zea mays
  Clone ID: LIB3067-036-Q1-K1-H6
cccacgcgtccgggagcgctggtgccggcggtgcgtgccctggtgcaccgcatggcactggaccacgttcacgcatcatggcccgctgcccgccgctagtgccacactttcactagcacccgtacccgcagctcttggcctcttgccgtcgcaccatgcctgcgcgtccgactcctgctgcgcactgaccctgcccgtcccgcccatctagaggacgacagcgccgccatgcgcccgttacgcagcctgatcgcgcctgctccttc

SEQ ID NO: 50946 - DNA, 260 bp, Zea mays
  Clone ID: LIB3067-036-Q1-K1-H8
agagctcaaccaatctgtctcttgctagctgctagggctattgtttccattttgcagactttgtgattcgtaaaattctttggttggtgcaaaatagaatttttctaaataattaaatatttatattgtcaaatgaaagcaccagcaatggtacctccatgttcatgtttataattatctgtgattcttacatatttcaattactatgcttatttgttaaggttaagaagtattatcatgtgacctgccttttgtccacc

SEQ ID NO: 50947 - DNA, 198 bp, Zea mays
  Clone ID: LIB3067-036-Q1-K1-H9
gtgaagatccccagttggacataactctttttattacgtgcaggcaatcaccacaaagtgtgtggggtttggctgcagtgcacgctattactccatggctgatggacagagctacgtcgagaagcatctttttggatatccaaaaagagctatcctttgacgaccggttcaaatccgactcaacccagatgacttaat

SEQ ID NO: 50948 - DNA, 210 bp, Zea mays
  Clone ID: LIB3067-037-Q1-K1-A1
tcgcccacgcgtccgaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaaaaggggtaatgagaaaaatcaaatgaaaaataaaaaaaaagagaa

SEQ ID NO: 50949 - DNA, 440 bp, Zea mays
  Clone ID: LIB3067-037-Q1-K1-A10
cccacgcgtccgcccacgcgtccggacggtgacgccacggatcacggtgagcgacgggcgggtgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacggcgacgacgcccccgcgtacgtggtgatgcttccgctgctggaggggcagtttcgggcggcgctgcaggggaacgaccgcgacgagctgc

SEQ ID NO: 50950 - DNA, 436 bp, Zea mays
  Clone ID: LIB3067-037-Q1-K1-A11
gttgaaacgtgtttttgtcatcggtttctcaatcattgtttttggcaacaaagtgggcacagaaactggaattggcacgtccattgccatagctggtgttgctatgtactcttacattaaggctaagattgaagaggagaaaaggaaaaagagcgcatgactgctgtgaataatattatcgggaccttcctcggacacaacatcgtcgacaatcacgacctacttctataccttgttttgttttcatcttgagtcagtcggtccattgtttgatcccagtctggtgattaaaagtctgcaaattctgtttgtggaattggcagcgatacaaatttggcttctttaagtaaatccggttggcggtacacagcggtattaattcacctgtaactgaatggaataccgtaatgcaaaaggcacaacactctgcctgact

SEQ ID NO: 50951 - DNA, 442 bp, Zea mays
  Clone ID: LIB3067-037-Q1-K1-A12
ggctcggtggtgcggtacgtgctgctcccgcaggacggcgtggacgtggacatcgggcacgaggccaccaggagggaggcgcgcggaggctgatcggcatcggcatcggcccccctcacctgtgctgcttctcccccggggaggagattgatctgccttgccctgatctcgtctggttgtacgaaacatatgctgatctgagtggccccaactcccccagcacacacttgatccaccacccacccagctccctgcctggtacttgcatgttccttgctgtgtgtgtgtgtgttcagcacacacttgatccaccacccacccagctccctgcctggtacttgcatgttccttgctgtgtgtgtgtgtgttcagcacacacttgatccaccacccacccagctccctgcctggtacttgcatgttccttggctgttgtgtgtgt

SEQ ID NO: 50952 - DNA, 344 bp, Zea mays
  Clone ID: LIB3067-037-Q1-K1-A3
cccacgcgtccggaaggctgatgtttcaccagagttaggattctgcacgatctgttatgatgatcttgttatctgtaccatctcagcatcgatttcttgaaactcctaacggaaaaaaaaaggaatacgaatgggtgtacaggtttcagattttgaattatatgattacggtgtcagggccatggcatattggtatgcatataaagactacatcatagagtaaccagatggtgtacatcatctgattaccgcaataagcagagcactacatttgggagcaatgtaaatcatgttacctaggattttgaaagttgaagggtatctcaaaacagactagatcgcga

SEQ ID NO: 50953 - DNA, 232 bp, Zea mays
  Clone ID: LIB3067-037-Q1-K1-A4
atactcacacacacacctatacccattgatgaacacattatttgacttcaaaactatctattacaagcgtcgccttatttctacttgtaactcatcaataaaaatataactcaaatctacaactcatactactttccaaatcttactacacaactttaaaatgctaaatctattttatctaacttaatgccatagtataaattcatctatataatatcttcactatctacat

SEQ ID NO: 50954 - DNA, 468 bp, Zea mays
  Clone ID: LIB3067-036-Q1-K1-G5
aagagatggaaattgattctatagatttacatgctacttaacaatttacaacttatagcacgctcgggtactttcttctctataacataaatataatgtataactatctctctcatatgatttatgttaatataaaaatatattacatgtacaaatatattaacttaattagtttcctctaaattataattagtagaatgaaattcaatttcaacgaaacaaaccgggcccaagagagtattggactgtatggaaaacaggggtgatgagaaatcctcaagatctccaattttttctctactgttttttttaaaatgtatgtcaataatagtgtccatcttgggaatgcaaactaaacgttcaacaacattctgttggtaggctctgaagatataagctcatatgttgtctttatgattgatagtcagtgataacagttctggagttggcaaatgcacatttaaattc

SEQ ID NO: 50955 - DNA, 158 bp, Zea mays
  Clone ID: LIB3067-036-Q1-K1-F1
aaaaaaaaaaaaaaaaaaaaaaaataaaaaaaaaaaaaaaaaaaaaaaaaaaaaaaagaaaagaaaaaaaaaaaaaaaaaaaaaaaaaaaaaaaaaaaaaaaaaaaaaaaaaaaaaaaaaaaaaaaaaaaaaaaaaaaaagggccgattattaaaaag

SEQ ID NO: 50956 - DNA, 447 bp, Zea mays
  Clone ID: LIB3067-036-Q1-K1-F10
gcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacacccgtgctggtggccacagcagaccagaccctggaggacgtcgagtgccacttcg

SEQ ID NO: 50957 - DNA, 447 bp, Zea mays
  Clone ID: LIB3067-036-Q1-K1-F12
gttctttcttagtttgtactctatccattctaaattataagtcattctaatattgtttgagcgacaagtttgattaaagctatagagaaaattatgaagattcatatcaaatgtaaaatctaaattaataagaatctagtgacatttagtatcataaatgttattattttaatgtacaacttaggttagacttaatatttctttgactcctcaagaaagttggactgacttaccatttaggatggagtatgatttattattgtcttataaaagcctggatcggtatactctgaatatctgagtacctacatgatgagtatttgtaagatgtgtgaaggtcgactgctaggtatacattgtcagtatgaaatggctatcgtcttcagctttctttcctggtcagtggacagtgaaatatttatacgatgtgttaatgtggactgctct

SEQ ID NO: 50958 - DNA, 470 bp, Zea mays
  unsure at all n locations
  Clone ID: LIB3067-036-Q1-K1-F2
cggacgcgtgggatacgctggggcgcttgagccggattgctccagcttggacgcctnctgtggatagctgatggactcgcttccctaactcaagagttgccatgtgtcttcaagccgccctgattagagaacccacatggagatccaggccaagaatgacaacgtctttacggacatggggctaaccttctagagcattgagaccatatgcagagaggtccagatcaagaacgacaacatcaagacggtcatggcgccaccttttagagcgttgacaccatagttggagaggtttagtgctaggctagatggggtgacatgagcatggctacagctgcgttggggctgctttattctttatttctttaatcctctatagtttcgtgactaaattaataattcccattaagattggagataaataaacctagaacattaaaatatcttttcttcaccaaaactcaatttaa

SEQ ID NO: 50959 - DNA, 316 bp, Zea mays
  Clone ID: LIB3067-036-Q1-K1-F3
aaaaccgtatcgtctcgcctgttcagtttccttctcctcttcccgcatcccggtttgccgagcaggttccaccgttccagagtagccaagcgaatcccgtgtctggttcgcgcgatggctgatgagcattttaacccccatcaccagcatgcggaggagagttaggttatggttgagcatcagcattctaggagggcccctaatctgaggtacctggacttcgtccaggtggctgttgcccaggccgcggtgtgccttgctgggctctactgccttaccaaggaccacgctggtccgctccgtcttagcgttgacg

SEQ ID NO: 50960 - DNA, 273 bp, Zea mays
  unsure at all n locations
  Clone ID: LIB3067-036-Q1-K1-F4
cccacgcgttcgctgacacgtgggcatttactgncgacgctgcagcaggaagccaaataggagagggtccatcgagtcgaccaccgaacacggttagggccgctgggctcgccgtggccacagcttatgaattcaattccccactccttaccggcgcccgctggattataaatagattccctcgtcactgtcgctgtctcggctggatcggattcaactcacctaccccaccctctcgatatcttcccagctttggctactttctacgccacc

SEQ ID NO: 50961 - DNA, 473 bp, Zea mays
  Clone ID: LIB3067-036-Q1-K1-F5
ccccaacatcgtccacgagcccgtcatttacagattgaatgaagctgttatgcattttggagagagcatcaaggaaatcatcaatgaggagtttggtgatggaatcatgtcagccatagacttctattgttcaatttgccaaggttgaaggggccgacggaaaagatcgtgtggtggtcacatttgatgggaagtatctaccttacactgaacagaaatctgaacatatgatgtctaggcctacccgcaagacatcttgatgtggctggtgaggaggagaaacatgatcgtagtggtaggtatcgggctcagcaaggatcgagcatgccattttctttgggtagtccatatcatcaacacaataaacagacctatattgatgataactgtcaaaaggaacattaaagtcaatgttctacctggcatgattgctggactgtattggatgatgctgagataaaaagagagaaaaa

SEQ ID NO: 50962 - DNA, 466 bp, Zea mays
  Clone ID: LIB3067-036-Q1-K1-F6
catacttctgcattaggttgtcttaaaaatgcattacgtagagcatgtaccaaaatttttgttagctataattgatgtttagtacatatagtataaaaggcaaggtttttgttacaaagaaaatactctctgtttgtgtgtgtgtttgcttaagtgttatggattattcattttttgtaaatttagtgatatttttatttgacctgctgcacacctagctaatagttcatttctctgttggcatagcaagaagtggtacacaggttgcatttggacaaggaaactcttattatgcaagaaattttcccatgcccaaaaaggattcttcagcaggtggagcttcgaagttaccaaaagaatatgcagaaccatgggactatagccatgattatcctgttactctcccactaaggaagccctactctggaaatcctgaaattctggatgaggaagaatttggagaatc

SEQ ID NO: 50963 - DNA, 442 bp, Zea mays
  Clone ID: LIB3067-036-Q1-K1-F7
gctaagagagctcaagaaagaagaattcatcgagtacttcaaccagtatataaaagtggacgcgcctgaaaggaggacactaagcgtgcaagtcttcggcggcaaccatttggtagagttcaagaaggcaatcaacgaagccgacccgtccaaaatgtacagaattacatacatattctgcttcaaacgatcgaagccgctgtacagctcactcaagggaggtcctggcaggatcaccatggactgacagccggcaatagcatgccttgtttttcatgtatgtagtgtaatggccagtgcatacgaatgatgaattcgattctgaatcctgctcctgcattaaattcgagtgcatgaatgatctatacttcactgttggttttacgaccagcgtgtacttttctggcaaaaatctagggagctggataaagtcatgtatgtt

SEQ ID NO: 50964 - DNA, 447 bp, Zea mays
  Clone ID: LIB3067-036-Q1-K1-F9
caaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattct

SEQ ID NO: 50965 - DNA, 380 bp, Zea mays
  unsure at all n locations
  Clone ID: LIB3067-036-Q1-K1-G1
gaactcgactgctgttggcatgaaacagggtcgtgagcaaagctccatacagccccgctaagtcgtccgatggcatggagtcaccgaggattgaggtgacagcggagggcaaggcccagtaacttgaaaggtccccgcgaagtcccatcggtgaaggctgacgttgtgggaaggggcatggacatgctgntgttgcctttatgttatgtggcggctgcagcgtggaaccgcactaataatgtggaccggaacctctgttactgtggtttgtgctgtcgcgtgctaggtttatgctgaagtggattccttcactccacacaccgaactgtctgttgtacatcacgccggtggtctcgtctgtctgacttcgttacatggat

SEQ ID NO: 50966 - DNA, 137 bp, Zea mays
  Clone ID: LIB3067-036-Q1-K1-G11
gcgttgcttcttgtacctactggtgtttttcttgttgttgggatcagagcgcacctagtggtccgtttatgtaccagctgttgtatgcgaatccatctgtgccttcatcacctaatgcactctctgttgctgctggc

SEQ ID NO: 50967 - DNA, 380 bp, Zea mays
  Clone ID: LIB3067-036-Q1-K1-G12
cccacgcgtccgcaccatcaagatcgatctggagaccaacaagattgtgtcgttggccttggggagcgggtcagggtagcggatggtgcggccaacgacaccatcaagatcgatctggagaccaacaagattgtggacttcatcaagtttgatgttggcaacgtcgtcatggtgactggtggaaggaacactggccgcgtgggtgttatcaagaacagggagaagcataagggcagctttgagaccattcacgtggaggactcccttggccaccagttcgccacccgtatgggcaacgtgttcaccatcggcaagggtaataagccgtgggtgagccttgccaaaggcaagggaatcaagctgagcatcatagaagagca

SEQ ID NO: 50968 - DNA, 62 bp, Zea mays
  Clone ID: LIB3067-036-Q1-K1-G2
cccacgcgttcgctaccctgctttgaaacataaaaggatgattaccatgccagcaatcttgc

SEQ ID NO: 50969 - DNA, 379 bp, Zea mays
  Clone ID: LIB3067-036-Q1-K1-G3
cggacgcgtgggcggactcgtgtttactagtggatccattgctggacacttgatggcaacggcctttgctattcttgggggagcattcctggccaactacttgtccgagaagctggtttgcttgttaggagtagtattatttttgctctttgctgctgtattgtctttttggtgtaattctaatctatctgaagaatttgctagttaggggaaagacctcatagttccagtttggtcttagattatgaagatgaggggcaaacccaagtaggcttgagacatgctggatgtagatagacgttatacttatcagagatgatttctatgagcccaaatatctaccagacagactggaaactgcatcacatggacagcctac

SEQ ID NO: 50970 - DNA, 118 bp, Zea mays
  unsure at all n locations
  Clone ID: LIB3067-036-Q1-K1-G4
cgccaagcgtgccttcgtgcactgatatgtttgcngctgctatagaagtggtggctactgaggtggctgcagctactgaggtggtggctattgtggtagcagccaaagctatgatgct

SEQ ID NO: 50971 - DNA, 451 bp, Zea mays
  Clone ID: LIB3067-036-Q1-K1-E9
cggacgcgtgggtaatggtagtcttgaagaaaagatcaaagaactcaaggccgagaaggatgagcttcgggatgagaagcaaaagctgaaattggagaaggagagtttagaacaccagatgaagctgatgacatcgactccaacctacatgcctcatccgaccttgatgctggcgcctttccctcaggcacccctagcgtcgttccatgcccaggggcaagctgcagggcagaagctgatgatgccctttgtcagctatccggggtacccaatgtggcagttccatgccgccttcagaggtcgacacctcgaagaacagtgaagcgtgccctgctgttgcataattgcttcgactagcggctggtcctgctcacaccatgcgaattagtcgcaactgaagcccccctagctgttgatccattgattggctataactgatgttgttatattt

SEQ ID NO: 50972 - DNA, 195 bp, Zea mays
  Clone ID: LIB3067-018-Q1-K1-C8
cccacgcgtccgccttgagtaaggaaaatagggatgggcatggattaatccattgatctaggtcgcttaagtaaaaaaaaaaaaaaaaaaaaaaaaaaaaaaaaaaaaaaataaaaaaaaaaaaaaaaaaaaaaaaaaaaaaaaaaaaaaataaaaaaaaaaaaagaaaaaataaaaaaaaaagaaaaataaata

SEQ ID NO: 50973 - DNA, 370 bp, Zea mays
  Clone ID: LIB3067-018-Q1-K1-C9
gaagaccagctcccctctcctgatcgtcctgttcctcacagcagcagccatggcggccgagccggagaagcaggcggcccccgcggcacaggagacggccgtgcacatcgggtacgttgaccgcccctaggacgccaaccctgaggagtccaaaatcggaaccttaaccccggtcttgggcaccaaccataaggccagggcccacaggttttacacattcacaggacacgcctccgagggttcttcgcgaaaagttaaccccacaacatgaaagggatctaagggcgaccccatgtgctccacattgtgcccagacacactctcccgatacacagggctgggtctcggactctccacggcgcgacacaca

SEQ ID NO: 50974 - DNA, 179 bp, Zea mays
  Clone ID: LIB3067-018-Q1-K1-D1
cgccagccagccatcgtcacactggtgagctctgcactctgcttagctccgagcttcagtgccttcgttgtttggtccacgcagtccacacacacacaccagtacgttcaagttgacttgtaccattggccgcctccaaggtcaaggtcccaattgcggttccctcgaggaggttgccc

SEQ ID NO: 50975 - DNA, 414 bp, Zea mays
  Clone ID: LIB3067-018-Q1-K1-D11
agaacacagggcacacgcacggcacgcagatacatatagagagaggttagctatagcttgcacatctatttaactaactaactaactggctagctagctcgatcggcagagcaaagcgaaagcagcaagaagcaaagcaatggagaaccctgcgagtgtgctagttctaccagcgcagttcaccaaactcaccttccgaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggtatactgctcg

SEQ ID NO: 50976 - DNA, 432 bp, Zea mays
  Clone ID: LIB3067-018-Q1-K1-D12
cataggctgagctttgttgagatggttgttccttatggagatccaagtgaaccacattatcgcaagaatgcatttgatgctggagaagatggacttggaaaaaatgctcattctcttaagaagggatgcgattgcttgggctacataaaatattttgatgcacatttcacaaacttcactggtggtgtggagacaattgagaactgtgtttgtttgcatgaggaggatcatgggatcctttggaaacatcaagactggagaactggtttagcagaagtaaggcggtcaaggaggctcactgtttcatttatctgtacagttgcaaactatgagtatggtttttactggcacttctatcaggatgggaaaatagaggcagaagtaaagcttactggaattctcagcttaggggctttgatgcctggggaatcg

SEQ ID NO: 50977 - DNA, 77 bp, Zea mays
  Clone ID: LIB3067-018-Q1-K1-D2
ggaagagtgaaatgaggcatgagaagaagcctgatgatggagaaactaactcatctaagagtctcagtggctctgac

SEQ ID NO: 50978 - DNA, 292 bp, Zea mays
  Clone ID: LIB3067-018-Q1-K1-D4
cccacgcgttcgcccacgcgtccgcccacgcgttcgcccacgcgtccggagagatccggagcagccgcggtcccaccgaccccgccgccggtcgccctccatctcctcgccgctgcctctcgatctttgtacagtttctcttttcaataatcaagatgagccgtggtggtagtgccggtggtggtcaaagttctctgggttatcttcttggaagctgggagccccccaaaccagcattggcaccagctgcaagtgctccacctgttgtgaaaccatatgctgcaaagactga

SEQ ID NO: 50979 - DNA, 283 bp, Zea mays
  Clone ID: LIB3067-018-Q1-K1-D6
cggacgcgtgggctgcgccgcagcaatggtggtttccctcgccgaataaatctcaccggtcgcgcttcttggcgtgttcctccgctcgcctgggcttcgatctccagccctcgcgtgagcgcgggtgccgacgcggcgccgtgttcatggcaacggaggattgggacctgcggtaggaggacgcctcgcctacgagttccagtttgacctttagaaccccttcatcaggcccggcgaccagccgaacggcaagcttcttgaaccccaagggcaacaagccgcc

SEQ ID NO: 50980 - DNA, 68 bp, Zea mays
  Clone ID: LIB3067-018-Q1-K1-D7
accacgcgtgcgggaagcacaatatacaccaaaactctggtatagcaatagaaagaaggtggtaggct

SEQ ID NO: 50981 - DNA, 302 bp, Zea mays
  unsure at all n locations
  Clone ID: LIB3067-018-Q1-K1-E1
cggacgcgtgggctaccggatctcctgcgactaccaggcggacccgcggttctgcatccgcggcacgtcggtgaccatcaccgccaccaacctgtgccctcccaactacgcgctgcccaacgacgacggcggctggtgcaacccgccgcggcagcacttcgacatggccgagccggcctggctcaagatcggcatctaccgcggcggcatcgtgcccgtcaactaccatagggtgccgtgtgtgaagaaaggcggngtgaggttcagcatcaacgggcgcgactacttcgagctggtgctca

SEQ ID NO: 50982 - DNA, 376 bp, Zea mays
  Clone ID: LIB3067-018-Q1-K1-E11
aactacaggcgttcgcatatcaacatgcgttggaaccactatcctacagaaagatctactctggggaattctgcactgaattaatcacaccctactatctggaacctgttgaaaggtgggaagaaattgctggcacagtctttcagcacttcgaacttgatggccaccgattgatatcagccgatgagttagcacacgaactaaatgtgtcgccgacacattacttcattgtgcatgactggatcacaaaatcggacggcatgcttaacttctttgggttcaccagaattcttcacggtgtcacgatactgggtttaaatacaatacgacactaaacagatgcaaactgtattcacttctaatttgaagactctca

SEQ ID NO: 50983 - DNA, 200 bp, Zea mays
  Clone ID: LIB3067-018-Q1-K1-E2
aaaaaaaaaaaaaaaaaaaaaaaaaaaaaaaataaaaaaaaaaaaaaaaaaaaataaaaaaaggaaaaaaaaaaaaaaaaaaaaaaataaaaaaaataaaaataaaaataaaaaaaaaataaaaaaaaaaaattgtaaatatatataaaacaaaataaaatatagaaaaaatataattaaaaaaataaaaaaatataaaa

SEQ ID NO: 50984 - DNA, 162 bp, Zea mays
  Clone ID: LIB3067-018-Q1-K1-E3
ctcaaattacaactgtgcatcactgtttttgtcctccatgagtagcatgattattttgtaacaatattaggattccatatctgtttcaagcactactttaatttaaccccattaagtgttaaaaaaaaaaaaaaaaaaaaaaaaaaaaaaaaaaagaaaggg

SEQ ID NO: 50985 - DNA, 316 bp, Zea mays
  Clone ID: LIB3067-018-Q1-K1-E4
cccacgcgtccgcccacgcgtccgcccacgcgtccgcccacgcgtccggttcgcgatcgggcaaacctgcaaccctttcctcttcgtccccccgctctctcgttgccccaagccggagtacggagtacggcagtcgcacccccgtcgtcccgttccttggtcgacccaaattcgccggcgcgttcccctcggctcctagtgatgtctggtggtaacgcgtggtcgccggtcccttcgcacggatttgaatccgacttcggcggcatggggagccgcgcaagcgaacctgtggcgaggaccaacaacagcggcggtg

SEQ ID NO: 50986 - DNA, 229 bp, Zea mays
  Clone ID: LIB3067-018-Q1-K1-E6
gaggagcgtgttgttggctggtacagcactggcccaaaactattggagaacgacttgtgtgtgcatgcatgattcaacagttatgttcctaatacagtcttggagattattgatgtccaacctaaggagctgggtataccgaccaaagcgtactacgctgtggaggatgttaaatagaatgcaactcagaaaagtcagaatgtatttgtccatgttccttcagaaattg

SEQ ID NO: 50987 - DNA, 477 bp, Zea mays
  unsure at all n locations
  Clone ID: LIB3067-018-Q1-K1-E7
ggtgagatgttaggttcaggcaaatcaacaccaaagttgcttcagatgtatgttccttatgctgtttttgctgtcattgctattctacgtggactttgctcatgctctggacgcactactgctggttcatcacttgggccttctgcccggaagaagagggtctagatcagcagtgacacttggagaattttcggtttgagacagtggcgccagagcactaatgctggtcagaagacgattatctggatcaagtttctaatcctgggatttaacacggatgttgaaaaatccaaatagtgttagttgcctgttctctaagatttggtggttcgtttcccttgaatgtgatattcatcttgcctttatttncattttaccctttgattatatgtcttgctaactaagacattgttttgtttactggatgaactgattcaactctgggattgttctggcgaataaagttcataaatcctt

SEQ ID NO: 50988 - DNA, 117 bp, Zea mays
  Clone ID: LIB3067-018-Q1-K1-E8
attgagccattggttatcagtgtataatctctatgaaggcattttggtggcagtggccttgtctgtcattggctacaacgttctagataaaaaaacatttaaattttgtggaagttg

SEQ ID NO: 50989 - DNA, 433 bp, Zea mays
  Clone ID: LIB3067-018-Q1-K1-C6
cggacgcgtgggcggacgcgtggggggatcggtgccgggctgtgaagtgaagaaaaatttcaaatcgagccagtttttgttctagtttagatcaaaacgaacatatataatggagtacactaaattctaaaccaggcctgttcgttcctccccgaacgaggactagaactagccaaactgttagaaacgaacggcctcctaggtcttgttcgtttacaccaatccagctctgtattaacaatctatgccacaatctattcccttagaccttgttcgtttatgagcgcctaggccaaaaaggcgtgtggaactacagtctaccgttcatatccgacgttgtagatcctagcgcgaatggttgacatcactagtcctgacatcaagcttggtgcaacgacgcgttacggacattaagattgtgtcacatatgtgc

SEQ ID NO: 50990 - DNA, 394 bp, Zea mays
  Clone ID: LIB3067-018-Q1-K1-B1
cccacgcgtccggcaagaccaatttgggagacttttacctacatttattcaaataattgatgttggcggaagaggaagaggaagagtattggatggttgtatctgccatattcgagggaaaggaaacttgcagtctaccatctgaatcgagttatgctgataaatcatcatctgaacctccaagttctactccattaagcgaccccatcaacaataaggtgcatttgctcagaaccatgcttcaatgggaggagcaagttcgtcgtggcgcatctttggcagagaaaagtctcagtgcaagcatctgcacaaaggcaatcctgcgtgaagtggccataatattcttgcctaatggcaagattattagaatgagcacttgtagcacaactgctga

SEQ ID NO: 50991 - DNA, 395 bp, Zea mays
  Clone ID: LIB3067-018-Q1-K1-B10
gtaacggcgtctgcctgctctaccgcgagtggcatcgcccgctccgcacgctcgatcccacccaggaccacaagctcatgttcggactcctcttctcccttcgctccttcaccgccaagatcgacccaaccacggctgaaaagggaaatcttggagtgccactgctgccaggccaaggttgctcgttttatagcttcaagacaaacacatacaaactgaacttcatggagagcccttctggtataaagcttatattaattacacatccaaggactggtgatcagcgagactcgctaaaacatatatacaatctatatgtggaatatgttgtaaaaaatcctctgtatgctcctggaacaccaatcaagtgtgaaactttcaattaaacatctcga

SEQ ID NO: 50992 - DNA, 364 bp, Zea mays
  Clone ID: LIB3067-018-Q1-K1-B11
cccacgcgtccgggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctgcgtccgtccgccttgctacaagcaggcagccacaccaataagctagctcttgttgttgatttgtatgtttgattgggtgtcccttcccagtcgagatggaataaaataaatcatcaagcgcc

SEQ ID NO: 50993 - DNA, 229 bp, Zea mays
  Clone ID: LIB3067-018-Q1-K1-B2
ccaaggcgtccgcggccccttgggcttcttaagcctggccgacctgaaccatgtgcctgtgattttttgcctgttcgttacgccttacgcatttgtgctcgacgcctacccgaatgtaaaggcctgtgggtctggcctgatggaaaggccgtttgtccaaaaggtcgctgccctgttgaagccatttgcttgaaacggttgccctgtcaatcgttgattggattaagcc

SEQ ID NO: 50994 - DNA, 308 bp, Zea mays
  Clone ID: LIB3067-018-Q1-K1-B3
cagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagatgcctttgcggagtttggtgaagttttgcatgctcgagttgtgaccgatcgtgtcagtgggttttctaagggatttggctttgtaaggtatgctacgaccgaagaggcagccaagggaat

SEQ ID NO: 50995 - DNA, 346 bp, Zea mays
  Clone ID: LIB3067-018-Q1-K1-B4
ccaccatcctctacaagctcaagctcggcgagatcgtcaccaccatccccaccatcggtttcaatgttgaaactgttgagtacaagaacattagcttcactgtctgggatgtcgggggtcaggacaagattagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagaatactgacaagcttggattaca

SEQ ID NO: 50996 - DNA, 348 bp, Zea mays
  Clone ID: LIB3067-018-Q1-K1-B5
cccaaacccaaaaccctaccacggcgcccatggcttcgccgccgcctcctcctgcccggcaccccacctccgcagcaaccgccgctgcggcgggcaatggccacgacacctcctgagcaaccgccgctgcggcgggaaatagccacgccacctccgcttcgccggtggacgccctcttgctccagaacctcatgacccgcgttcagctccgaccgcccttcctcgacaccaactcattcctcacccaggaccttgacgacttcctcctcaacgagttcgccgcgctatccgccgctgcaggggcgtcggatgatgacgaagacgttgaggatgaggatggtgggctcg

SEQ ID NO: 50997 - DNA, 81 bp, Zea mays
  Clone ID: LIB3067-018-Q1-K1-B6
tcgtccacgcgtccgcccacgcgttcggctgaagatgtggactgggagaaccttttggagcacaggtctggggagctttgc

SEQ ID NO: 50998 - DNA, 453 bp, Zea mays
  Clone ID: LIB3067-018-Q1-K1-B7
caaagaagctccatccagacacaaataaaggtgatgcggatgcagaacgcaagtttcaagaggttcaacgagcttatgagactttaaaggatgaacaaaaaagatcattatatgatcaggttggccctgagcagtatgagaaaactgcttctggcggaggcggaactggcttcgagggtggttttggaaatccatttgaggatatttttggtggtggcggtggcggtggtggaatgaatgatttctttaggaacattttcggggatagggactttggaggacgagatgttaaggttgcactcgaactatcatttgtggaagcagttcaaggttgcagcaaaacggtcaccttccaaacgtctgtaacatgtgaaatctgtggtggagccggtgtgccttctggaaccacaccttgaacatgtctatcttgcaagggttcaaggattatattca

SEQ ID NO: 50999 - DNA, 305 bp, Zea mays
  unsure at all n locations
  Clone ID: LIB3067-018-Q1-K1-B8
gccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgncttcagatctgccaggaggaggacgactggaagcgcatcgaggaccgaatcggatg

SEQ ID NO: 51000 - DNA, 433 bp, Zea mays
  Clone ID: LIB3067-018-Q1-K1-B9
gacccacgcgtccgcccactcgtccgccactcccaaatcgcgtcgcgtcgcgtcgagagcgagagctgaagaggtgcgcgcgggggaaccgagccgactgatggagccgacggctgcgcccgtcgcctgcgagatcgcgcgcctgccggatgacctcctgtcagcggcgctcggccggacggtgcctatggactcctgccgcgccgactcggtctcgtcggcctttcgcgccgcgtccgacgccgactccgtctggtccagcttcctgccgtccgacctgccctcgctcgccgatggggagctccccgccgacgcgacggccaccaagaagcagctcttcatgcgcctctacgaccccgacagacccgtcctactcgccgacggcctcacgagcatgtggctggacagggccaccgtggccaaatgttacatg

SEQ ID NO: 51001 - DNA, 376 bp, Zea mays
  Clone ID: LIB3067-018-Q1-K1-C1
ggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaaggtagggccgaaccggtgcagcgcctgcatgaaagagggttggacttacggg

SEQ ID NO: 51002 - DNA, 71 bp, Zea mays
  Clone ID: LIB3067-018-Q1-K1-C10
cgccaaaagtccagctctatgtgtctgcggctcgagccaagctctcaatatctgtcagtttaatttgcacg

SEQ ID NO: 51003 - DNA, 176 bp, Zea mays
  Clone ID: LIB3067-018-Q1-K1-C11
aaaaaaaagaaaaaataaaaagataaaaaaaataaagaaaaaatgaaaaaaataatagggaagaaggaaagaatgaatacgaatgcatgaaatagacattaaaatagtatgaattgggctgctttgcaatgtcattggagagcgtttaactatgtatcacctgtatattcgttgat

SEQ ID NO: 51004 - DNA, 440 bp, Zea mays
  Clone ID: LIB3067-018-Q1-K1-C12
atctcctcgcatttcttcccatcccccttcgcaacccaaaccccaactcgccccgcatcgatggcgcccaaggccgagaagaagcccgcggcgaagaagccggcggaggaggagcccgcggccgagaaggcgcccgccgggaagaagccgaaggcggagaagcgggtccccgctggcaagtccgctgccaaggagggcggcgagggcaagaggggcaagaagaagggcaagaagagcgtggagacctacaagatctacatcttcaaggtgctgaagcaggtgcacccggacattggcatctcctccaaggccatgtcgatcatgaactccttcattaacgatatcttcgagaagctcgctgctgaggccgtcaagctcgcgcgctataacaagaagcctaccatcacctgccgtgagatccagacctccgtgcgcctcgt

SEQ ID NO: 51005 - DNA, 373 bp, Zea mays
  Clone ID: LIB3067-018-Q1-K1-C2
cccacgcgtccgcagattcagatctgtttcctgtttctctacccccaccacctcctccacctgcattacccccaattgaaagagttattgcaaatcccattgttccaccagaaaagcgatatagtcctccaccaaagacaagtagctctacttctgccacatcattctctattgcatctcttcagcaatatacaaatagcttcagagaggagaatgtgataagagagagtagattaggaaaggtttacctagcagagcttcctgatggcaagttattggaggttttgaagattgacaatgctaatgggaagaatatcaagtgatgactttctaaaaaaggttgaatgtatcttagatatcaagcatcctaaca

SEQ ID NO: 51006 - DNA, 374 bp, Zea mays
  Clone ID: LIB3067-018-Q1-K1-C3
atttcttgtaagcactggattaacagcgactggccccattgatcatacggattcgtgaagacttgcgttgtgaccccgaaacaaattcttgaagcctcttcttggacagcgaatgaatggagttgacgactagaggtgttctgcttaattaattgcttgcccgtcgcgatggttactgtttctttcaggatgactcgttctggtgtgtaagatcaggtgatgtgcagctcccccttcctgtgcatgattagcccccctccttgagtgcaagtgtagacataggatgctatctgtttgtttggttacctcaatttaagctgaactgtacaatgctgatatagtttcctgggtctgaagcattctcttcttgaaaa

SEQ ID NO: 51007 - DNA, 95 bp, Zea mays
  Clone ID: LIB3067-018-Q1-K1-C5
cccacgcgtccgcccacgcgtccgaaaaaaaaaaaaaaaaaaaaaaaaaaaaaggaaaaaggcagaaataacaagggctgtcggccttctggctc

SEQ ID NO: 51008 - DNA, 446 bp, Zea mays
  Clone ID: LIB3067-018-Q1-K1-A9
atgtgaggtctattcctattgatgagatctatccacattgagtaagcacacaacatcagcgagcattgccatcatatgcatcattcagaaatccaggatcagggccgtaaaagggttggactatgtatctgcaacatcgcaagcaacagggaggctgtctcttcagaaattttcaagaggacgtgtcagtaacatactcaggaggccgtctcttcattcaaagagtatcttttacacgacttcttgagtataaaaaactcatttgtacaatcctacctgtctattgaattgtctttagaaaaaaaaagtctttattgtatgtactttttttttttatcttttatgcctgaagaactgttttccccttttcttttagaagtaggagccggtaaagctactctttcaatttgtcacaagcattatttatttttataatttgtcctctg

SEQ ID NO: 51009 - DNA, 421 bp, Zea mays
  Clone ID: LIB3067-017-Q1-K1-H12
cggacgcgtgggcgtgcagatattggccttatagtggaacaattcattgctgagtttgaagtagcagccgaagaagatgcaaacttgaataggcaatcaaaaccagccattaacaaacttatgaagcttcctctgctcatagatgttctctccaagaagaatcttcagcaggaatttcttgaccacggagttctcactcttctaaaaaattggcttgagccattacctgatggaagcatgccaaacatgaatattcgatctgctgtactgaaattattaactgattttccaattgacttggaacagtatgaccgaagagagcagcttaagaaaagtggtctgggaaaggtcattatgttgttgtccagatctgacgaggagactactgcaaataggaaattggctaaggagctggttgata

SEQ ID NO: 51010 - DNA, 263 bp, Zea mays
  Clone ID: LIB3067-017-Q1-K1-H3
tcggcctcgaccgccttctggccggaggcgaacttggtggcgatgtccatcagctcgctcgccctggtgggggtcttgcgacccaacttgctcaccaggtcacggcaagtggtgccggcgaggaacgcgccgatgacattcgagtcggtgatgttgggcagctcggtgcgctgcttcgagaatcgccggatgtagtcccggaaagactcttccggctactgccggcagcttttgagatcccaggaatttccggggcgcacgta

SEQ ID NO: 51011 - DNA, 445 bp, Zea mays
  unsure at all n locations
  Clone ID: LIB3067-017-Q1-K1-H4
agaattttgaggaaaccagaaattgatgcatttgcagaggagcttaggccgcatgaaaaagctttattaccagataagtcgactgtgcttgaccgagcaatgatcgagcataatctccttagtgccagtaaactttacacaaatatcagctttgatgagcttgggacattactggggattgatccaaggaaggctgagaagatagcatctcggatgatttatgaggatagaatgcggggctcaattgatcaggttgaggctgtgatacattttgatgatgacacggaagagctgcagcaatgggatcagcagattgctggactgtgcccagccctgaatgacatccttgacagcatgtcaagcaagggaataactattccggtgtgaataaatatctcatgctgtcggtcgatggtgcatggcanaactgctaacatgccccgga

SEQ ID NO: 51012 - DNA, 401 bp, Zea mays
  Clone ID: LIB3067-017-Q1-K1-H5
gtgcgttcttctgtaggtttgggctgggccgctcagcatcaacaggaaggccgtggttctctggaaccggcagggataccaggcaaccatcaccgcacagtggtcgagcatcgggctcgcttcttccactgctgtcactgctcgcgatctatgggcggtacgctgcttttgctgcctcgctcgctcttcagattgcataactccataccataaccaatgtaatgaaggctggctggtgttcgggcttgagatttcgtgttccattttgttgtgcagcactcgtcgttctcggctcaaggccagctatcaacttcggtgccaccttacgactgcaagatgtatgtcttgacgccgaactagctcaaaagacaatagcggattgttccatggcgcgtgggatg

SEQ ID NO: 51013 - DNA, 452 bp, Zea mays
  Clone ID: LIB3067-017-Q1-K1-H7
cgagttttgaagaacaaaaggaagtacaaagttgatattcttcgatgtgagagcttagcctgacttgccccggctacattagaacggctattccttcgggactatgacattattgtgtcgatggttcctcttccttcatcagttcttccaggcccttcaggcccaattcattttggaccaccatcttattcctccatgacaccttggatgaagctagtactgtatacagcaggacattgtggaccagtatctgctgtgttcatgaaagggctacgttttagattgctgcctgaaccattagctggttgtgagaaggcactgctatggtcttgggatggctctgtggtgggtggattaaggggaaagtttgaagggaacttactgaagggcaacttattgttacactgcttgaattcgatgctgaaacaatctgctgtactggtgcaaccact

SEQ ID NO: 51014 - DNA, 424 bp, Zea mays
  Clone ID: LIB3067-017-Q1-K1-H8
cccacgcgtccgttcttggttgtatgattgtgggcattgtattaatgtgtttactttcgaaaagagatgagaaaaaagataatactccaacgcattcctcatttggagctatgttgaagtacatcattgcgccacttaaggacaaaagaatgcttctcaccattcctcttatagcatattcaggtttacaacaggcatttgtatgggcggtattcacaaagagtattgtaacacccgttcttggcatcagcggcgttggtggagccatggcaatttatggtgcagcagatgtagtttgttctttggttgctggacgattgaccttcggacttcgctcagcagcatttatagtgtcggttggagctattcttcaggccatagtcctgttctggctgcttcttttttacagtccaatggatggact

SEQ ID NO: 51015 - DNA, 153 bp, Zea mays
  Clone ID: LIB3067-017-Q1-K1-H9
aaaaaaaaatatacaaaataattctaattatattataaaacaaaaaaataacaaaatctattgggaactattgaaataaaattaaaactacatccaataaataaaaaaagtggccgcccatttttaagctttccaattttcctcccccttcct

SEQ ID NO: 51016 - DNA, 318 bp, Zea mays
  Clone ID: LIB3067-018-Q1-K1-A1
gacgaattacgagaaaaaaaagaaaaagaataaaacaatagccggaagccgaagtacagcgctgtcgcgaacgctccggtcctatactcctcctgacctcgattcccgcactacctagatctcgaactcccaccatcgccgccgccgcccatggcgaaggagttccccgtgccaccggtggtcttcacgccgtccaccccaacacaccgtcggcaccctcccccgggcatgggggactcccctccgcccgcgttcgcgccgccacgtccctccacctcatccgtcgtcaacccgctccctttcatgtcgttcgatgtc

SEQ ID NO: 51017 - DNA, 297 bp, Zea mays
  Clone ID: LIB3067-018-Q1-K1-A10
gtgacccttgtcaaaatataaaaaagataaatgaaagaaatataaagcacaaaaaaggagaagagcattacaaaaggatggataaactcaagataataggtatagaaaaataaatatggtgaggactaatgttacaacaattgagaaaggcgtatggcgattttcatgtcccaaagttaacttgctgacctttcattgatattcggttgcacgtaggcaatgtattagaagttcactttcagtggtgttattgtgacataagtgcttatattgcgagttgaataagtttaatgtggt

SEQ ID NO: 51018 - DNA, 435 bp, Zea mays
  Clone ID: LIB3067-018-Q1-K1-A11
cccactcgtccgcccacgcgtccggatgccccaatcgccaccgctcccagcactggatccgcagcaggaagaggtgtagccatgatcaaagtcagttctgaaacattatatggctctcgtttgcggaccttcaagccttccctaaaggtttgttctctcatttgagcaatggggaatgtaactggtactttacctttacgtatgtaaggctctggcatggctttgccgacctctgctgtatctgcctatctggaggtgggagaccaagatgccaagaagagtgtgtaccatatatacaccatgcatgcgtgtgccatggctaccttaagaagcgtagcgaggaggattcctcatttctggttgacttcctccaggaaaccaggggaagagaaggttgtctcataaatttgtacaaaaaatgactatttcaccttg

SEQ ID NO: 51019 - DNA, 304 bp, Zea mays
  Clone ID: LIB3067-018-Q1-K1-A2
gccatgtatgaggttccagacgaaaaaacaggaaatgagcgagttgacgctgttgtggtggatgaggaggcgattggttccgttgataggccaggttgtggggctaaaattctccgaggggatggtgcattggaccagtacataacaagaaccaatgtgatgaatttacaggaaactaacgatggtttggccggtgagctcgaggaagcgtacatgctgtctagaattgttagctagtaatttgaaaggctggggaggaagcgtatatgctgagttctgaccaacttcgtacatcgtgtaacat

SEQ ID NO: 51020 - DNA, 441 bp, Zea mays
  Clone ID: LIB3067-018-Q1-K1-A3
agacagttgaagcttcctgactagttcccttctaaaagtagttaaaggccattataatttgagcatagctgcgtttggagccaaccggagttgcctggcatcgagtacagattctgatgtggagaacagggcgcctggcatgaatcagtggcatctccacccaactctgatagcctgccacaagggtggaaaagagatcgcagtcgcaagaggaatatcatcctgccaacatgggtgagccgcgggcgcatcatactaaattactaattacgtttctcctctgctcgtccaccgccagtttctgtgtttctcatagcaagtagaactaaagcacctcaaagatgtaaagttatgtatgcagtcgcaaataggttaggattttgagcacatattgataatttttatacatggagaggcagtatgtatgtgaaataatacgag

SEQ ID NO: 51021 - DNA, 336 bp, Zea mays
  Clone ID: LIB3067-018-Q1-K1-A4
gcaatatgaaagcctgatgctttcgttcttcgttttatttaagatcactttcctcccttggtgttatgaaatgtgcaactctttaatcagggatggcaaccgatagtgaagcctcgaaggcagctgaggttgtggttgactggcataaacaggacaaaaagaggatgctccatgcagtttaccgtgttggggatctggaccgcacaatcaagtactacacagaatgctttgggatgaaactgctgaagaaaagggatgttcctgatgagaagtacaccaacgcctttcttggctttgggcctaaaaaacaccacttttgcagtgaatttaccaact

SEQ ID NO: 51022 - DNA, 396 bp, Zea mays
  Clone ID: LIB3067-018-Q1-K1-A5
gattcaacaaagacgtacgtacatgcacaaaactagagcgagctgtgtgtgtgtgtgttcgtcatctcctcgatcatggcgaaggcgcaggcgccagggccgcaccctctacggcttcggcggctaggctgagtaccatcgccgaggacgacagggagatgctggcgctgtgcgggtcaccgtcggaccacggccacgcgcaggcgcaggtggcggcgaggttcatgacggaagtggcgccgccgcaggtggtgtcggtcatgcggcgaaggaaggcgccgaggagcctggacaccatcggcgaagacgacagggagcagcagctggcgtgcgggtcggcatctgaccacggcctcgcgacggcgtggtcgtcgctccagaggataccgactccac

SEQ ID NO: 51023 - DNA, 352 bp, Zea mays
  Clone ID: LIB3067-018-Q1-K1-A6
ggccctgcggatgcaggccctgtcaatgcaggcgtatgatgtctactccaagagggcgagggaggtcttgctggaagcctctgagaagctgaagatacaggcagacaaagcacagaaggacctcagtgtgatcgccaccgaggttagtcaggagggacaggaatatctggtgatggcagctcggaactccccagactcgatcaaggatattacaacaacgttcagggctcttggaagattgaattggccatcagagtatgaggattatcatgtgggcattccgtttggtacccttcttacagtagggggtttcctcaacttcatgttgactggaagtacctctgctcttcgt

SEQ ID NO: 51024 - DNA, 106 bp, Zea mays
  Clone ID: LIB3067-018-Q1-K1-A7
gaccctgctgatgcagtccctgttaatgcatgcgtatgatgcctacttcatggggactagggaagttttgctgcaagcctctgagaatctgaatatacagtcatac

SEQ ID NO: 51025 - DNA, 322 bp, Zea mays
  Clone ID: LIB3067-018-Q1-K1-A8
atccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaaca

SEQ ID NO: 51026 - DNA, 426 bp, Zea mays
  Clone ID: LIB3067-017-Q1-K1-H11
ggccgcccttttttttttttttttttttttttttttttttttttttgcaataaagatatacaactgtcatttgcactgttcctctgttcacttgtttgccactgagttacaatacgttatcagcactgctcgtgagagaacagagagaagtcgatgttgaaaggttgaagaaacaagcgagaaagggaaatgaagaactatcgtggacgttggcggacgggagtcttccatgcggaactctagcatgcacttggactttggacttcatgcgtctgtccgtcgacgtgagttatctattgcgaatccaaaccaaaaatcaatgtgtgtgtctgcaccacgatgacggctacgatgtggccggatgagaccttgttcggggtgcttgtgcctgcggagccagatccgcgtcgggaccatgcctgacca

SEQ ID NO: 51027 - DNA, 307 bp, Zea mays
  Clone ID: LIB3067-032-Q1-K1-A5
gtgtttgggacagagaccagatggagtgtgtgcaaaagttcatgcatgcagactgggtctgggatcttgctctgcgtggaaatactgttgccagtactgctggtagagatgcatatgtatgggatatcagggctggcgagttaacaagcttagtttccaatgcccatgttggtagcgcatattcaattgcttggacacacctgccagatgtgctgtttaccggtggagaggatggcgctattcgcctgttcaatgtttctgatgtctctgatgatgagggtgacattaaaccagtggcaacttgggt

SEQ ID NO: 51028 - DNA, 318 bp, Zea mays
  Clone ID: LIB3067-032-Q1-K1-A6
aactaaagtcacgtctggtattgttggtaaggaaaaatgctgaattcaagaagcagatcaatgaattgtcaatgaagcttcaattggccggacaagggaaaaatgaggccctgtataaggctggtccatttggtacagtgaaagctctgagaacaaatccaacagttactcctgatttatccatcaatcccagattggccaacatattggaacaggttgctgtgaagaaagaactgatagttgcattggcaaattctaatgtgaaagagatgcttgagatgtggttcactaacataaaacgagctgggatttcaaatt

SEQ ID NO: 51029 - DNA, 307 bp, Zea mays
  Clone ID: LIB3067-032-Q1-K1-A7
cgcagctcagtctcgtccatccagtgctgtagaattttctttggtctgttggcaaggcggccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccg

SEQ ID NO: 51030 - DNA, 318 bp, Zea mays
  Clone ID: LIB3067-032-Q1-K1-A8
caaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagttgacgctgtcgggtgccggtgccgactgcctctctcacgcaacaaagcggcataaacggagcaacagctgatggccgctctccctcacctcgctccccgaccgacggatgacggattggtgacattcttcttttccctcccagccaacggggaggctcgtggattggctg

SEQ ID NO: 51031 - DNA, 295 bp, Zea mays
  Clone ID: LIB3067-032-Q1-K1-B11
gcagcttactggaactgctcaagtgcattttatttgaactactctcgtactctggagtagcccggatcattaacgcctatcactacagatcatcagcgctcatatgtgcctagctcaatctgctgtcgctctctatacgatctctacctcaagcaactggtttcagagcatcttgtggtatccacagatccatctgcttatctggtgctccagatagaacaattgagtgatgacctttatcctggcttcacaatctctcacctggatcatgaatagcaccattctgctacgtaca

SEQ ID NO: 51032 - DNA, 418 bp, Zea mays
  Clone ID: LIB3067-032-Q1-K1-B12
cccacgcgtccgttcactcgtccgctcgagaactccatttcgatggcaggttgaaatcaacccatcctcgtttcctccgtctagcagcctctcaccctcatggccaagatcaagatcgggatcaatgggtttggcaggatcggaaggctggtggccagagtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctctggtgagaaggaggttgctgagtttggctgcaggaaccctgatgagatcccatggggttcggttggcgctgaatatgttcgtgagtctactggtgttttcactgacc

SEQ ID NO: 51033 - DNA, 160 bp, Zea mays
  Clone ID: LIB3067-032-Q1-K1-B3
cccactcgtactaaaaaaaaaaaaaaattacataaaaaaaaaaaaaaaaaaaaaaaaagagaaggattaaaaaaaaaaaaaaaaaaaaaaataaaaaaaaaaaaaaaaaaaaaaaaaaaaaaaaaaaaaaaaaaaaggggattatcttttaaaaattcaa

SEQ ID NO: 51034 - DNA, 303 bp, Zea mays
  Clone ID: LIB3067-032-Q1-K1-B5
gccgcacctagagggacgcatccgccgacgcgtccgctacgccgacgatcatcgctacgatacttgcttgtcactgtcgccggaattcttgccaacagtcaagagcagccttaaccctggctcctctcatgatgaacgttatgtgggtctcctctccataagcggtgagaccgagacactagacatgatgccatcatcaagcactgcacctactgctctatgacctgcacgtggtcagaaaccacctcctgtcaagactgatagtaccagcaagatggctactgacagatccagccgcaccaa

SEQ ID NO: 51035 - DNA, 312 bp, Zea mays
  Clone ID: LIB3067-032-Q1-K1-B6
cgccgggaccgccgcctctgcctcctcctcctcccctacctcttcagcgtcccacggagaaaccacgtgatgaggctgctgcggaggaggaggaggctgagctggcggtcctgtcccccggagtcctagaacgtgacgaccctgttgtccccgccgccttcgtcgttggctctgggaacagtgcaactgactacctgccgatgcctgagccttttgatcatgactccgccagttgcagtcttaactactgtaagctattgctctgcaagaaggtttcctgtcctatttacctgttctgcgactcttacatct

SEQ ID NO: 51036 - DNA, 308 bp, Zea mays
  Clone ID: LIB3067-032-Q1-K1-B7
tcagcaactacaggctcgcatcctcctttcccccgcaattccgacgatcaacacgagggtacttccataaaactatctccggaattctttccaacagtcaagatcatccttaaccctagctcctctcatgatcaacgttatgtggctctcctctccataagctctgagaccgacacactaaccatgacaacatctgtaaccacctccacctactgctctatgacctccatcttctcataaaccacctcctatcaaaactgacactaccagcaagatgtctactgacataaccagccacaccaataact

SEQ ID NO: 51037 - DNA, 317 bp, Zea mays
  Clone ID: LIB3067-032-Q1-K1-B8
cggacgcgtgggcggacgcgtgggcggacgcgtgggcggacgcgtgggctcccaaccgaatctccctccagcgccgcagctagcccgagaagccgacgaggaggaaaccgagcgccgacgccgagcaccctcggttccttgcttgcccggcgccgaatctagacagctctttctcgttcgtctgtatccatggccgccgccgcgagcaagaccgtcgctgtcctcctcgccgcgctgctcctcgcgctggtcgcgtccgcggtggccagcaggaagctggaggaggacgctttcctgggaagcctttcgccggcgcc

SEQ ID NO: 51038 - DNA, 312 bp, Zea mays
  Clone ID: LIB3067-032-Q1-K1-C1
gtggaactttgtaaaggcctcgtagtgttactctgcctcgcctcctcggtagaggtgtgtgggaagtcgcgatcccttggcagatgggtaacatgacttgtgggtaaagatgcgcaacctctgcagagtgtaaaactggtatactagccgtgctcacggtcatgagcagctcggacactcacatgattaaattatggaacttaaactcaatttgtcatatgcattgcatcgcatgtgaggttgttacttttggtctactatttaattgggttggtatttacttatacttagtaattgctaataaaattttga

SEQ ID NO: 51039 - DNA, 433 bp, Zea mays
  unsure at all n locations
  Clone ID: LIB3067-032-Q1-K1-C10
gcggtttcgtctcccacttcctcttccgtcgggagctccagggcctctgcttcgccgcagggctgctcgtctctcaggccctcaatgagctcatcaaacactccgtcgcgcagtcccgcccctcgtactgcgagctgctggaggcctgcgactcccacggttggccgtccagccactcgcagtacacgttcttcttcgccacatacctgtcgctcctctccctccgccggtcgcgcgcgcgccaggtgatcgccgtcgtgccatggccgcttgccttcctcaccatgctgtccagggtctacctaggttatcataccgtcgcgcatgttttcgcgggagcagtagtgggcctcgtgtttggtgctatctggtactggattgtcaataccatgcttggtaattacttnccaatgattgaggagagtgcaaatcg

SEQ ID NO: 51040 - DNA, 409 bp, Zea mays
  Clone ID: LIB3067-032-Q1-K1-C11
tccactcgttcggaaaatgccatatattgtaggagtttttcagagaggacaagatgctagaggtgcctattaaattattttcctatttttcttagaggatagaattaccacacctgtgcctattgaattcagtctggaagttgctctgggagttctgccaatcaggcacatcatagaatcagcataaataaggcacaccctttttttgggagattctgcacttgcctgactaaatgatcctcacgatggaataaaatacacagtaagtatgtttataccttctatcaatgattttactaaccttaaattattttgattagatatccatttgggggcagcaaaactcgagacaacaactacgtagcgtgtcaagatggccatcgggcagcacgtaagcgaggatatcata

SEQ ID NO: 51041 - DNA, 416 bp, Zea mays
  Clone ID: LIB3067-032-Q1-K1-C12
tcgggacccttagaaagcctactatatttgcctatgtacccctcgtgtttaataatttgagcagcgataataatctatggtgttagcactgttaaaaaaaaataaaaaaaacaaaaaatgaaaatatagaataaaaaaaagaaagaagatatgaaagttctgacaatcaatgcacataatagaatcagaaatacatgatgcacaccctgattatgggagattctgcactagtctgactaaatgaccctgacgatggaataaaatacacattaagcatgtacataccttctatcaatgatgatactaaccttaaatgatacagaatagatatccatttgcaggcaataaaactcgagacaacaactacttaacatgtcaagatggacattaggcaatacgtaaacgatgatatgata

SEQ ID NO: 51042 - DNA, 319 bp, Zea mays
  unsure at all n locations
  Clone ID: LIB3067-032-Q1-K1-A4
aaacaaaatgctaaaggaagagtgccatagtgtgtcgacgganggacagaccatgcgtgtggaattgtctgaaaaatttgatatcgccataaagggtgtcagtgtcaagcttgaggagcagagggttgagtgcattgctcagctagaagagaacaatatgttgagaagtaaactcaaagacattgctgatcagtataacattactcagcagaaatatgctcaccaattgaaagagaaaatgatggaacttgagcttgctgatctgagacttcaacaacatcaagagaaggctgctcacgaacatacccaaatgcagttg

SEQ ID NO: 51043 - DNA, 320 bp, Zea mays
  Clone ID: LIB3067-032-Q1-K1-C2
cccacgcgtccgcaaatatcgagggaggatctaaaagaagcattcaaaaaatttggagctggccggtatgtggacttcagcatcggagataattcaggataccttcgctttgaagattctaaggcagctgaaaaagcccgcatgtctgcagtacttgctgatggtggcttgataattaaggaccacattgttactttggagcctgtgactggtgaagctgagaaggattattgggacacaatccgcagtattcaaggaaagtacaaggatagtagaagctacaagggaagggcttcaaataaccagagaggaggaaagcc

SEQ ID NO: 51044 - DNA, 315 bp, Zea mays
  unsure at all n locations
  Clone ID: LIB3067-032-Q1-K1-C3
cccacgcgtccgcccacgcgtncgtgctaatttcagaccgagagaagatcaactgagtggaagagcgccacgttctttcttctccctgtcaacattccgaagcaagggaggtgatgccaggctcaggtgatcctcagaaagacagaagacaccagaggtggagtgtataaaatatcttccgaggttaggtatgagtatcaaattttcagggcggtacgcggacgctgctagcttgtgattataaatatataaatatatatgttgtgtatctatggcaattcatataagctaccagttgagccccccatggttact

SEQ ID NO: 51045 - DNA, 359 bp, Zea mays
  Clone ID: LIB3067-031-Q1-K1-H1
cccacgcgtgcgaaaaaaaatgattatataataggaatataagaagaaatagataaccaacgtagagtgaataattgcctgcttcgaaaactgctaaaaaacttacaattaattccgattcttgtggggtcacttgaggagccagcaaaccaccaaccaagggtccgagagcaggtatctagagcaagatgtacggctagaaggtcgactggctgtaggagccgttgaccaagtcgttatacatcttcttatacacctgcttcctgacgtagatgccctaccacttgagctaagactacgcgttagagcacgccgtcgcgcaaggcatgccgtactggtcgccgttcttgtcgtcgtac

SEQ ID NO: 51046 - DNA, 395 bp, Zea mays
  Clone ID: LIB3067-031-Q1-K1-H10
caagaacgccgccaggggcgtcagcggcctcaacgccggcaacgccgccagcgtcccctccaagtgcggcgtcagcatcccctacaccatcagcacctccaccgactgctccagggtgaactaaaacctagaccacgcgcgacgacggccgcctgatcgatcgatcgaccattccgccgtcgccgccggccggatcatcgatcgtcgtcatgatgatatctatcaatctacgcgtgatgatcgattgctacttgtctactgctatgtactactaaataaaatctctccgtgtgtacacgtacgcttgcatgtgcatggtagcatgtacgtacgacgtcgtccatgtataagtgtgtgacgtgtgagacagagagagagagagacaggatcgatcg

SEQ ID NO: 51047 - DNA, 427 bp, Zea mays
  Clone ID: LIB3067-031-Q1-K1-H11
caaacaggaggattggaagcatttggatcagttcctgtggctgactgaacagagccagttttagcaaacttgtccctgtctgacagaacagcatcatcagccttccgtttctttgatggcagaatgcttctcttacaagtagagtaatcttcgatggcgatctgacgagcctgttaatcagcaggtttgtcgatacgaggtcaaaggcatcgcaaaaccctctgtactgccattgtttagccccccttcagacagatgccgtcgacgagatgatcgcttgagaacaaatttgagattggtatagtctgcatttttgtcgttagcatgtgtcgctagggattgctattgattttcttgtaatagcataatctttactgtagaataggcatcgggtgctaaccaatcctatgaacatataattaacatt

SEQ ID NO: 51048 - DNA, 401 bp, Zea mays
  Clone ID: LIB3067-031-Q1-K1-H12
cccacgcgtccggttctagatcgcgggccgcccttttttttttttttttttggttttttttttctttttttaacggggcaaattaagatctgctgctggcataacattacgacaatagttcatccgttcgacaacaaattttggcacaacttccacaggttcagcacttgaacaatctaagttaccaacacaaggcattttaagttcagagaaaagtgagaaataaacacatggccatttctagtccatctttactccaacaaaaccttagatgctgctcgggtacatgaacactctgaccttgcgccccatggactcaggcgggaggttggacttgaacttggcacggacgacgcccgagtttccgtgcggacgggtgacctttgcccaaatgcaccctg

SEQ ID NO: 51049 - DNA, 172 bp, Zea mays
  Clone ID: LIB3067-031-Q1-K1-H2
gcgacgacgcgttgggtcaatgggcaggctaaggctcctgcgctacgaatgtggacaagatacatgcattgtgtcatatcctgcaaagggtgtttaccgagccctcgcccattcagactacggcctgataactcttctggcaaccgatgatgcattgggtctccatctatgc

SEQ ID NO: 51050 - DNA, 461 bp, Zea mays
  Clone ID: LIB3067-031-Q1-K1-H3
cccacgcgtccgcccacgcgtccggaggatgcgtgtgctgaggcgccttctccgcaagtggcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccagggtccacgagaaataacaccacctgtctcatccacagctccagctactggggcaccgaagaaagcaaagaagtgaagtattgaaataaagctgtagctttctagtccagtactgcactttcttttataagctctagtcaaattttggagcgcctgaactgttttgctggtatataact

SEQ ID NO: 51051 - DNA, 467 bp, Zea mays
  unsure at all n locations
  Clone ID: LIB3067-031-Q1-K1-H4
gcattatttattgcttgagatactagaatacaataagatagcatagaaaggaaaatgggggtcagcagcacatcacacaaggtttccatcgaaggttcaagagcacataccccaggtggagtagcaagggaatctctcccatggagtccacaaccataaattgtgattatataactagcgtgatgtaggacacatacaatgaaggccaggatgtcacaaggctacctaactgtatatttgcatgcagctgagtggctgactgaggccacaagtttgatctaactttgtacttgtacacagggttgaaaaacaggaagaaggtacattttgtttttgtaagtagcgtangttggtagtgactgggctcagattggggcccctcaagtttcattaaagcttgttcccgtgcctcgtcgagtggtaggttgcatttttttgaagacaggactggctgaatcatgtatatc

SEQ ID NO: 51052 - DNA, 346 bp, Zea mays
  Clone ID: LIB3067-031-Q1-K1-H6
cccacgcgtccgcggacgcgtgggtaggatcccacaccgaggaaaggagaagagagggtcggaataatgtcggccgatgagggtgccgtgatcgcgtgccacaccaacgacgagttctacgcccgcatggccaaggtcaaggagcatggcaagctgctggtcatcgacttcatggccgcctggtgcagtgtgtgccagatgatggccacggtgtacgctgactgcgtcagcaagtactcttccgcggtcttcctcgtggtcgacgtcgacgaactgctgtaagtcgctaagatctacggcatccatgtgatgccgaccttctgcttcatgatgaacggcgagacgc

SEQ ID NO: 51053 - DNA, 311 bp, Zea mays
  Clone ID: LIB3067-031-Q1-K1-H7
cggacgcgtgggttcgtagctaagaacgtacagggagagagagagagttgacagcagggagcggcaggaagggagaaaagcggaagagcgccgtcgacggcttacgtccagggtcgatccgtcctcaatagatggcttgtgaggatcgtagaggtgtactaatggtgtcttgaccttgacccactggaacttgtgcggtcgcatggcaatttctcgccgaagtggatgaaccaccgtaattccggcctttatcgtggcctgacctgtcgtcattttcactgccgtgcgaggacacgtgtcatcttgaaatg

SEQ ID NO: 51054 - DNA, 462 bp, Zea mays
  Clone ID: LIB3067-031-Q1-K1-H8
atgaaaggtctggatggcattcagggtccagtttacgtgggaacaggatgctgtttcagtagacaggctttgtatggatacgatcctgttttgactgaagctgatctggagccaaacattgttattaagagctgctgtggtagaaggaagaaaaagaacaagagttatatggatagtcaaagccgtattatgaagagaacagaatcttcagctcccatcttcaatatggaagacatcgaagagggtattgaaggttatgaggatgaaaggtcagtgcttatgtcccagaggaaattggagaaacgctttggtcagtctcctattttcattgcatccacctttatgacacaaggtggcataccaccttcaacaaacccagcttctctactaaaggaagctatccatgtcatcagttgtggatatgaggacaaaactgaatggggaaaagagattggctggatc

SEQ ID NO: 51055 - DNA, 341 bp, Zea mays
  Clone ID: LIB3067-031-Q1-K1-H9
caagttcctccggggcaacgctggcggttcggagtgcatgtccgctatcgccggctcgtacggctacattgctcctgagtacgcctacacgctgaaggtggacgagaagaggacgggggcccggagaagaagcagcagcagcagcaggaagggccacacgactcgccgccgcagcaggatcttcttagtatctagaagcgcagttgcgagagttggtcgtactgatggtacttggtagcatccctgcctgccctgttctttgagtgaagcgttggaacgtggcgtgtgtgtagtgtaactgtgtatgcaggcggtgatttatatgcatgcttcctttaagt

SEQ ID NO: 51056 - DNA, 311 bp, Zea mays
  Clone ID: LIB3067-032-Q1-K1-A1
ggcaaagttcgctcttggtcaccaccgtgaggcctccgacgccggctgcgtccgtgccgtcctcgccgagttcatcctcaccttcctcttcgtcttcgccggcgttggctccgccatggcaacagggaagctggccggcggcggcggggacacggtggtgggcctgacggcggtggcgctggcgcacacgctggtggtggccgtcatggtgtcagcggggctgcacgtctccggcggccacatcaacccggccgtgacgctgggcctcgccgtcacgggccgcatcacgctgttccgctccgcgctctacg

SEQ ID NO: 51057 - DNA, 430 bp, Zea mays
  Clone ID: LIB3067-032-Q1-K1-A10
cggacgcgtgggttgcaacttgttcactgttttcttccagctcgagctcaagtacgcgagaccagaccgacgctctcgagccgccgcaccggtacgtgccctgggtggtcgtcgacgggcagcccctgctagaggtaagttcctttctttcccctgaacttcaacggcgccgcctttgcccaactgtctgatcaaagttcattcccccgttggtgttggtggtgatgatgaacatgttctcgtcgatccaggattacgagaatttcgaggcttacatctgcaaggcttacaagggcactccaccgaaggcctgtgagggcctggaacgtctgcagatggccctcgagacagcggcggatgcgcgcaacggcgtcagctacaactccggtgtcagcaagcttgcgactgctgaagatgatggtggggagca

SEQ ID NO: 51058 - DNA, 394 bp, Zea mays
  Clone ID: LIB3067-032-Q1-K1-A11
gacccggcagcgttcggtgacgaaaaattaaaaacccaatcgcctgcgccccctcccgtgactccgggcgcagctgccgacgtcgccacgcgcattccgccgcgccaatcgggtacacgagcagggcgggggatgacgtcgtcggcgtccgcgccggcgtccaatggaccgcgctacgcgccgccggatccaacgctgcccaagccgtggagggggctcatcgacggcaacacggggtacctctacttctggaaccctgagaccaaggttacgcagtacgagcgccccgtcgcggccgtgcccaactccccgtcgcagccgcctggctactccaggcccgaggagaggccgagaagcagcacaccttccgagcggagctcggaaaccacggtga

SEQ ID NO: 51059 - DNA, 380 bp, Zea mays
  Clone ID: LIB3067-032-Q1-K1-A12
gcgagcggctcgcccttttgtcgaatacttttattcccaatctccttcagccattcccgtggtgcgtgtctctcttgcctatgtttctctctcttgaagaaaccccaataaggcccactaccaatgcgtacgatgacaggtctacgacgcgaacctgcgcccaacggaccccgctccggccaaccgtaccaacactgcccaagccgccaaggcagctcatccgcccggaaaaatgtgcaaccactacttctgaaaccccgagaacaatgttacgcatcaccgaccacgacctcgaggtccttcccaactgcgagaccaagccccatgccaacttcacgcccgacgagaggcccagaagcagcacatctactcagcagaac

SEQ ID NO: 51060 - DNA, 311 bp, Zea mays
  Clone ID: LIB3067-032-Q1-K1-A3
cggacgcgtgggcggacgcgtgggcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgc

SEQ ID NO: 51061 - DNA, 412 bp, Zea mays
  unsure at all n locations
  Clone ID: LIB3067-031-Q1-K1-G9
gtcgtcatcatcagccccgggtgtggcgctggtcggctggtgaactgggccatggtgtgtcgtgacgatcagccccgggccgtaagcccaccggatcaacagcaggccgcagattcccctgtttccagaactccgtcgaatcctccccctcctccacgcagacgcagctccctctcctctcagcccccacccatcgagccgctagcgccggcgcccggcggcggtatggaggctggtggcgaggagttcgcgatcggcgtggtgctctccgcgaagaccaccctgngggaggagttcgagggccagatcgtcgccttcgatcgacccttcaacctnctcgttatccaggagggcgtggggagggcggagagcggagagcggcggaacgtgaaggtgctgaaggcgaactaca

SEQ ID NO: 51062 - DNA, 406 bp, Zea mays
  Clone ID: LIB3067-031-Q1-K1-F12
gagagacggaaaaatatgcccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgaccccggtgtgctctgcatggccaacgccgggcccaacaccaacggcttccagttcttcatct

SEQ ID NO: 51063 - DNA, 311 bp, Zea mays
  Clone ID: LIB3067-031-Q1-K1-F2
tttgcccgcagtgcttctgcttcttctacttcttcttctacttcccggccggcgggcgagcttgggttagtggctcttcttttcggagacctgtgaggagagccattatcatggccgctgttgagactgttgttctcaagggtgctatgtcatgccagggctgctccggggctgtcagaaaaatgctctcgaaaaatgaaggggttgaaaccttcgacatatacctcaatgagcagaaagtgacagtcaaaagcaatgttaagcctgtagacgtctttcagaccggtttcaaatttgggtaaaagaccttc

SEQ ID NO: 51064 - DNA, 465 bp, Zea mays
  Clone ID: LIB3067-031-Q1-K1-F4
gaagtaacatgatttttatacagggatgctccttcgttacggaagaccatgcagaacctgtcaggcccattgccacatcagctgatattactacttctatggatatgcgtctaatgatgaataagatcaagattgttgagttcatctctgttctactatcaattggtagtgcagctgccaaaacacgactgattcaactaggagcaatcaagcatgctatagatctattttttgagtacccgtttaacaacttcttgcaccaccgtgcgagaatatcatcggctcatgtttggagagtaagcaggatcgactgattgaccatgtccttgatgattgtaaacttgttacaagaattctggaagcagagaagaactctgctctgtcgtcagatttaacgaagcatacattgtcttcagagggaagattttcaccatggataggaattgttggtcatatgacacagat

SEQ ID NO: 51065 - DNA, 460 bp, Zea mays
  Clone ID: LIB3067-031-Q1-K1-F5
gtcgccgaggcccacgctgccatggactggggccgccgcggccggcgtccgcgccgctggagacgcacgcacgtgggcgacgctctagtgccgaccgtacagggccgcatccacgcgccgacaggccggggccgagatgcgcctgcgccagagtgcgcctcgccggggctgtacccgtgcctgcggtacgccaaggccgactcttacgttggctctccaaagtggcgaaaagtaggttgtacgagtgtatggtgaagacgatggagatctcaccttgtatttcactctggaatcctacatgaacactcgatgtacagcagcagcagcgtcccgatgccgagcgtcatgaccgtcgaggagaaccgacagcgcgccatcgacggtaacaccaaccgctcggtggagagagactcgtgctgataacgtgtcaaagtctactcagtgataatcagattgagag

SEQ ID NO: 51066 - DNA, 455 bp, Zea mays
  unsure at all n locations
  Clone ID: LIB3067-031-Q1-K1-F6
cccacgcgtccgacttcagcaaaggtccgcgacaaaggttacctttcctttagtttggagcaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctcatccggaaggctgacgctggcgaagatggngtgaagatctcccnctggttcatgctggtggtggacaacttcctcatgggctggtgggaccatg

SEQ ID NO: 51067 - DNA, 461 bp, Zea mays
  unsure at all n locations
  Clone ID: LIB3067-031-Q1-K1-F7
cacggtcatggggaaaatcgtggtgtgcatgttcggagcaagcgacgcggatggcatctggttgcagaatgctggtggagcagggatagttgatgtggattcttacgagtggtctcgtgatggttccgcgctttattccttcacccttccgggtctcacgctcagctacaccgccggcgagaagctcagggcgtacatggtctcggtgccctatccggtggcgtccttgagcttcggctgtgagacggtcatcagccgcaagaatcgggcgccggtggtggcgggattctcgtcgcgtggccccaatcctgccgcacccgagctcctcaagcccgatgtcgtcgcgccgggagtgaacattcttgcggcctggtcaggcgacgcaccactagcggnggtcttcgttcccgatgggaggagagcgaactacaacatcatatcggggacttccatggcgtgcc

SEQ ID NO: 51068 - DNA, 386 bp, Zea mays
  Clone ID: LIB3067-031-Q1-K1-F9
cctgaaccaaaaccagagcctaagccagagcataaacctgagccaaagccagaggctaaacccaaaccgaaaccagagccaaagccagagccacaaccaaaaccagagcctaagccagagcctaaacccgaaccgaaaccggagccaaagccagagccccaacctaagccagagcctaagcctgagccatagccagaacgaaagccagagccacaaccaaagcctgagcctaaaccagaaccaaaaccagagccaaagccagagcctaagcccgaaccaaaaccagagccaaagcctgagcctaaacccgaaccaatgtcagaacctaaaccagagccaaaagctgagccgaaaccgaaacccgatccagagccagagccacaacc

SEQ ID NO: 51069 - DNA, 250 bp, Zea mays
  Clone ID: LIB3067-031-Q1-K1-G1
acaatcatcctagaaaaatgctaatttattgatatctgatccacttcaaaccaagtgtacgcggttattcccgcttaaaataccgccaataaaactacaattcatcccaaacctctaggtcaatttaacgcccaaccaacccacaacccaggcccagaacacagtctctagcccaatctataccccgaaatgcacgccgctttaaccccccctttgacaaaccccatatacattttcttatacgcggttt

SEQ ID NO: 51070 - DNA, 317 bp, Zea mays
  Clone ID: LIB3067-031-Q1-K1-G10
gaattgccggctggacgccacgcgtgcggtcgtcatcatcagccccgggtgtggcgctggtcagctggtgaactgttcgagcttgtgttcgaacgatcagccgcggaccgtgagcccaccggatcaacagcaagccgcagattcccctggttgcagaactccgtcgaatcctgcgagtcctacacgcagacgcagctgcatcttctcttagtcatcactcatcgagccgatagcaccggcgcccggacgcttgatggaggctggtggcgaggagttcgcgatcggcgtgacgctatgcacgaagaccatcctggggg

SEQ ID NO: 51071 - DNA, 378 bp, Zea mays
  Clone ID: LIB3067-031-Q1-K1-G11
cccacgcgtccgcagctagctagcgttcctaatcaccgacgaataatctcttcggcacctgactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggggtgctgcagcggggtgcgctcgctcaacagccgtgcgtagtcggcggcggaccggcaggccacctgcaactgccttaagagcatgacgggccggctcggc

SEQ ID NO: 51072 - DNA, 359 bp, Zea mays
  Clone ID: LIB3067-031-Q1-K1-G12
cccacgcgtccgcccacgcgtccgctcgagaactccgggtcgagctcatttgaaatcaacccatcctcgtttcctccggctagcagcctctcaccctcatggccaagatcaagatcgggatcaatgggtttggcaggatcggaaggctggtggccagggtggccctgcagagcgacgacgtcgagctcgtcgccgtgaacgaccccttcatgagcaccgattacatgacctacatgttcaagtatgacactgtgcacggacagtggaagcaccatgaggtcaaggtgaaagactccaagacccttctctttggtgagaaggacgttgctgtgtttggctgcaggaaccctgatgagatc

SEQ ID NO: 51073 - DNA, 464 bp, Zea mays
  unsure at all n locations
  Clone ID: LIB3067-031-Q1-K1-G2
gtccagctcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcttgccctccgcgtatcggaagatggaaagaagattggtagagctagtgaactcttgaagccagatgagatcatagaacaagtagactctaggactattgctgtatctccgctgccttgcaatgtaaagcaggaagacgtncaatcttttttcacaaattatg

SEQ ID NO: 51074 - DNA, 255 bp, Zea mays
  Clone ID: LIB3067-031-Q1-K1-G6
ccgaaaacaaattttgcatctggtttttgaaagcaaaatttgttttcggtggccttctagaaaaaaaaaaaaaaaaaagaataaaaaaaaaaaaaaaaaaaattaaaaaaaaaaaaaataacaaaaaaaaaaataactgaacaagacattacaatcaaaaaatatgaacaatattgtgggaatgcacttgatatgcttcttcttacagatgaaaaaccacctggggctggacgcagatgtcaatccacgaactgt

SEQ ID NO: 51075 - DNA, 191 bp, Zea mays
  Clone ID: LIB3067-031-Q1-K1-G7
agtcggtctggtgtcgatgtctaaaaactgttattgtcgtgccgcgcagcataccctatgtggttggctgcgtttggtgtcagtccgttttgtgtttggatgtcacgggttattatgttcctgtgggctgccactatatattatagttgcttgggatgtgttttttataaaaaaaaaaaaaaagggcgggc

SEQ ID NO: 51076 - DNA, 304 bp, Zea mays
  Clone ID: LIB3067-031-Q1-K1-G8
attcgacctacgcctacgcgtacgcataaagcgcatatattgtgacacaagtatctgaaactttgtacttcaacagagggtggggcagggcagatcagacaattttctgtgtttcttatttccattgtagtctgggatctctgttcttccctccatgccctgtttgtagtaggcatcattctttgctcgtatatttggctgtagcattccttgtttgttgatcaatacacctgttcagcttgtattgctttcttcctcaaatggatgtatggattcacttgcataacatcgtgaacaaacattc

SEQ ID NO: 51077 - DNA, 458 bp, Zea mays
  unsure at all n locations
  Clone ID: LIB3067-031-Q1-K1-F10
cccacgcgtccgagataactcattggtgagagacataagccaaatgccgcagagcagcgatgggattgaaggattgtcacatataacagttgctggtgcgctcaatcatgggatgaaggaggtggaagtgtggcttcagacaataagtccaggtcaaaggacgccaatccacaggcattcctgtgaagaagttttcactgtcctcaaagggaagggtacgctcttgatgggatcaagctcactaaagtacccagggcagccacaggaaattcctttctttcagaataccacattttcaatccctgtaaatgatccacaccaggtttggaattctgacgagcacgaagatttgcaagttcttgtgatcatatcgagaccggctgctaagatattnttatatgatgattggagcatgccttatacaagcgtgggactggaattccccctcgtctgggatg

SEQ ID NO: 51078 - DNA, 436 bp, Zea mays
  unsure at all n locations
  Clone ID: LIB3067-010-Q1-K1-D6
cccacgcgtccgcccacgcgtccgctttggaactgctgatgctgctgaggtggatgctggttctgcctgaactgctgaggttgattgcctgagaaacgaggacgattgctgcttccaggctggggtccactgatcttgcgcttacgatcctccatctccttacgcttcctctctgtcatgattgctctgtcaatcaggtgctggaatgtcgggaaggtgtgattcatcagctgatactaaagagggtcaaccaagcctctcaggaaacggtactgccgcttggcgtcagtgttgacatcttcaggagcatagcgagacaattgcagaaacctgtctcgatactcactgacagacaatggcccttgcttgagagctaggaactccttcttcttcactgtcatcagacctgcatgaacatggtactgacngaagcttt

SEQ ID NO: 51079 - DNA, 443 bp, Zea mays
  Clone ID: LIB3067-010-Q1-K1-D7
cccacgcgtccgcccacgcgtccgcccacgcgttcgagactatggttatccaacaaacttctacaatatatatggaggagctcagtacccgttttatggaggagcaacagctggcatggtgacaggaacaagtcccttttatccatatttccaatttgggcagtcaggaaacactactaccaactatacaagtggacaaggctacaacttgcaacaatacccacaaatgttccacttctcaactgtatcttctacagctgcagctgtgaccggctttgctcagcaatatggaggaccattgtcactagcagcaagccctcaagcccaagcagtgtgtatccccattaaacaggcatgactatggcactcacagctccaaccctgccaacttcaacacaggctgctcatccttaccggttgattcccttgcactttgcaatttc

SEQ ID NO: 51080 - DNA, 327 bp, Zea mays
  Clone ID: LIB3067-010-Q1-K1-D8
acagcaccgctgccgaaggtgggaaagaaggctgcggcagtagcaccggcaccgactaggaaaggaaaccgtggaaactacagccatggtggtgcggatccgtctggcagcggttcgggtgccggaatcggcccttctaccgggtgatggccgtctatagccgctcccctcgagacggcaagcaccttgaggtactcggctactataaccagctcccagggaaggatggatgcaaaaggatgggcctgaaattcgaccgggtgaagtattggcttgcaattagggcacaaccattagatcttgtgcagagtattctcttttcgagcc

SEQ ID NO: 51081 - DNA, 210 bp, Zea mays
  Clone ID: LIB3067-010-Q1-K1-D9
catatctatctggctgtgtactgcaagcaggcctagtacgccgcctgcgcgttcctcctatgaggacatataggcccctccctgcgtgtatgcttgttaccgtcgtgtcgaaccttgtactacgaggctccatcgaacatcgatggcttgcttctttatcagaacatgtttgaataaacgctatttggtaaaaaaaaaaaatataatttt

SEQ ID NO: 51082 - DNA, 342 bp, Zea mays
  unsure at all n locations
  Clone ID: LIB3067-010-Q1-K1-E1
tcccacgcgtccggacccacgcgtccgcccacgcgtccgcggacgcgtgggccgccttaagaggtaggtgttctggtgctcggttgcgtagcagtaaagggagttttcgtcgtgatgctgctattactgaactgggaggtatgcgacttctatgagtagttgcttattagcctacagaaaatatagggatctggagactggttatgtttcatggctgttcttctttcaccggtaccattttatgacgaacgttgtatgactgattatcttcttggttacgttactgctacggcatggcctcatgaccctnttttgatctaaaaaaaaaaaatattattgttt

SEQ ID NO: 51083 - DNA, 211 bp, Zea mays
  Clone ID: LIB3067-010-Q1-K1-E10
cgttccgcaggatataagttatgcctgtggatgccagtcaaagtttgcgtattatttcggtaggtgcattgtaagtacttccgcggctgaaagtcttagtctaccttggtggtgatattgggagcatgctactccaaagcaaagtgcaccatcagagggtgcgtcgataccccgcggattgcgaaaacaggcttgcaaaagggttcgagta

SEQ ID NO: 51084 - DNA, 284 bp, Zea mays
  Clone ID: LIB3067-010-Q1-K1-E11
gcggcacaccaccaccagaagagcggccgagcggcgcagagaagagagaaccagccgagcggagcggctgcgcttccggagggaggaaggaggatggagaaggctctcaccaagctcggcagcttcacaatctcccgcaaggccaagcaagagctcttcgccatcggtgacgacatctcccgtttttcgagcacggttgaagagaaagcaaaatgggtgttcgagaaactcaaaaggcccaagaagtcgcttcctgatctactgcgcgagcacaaccttccttc

SEQ ID NO: 51085 - DNA, 391 bp, Zea mays
  Clone ID: LIB3067-010-Q1-K1-E2
taccacgcgttcggacccacacgtgcgcacaatgttgcgttgactcgtgggccgtcttaagaggggggtgttcaggtgctctgttgcgatgcagttacgggtggttgtgccgcgatgcaaatatttccgttatgaaaagtatacgagttgtatgacctttagattattaggaaatttaacagaataatagattgacatacttatgatcaaggttctgaaatgggatcttatatggtaaagagattaatatagcggatatttgcacattatgtataatctttcgtcgaggcttcctgtgcttcatattaaatttgtcctggaaaaaggtgtaccattctaactctacattaatctgacaaccctgttattcatttataaaatatataattta

SEQ ID NO: 51086 - DNA, 450 bp, Zea mays
  Clone ID: LIB3067-010-Q1-K1-E3
cttgtacgcatctgaagacattaacaatgggcaagggacaactgggagaatcattttttcaagctttggctgagtgcccattattgactgctttaacagtcaacgatgcttctcttgggagtggcattcaagaagtcactgttaatcatgatggactgcgtgagcttcatattttgaagtgccatgcacttagaatatctgtcagatgtatcccaacttcaaatactgtctttgaggcgaacaggcatggctcatgtatcactgaactgtcctcagttgcttgagttggacttccaatcctgccataagctttctgacaatgcgattcgccaagctgctacagcttgcccattgttggcaaaactagacatgtcatctcgttcttgtgttactgatgagacattgcgtgacatagctagctcatgttcgagtctttctggtcctgatgca

SEQ ID NO: 51087 - DNA, 387 bp, Zea mays
  Clone ID: LIB3067-010-Q1-K1-E5
cttgtacgcatctgaagacattaacaatgggcaagggacaactgggagaatcattttttcaagcttcggctgagtgcccattattgactgctttaacagtaaacgatgcttctcttgggagtggcattcaagaagtcactgttaatcatgatggactgcgtgagcttcatattttgaagtgccgtgcacttagaatatctgtcagatgttcccaacttcaaatactggctttgaggcgaacaagcatggctcatgtatcactgaactgttctcagatgcttgagttggacttccaattctggcataagctttctgacaatgcgattcgtcaagctgctacagcttgcccattgttggcaaaactagacatgtcatcttgttcttgtg

SEQ ID NO: 51088 - DNA, 464 bp, Zea mays
  unsure at all n locations
  Clone ID: LIB3067-010-Q1-K1-E6
tgcacgtactcgtgtccgtgtaattcccgggttcgactccacgtcgtctcgaagggagttgtgagtctccaagtctgtccaagtaaatgacgcctgtgctccaagggacgacaatacattatgatggatcttacanctcctgtttcttgtaatgtcgttggctagtttgaggtccaggattttgaatntgtgtcctttaaaaaanaatgtatgntgttgtaggaactctttagttctgttggaaattttactgaataatggaagacatcttaggttcaaggttctgaaatgggatcttatatctcaatgagattatgatggtggatatctgcacatcatgtctaatctttgtcgagtcttcctgtgcttcagattaaattgtacctggaaaaaggtgtaccatcctcactctacattaatctgacaccccgttttacatgtaaatatattaatttttttttttt

SEQ ID NO: 51089 - DNA, 415 bp, Zea mays
  Clone ID: LIB3067-010-Q1-K1-E7
ctccggcacggacaagcacgagtcggttctgaactcgtggtacgaggtgtccaacctgaggcagtactgcctgtacgggctctactgatacctcaagggcaccctgagcggccagttcaacaagatcttctaggctgtgttggcgctgccgtagtgtattcgccccacacttcgtactgtcggctgctccggatccttatgttgtgcttgatacacattctactagttgtcaggcgaacaggtatctcgtatgtatatttgagacctgttataacgctggctgagctctaccgtatgtaccgtaggcgtcatgtcagcgcgcttgttaacgttgctacaaatagtccattgttggcaaaactagacatgtcattttgttcatgtgttaattgatgagacattgcgtgacataatt

SEQ ID NO: 51090 - DNA, 87 bp, Zea mays
  Clone ID: LIB3067-010-Q1-K1-E8
gtggacaacaataattatatggttgctgcaagccttcacgtgtttttgttgcctctctaccaactaagaataaatcaagctagcagc

SEQ ID NO: 51091 - DNA, 343 bp, Zea mays
  Clone ID: LIB3067-010-Q1-K1-E9
ggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctccttcgagaactccatgctcgacgctatcgagaacatgaacggcaaggagctcgacggccgtaacatcaccgttaaccaggcccagtcccgtggcggtggcta

SEQ ID NO: 51092 - DNA, 268 bp, Zea mays
  Clone ID: LIB3067-010-Q1-K1-F10
attagtactgcaagcaaatcggggaatcattgtgaatacataaatctgtggatctcattactgtgcacattattttgatcactactgctagcagtacaattacaatagtttatttccgctggagatggctgctgcacactcggatggttggttcatcaggcaaaggcaggttgctcagctggaacagagagcacagcatgtcggttgggcaaccaacccatttacccagcccctatgtgtgctgctacacgactaccaacgatgcttc

SEQ ID NO: 51093 - DNA, 299 bp, Zea mays
  Clone ID: LIB3067-010-Q1-K1-F11
gccccgtagtgcagtgcagtgcagcagtgtgctaccctcctcagtcctctcactccatcacaaacgctagtcttcctctgaagagatctttggcaacgaccgacagctcggagcgagtctcagaagcgatggcgtcaaagaggctgctgctggcggcgctgtgcgtggtggcggcggcgctgctcgccgtgcggtcggagtcccacggcctggaggacttcgcaagcagcgacgcgacgccggagatgcagacctttttcaagcccgaggccgcggcgcttccggaggccctggacgcg

SEQ ID NO: 51094 - DNA, 370 bp, Zea mays
  Clone ID: LIB3067-010-Q1-K1-D5
gaaacttctgattatcctcagtcaagtgagaggccactgactgccacaagcagtttcagttgtgcatccccattttcggaatcaagccaactagcttcgtctagtaaacaagcggccccatatctacctcgcaaccatatgggcaggcggtctttcatgtctaaaccagtgtacccacttgtcttccggaaccctgtgtccgaatcagaagcgtgcaggatgcttgaggttagtaatgccgggcgagcgacaccaagtgatgacagccaggcttctcctctgtggcgtcgcagcttggcgagcccagagctcaagttccataacgcactgaacgaacttgggaagatggaggtttcacctgaacggaaca

SEQ ID NO: 51095 - DNA, 317 bp, Zea mays
  Clone ID: LIB3067-010-Q1-K1-F12
aggaggagtccccgagcaggtggcgaggctgtgcagcttcgaggtgctcagcggcctgtaggggaaccaaaccggaggtgtcgcttttggaaacgatttagtcattggcaagtctacgttcttcagggaaggcaaggtgggggactgggaaaaccacatgaccaaagagcaaggacagaggttggatgacgttttggaggacaagcttaagggatctggtctcgtgttttgattaattcatatagcatgttgcatgtcatgaataatcattcgcttacacatgtagtggtattttaatgtattggatcttttttttt

SEQ ID NO: 51096 - DNA, 453 bp, Zea mays
  unsure at all n locations
  Clone ID: LIB3067-010-Q1-K1-F2
cggacgcgtggggtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaagganggacgtgttgtggatcgctatgctncaaccacttcacccctgagcattgaaaaggatatcaagaagctgcttgtgagctcttaatcagtatctgggtgcaaaagctgtagaaaaacatgtattaacaat

SEQ ID NO: 51097 - DNA, 422 bp, Zea mays
  Clone ID: LIB3067-010-Q1-K1-C1
cggacgcgtgggcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaagcatttgctgatgagatgggcatcccgttcatggagacgagtgccaaaaacgccaccaacgtggaac

SEQ ID NO: 51098 - DNA, 326 bp, Zea mays
  Clone ID: LIB3067-010-Q1-K1-C10
cccacgcgtccggactagttctagatcgcggcacagagcctcattcatctccattcgaaacacgctcgcacccacactctcccttcgtccccagcctaaatccccgcaacgatggctcgcacgaagcagacggcgcgcaagtccacgggcggcaaggccccgaggaagcagctggcgaccaaagcggcgcgcaagtcggcccctgcgaccggcggcgtgaagaagccgcaccgcttccgcccgggcaccgtggcgctgcgcgagatccgcaagtaccagaagagcacggagcttttcatccgcaagctgcccttccagcgcctggt

SEQ ID NO: 51099 - DNA, 425 bp, Zea mays
  Clone ID: LIB3067-010-Q1-K1-C11
gcacaactctctcgcaggcttctctcccctctgcgcccttcccgcagcaccctgctcgcagcgctctccacaggacctgctccgcgcgcgccgcccccatcgccggcaaggcggcggtgctgctgcatattctcccggtcccccctccggagccaccctccccttctccgggacctcgagtaactttggagtaccagtgatgcaaagggacactagctctagcgatgtttctgcttctcatgtagggcgtgtaagacgtcgcaaacatccatctgaggcttccacagatgggaatagagctaatggacaaccgttgcttgtcaatgatcagaacaagtataaatcaatgcttatccgtacatattctacagtatggatgattggaggctttgcctttattatttatgtgggtcatctatatatct

SEQ ID NO: 51100 - DNA, 131 bp, Zea mays
  Clone ID: LIB3067-010-Q1-K1-C12
cccacgcgtccggggatcagggtgcgccacctccttttgagcccagtggaggtccacatcctaggaaagcagggacgggcagcggcggtcctccaatgcgtggcccgtcccaagccttaatggttcttcgg

SEQ ID NO: 51101 - DNA, 363 bp, Zea mays
  Clone ID: LIB3067-010-Q1-K1-C2
ctctacatttcttctgtctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctgcaagactggtaagcatggccacgccaaatgccactttgtcgccatagacatattcaatgggaaaaagcttgaagatattgctccttcatcacacaactgtgacattccgcatgtgaaccgtactgagtatcagctgattgatatttctgaggat

SEQ ID NO: 51102 - DNA, 440 bp, Zea mays
  Clone ID: LIB3067-010-Q1-K1-C3
gaagttcttcggagagtgcacagaccttaaaatcaagctagatcgctgcttccgacaggagaaagctttgaagagaaaggcaaactttgaagagagcaagagatttaaagaacagttgaaggcttacaaaagggaaattgcagagaaaagcgaggaatgataacttggaacggaggacaaggccgtataggctcttaatctgtgatgacctgcccttgattttgtgaaggatctgtcgagtgtttttgaatataatgtttctaaaaaatattatactcttttcctagtagcagctaaactttaacagcttaaattttcttccatgactaccgaatatgtttccaatttgttcatgcatgcgtgcaggagtcctttgtatcaaatttggacaacccactcttgttgcctagtataagcagtttattggccagttcctttta

SEQ ID NO: 51103 - DNA, 400 bp, Zea mays
  Clone ID: LIB3067-010-Q1-K1-C4
cccaaaccgacaccacagcctgagccaaaaccagagcctaaaccggaaccgaaacctgcaccacaaccagaccccaaacccgcaccacagccggacccaaaacccgcaccacaaccggacccaaaaccagaacccaaacctacaccacagccagacccaaaaccttcaccacaaccaggcccagagccgaaacccaagccagcgccacagcctgaaccaaaaccagaacccaaacctacaccacaaccagacccaaaacctggaccacaaccagacccaaaaccagaacccaaacctacaccacaaccaggcccagagccgaaacccaagccagcgccacagcctgaaccaaaacccacactgcaaccagatccgaaacctgagccaaaaccaacaccac

SEQ ID NO: 51104 - DNA, 129 bp, Zea mays
  Clone ID: LIB3067-010-Q1-K1-C5
cggactcgtggaaaaaaaaaacattaaatataaaactaaaaaaaaaataaaaacaaaaaaagagcaattaagagaaaagcattcttatgaatacagccttaaattcaattaaatgcaacaaggcttaca

SEQ ID NO: 51105 - DNA, 450 bp, Zea mays
  Clone ID: LIB3067-010-Q1-K1-C6
ccctaacaatgtgaagtcgagtgtgtgcgacatcccacccatcggcctgaagatgtcctccacattcatcggcaactcgacctccatccaggagatgttccgccgcgtcagcgagcagttcactgccatgttcaggaggaaggccttcttgcattggtacacgggtgagggcatggatgagatggagttcactgaggcagagagtaacatgaatgacctggtggccgagtaccagcagtaccaagacgccacagctgaggatgaggaggagtacgaggaggaagaagaggaagatcctgctgcctaagccatcatcccaagtgcttggtaaagatatgatgtcccttgtatcgctgctagtcagcactgagtcgtttgaggtgctcgtggtgatgttaggtactagatgggtgtcattacttatgaatgcgatgttgctgtgacagaact

SEQ ID NO: 51106 - DNA, 396 bp, Zea mays
  Clone ID: LIB3067-010-Q1-K1-C7
cccacgcgtccggcactgcgctcatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgctttcgctccctcgacttcggcgagcgcaacgggtacctcaagggcgtcgtcaccgacgtcattcacgaccccggccgtggcgcgccgctcgccaaggtcactttccgccacccattcaggtacaagcaccagaaggagctctttgtcgcagccgaaggcatgtacacgggccagttcgtctactgcggtcgccgcgccaccctcttcatcggcaacgtgcttgcccttcgcgggatccctg

SEQ ID NO: 51107 - DNA, 404 bp, Zea mays
  unsure at all n locations
  Clone ID: LIB3067-010-Q1-K1-C9
cccacgcgtccgcggacgcgtccgcccacgcgtccgacattcttccttaagcttgtgtcctggtgccgagttcctcaaaaggacaaagtcgttactgtggttcagtctctacttgaatgatattagtgacaaggtaaaactattcctttattgttaattattttctatatgcatgatggcagtaactaaaatattggattgtgttggacatacaacaagttctagaagccattagctaaccacataatcactgaccttaacccagtgaccatttaacaacgtatataatataaatttacattagatgctttatttttgcactgtagacctattgcacatataagtgctccttagaacttangttgttattttcagtctcattattccattctttactaaagaat

SEQ ID NO: 51108 - DNA, 415 bp, Zea mays
  Clone ID: LIB3067-010-Q1-K1-D1
cggacgcgtgggctcccgagccttgcctacctcaacaagcagcccgtgaagaggcccgtgaccgcccggcgcagggcgtcgtcgccgatgttggcctgcctcaacaagcagcccgtgaagccgcagcgcatcgcgcgggaggtggccacggacagcatcgcgcgcgccgcgctcagcggctcggacagccggagcatccggaagaggacgtcgcggcggctcacgcagagcccccgctcgtcgtcgttgaccagggcccgtggcggcggcggcggctgttcacccacaccaagaaacacctctcgtcgtcgttgaccagaagaaccaactgcgtgattcgcgttgctctttggagactggagacggcggcgtgactgcgtgcaggcagactcagacgacaccatgattctgcacg

SEQ ID NO: 51109 - DNA, 380 bp, Zea mays
  Clone ID: LIB3067-010-Q1-K1-D10
ccgcatcgcatcgagagcggggctgtaccgtgcgagactctactgctcgatcgccatggccggcgggctcaagtgccccgcattccgcaaggtcttgggcccccgccgccgcggggctcgccaaggtgcgccaggcgtccaaagtcgtaccggtaagcggggcccggcaaagccgcggcggcggcttcgccgtgcgggcgtctctgttctcgcccaagcccgcggcggccaaagacgcgcggtcgaccaaggtgcatgagctgtacgtgtacgagatcaacgagcggcaccgcaagagccccgcgtacctgctcctcatcgccaagcagacggaaaacgcgctgggcgacctcgtcctcttcaccaacaaggtgtacaac

SEQ ID NO: 51110 - DNA, 366 bp, Zea mays
  Clone ID: LIB3067-010-Q1-K1-D11
cccacgcgtccgcggacgcgtgggcccacgcgtccgcccacgcgtccggaggatatcttgactggatttaagatgcactgccatggctggcggtctatttactgcatcccgaagcggcctgcattcaaaggttctgcgcctctgaacctttccgaccgtcttcaccaggtccttcgctgggcccttgggtctgtcgaaattttcttcagcaagcactgcccactttggtacggatacggcggcgggctaaaattcctggaaaggttttcttacattaactccatcgtttatccctggacgtccattcctctcctggcttactgtaccttgcctgccatctgcctgctcacggggaagtttatcaca

SEQ ID NO: 51111 - DNA, 310 bp, Zea mays
  Clone ID: LIB3067-010-Q1-K1-D12
cccacgcgtccgcttgcttgctaccagggtttgtgtgagtgtgttagtgagagagaaccatggcgacgcagcggttcacggcggcgctggtggcctgcctcctcctgctcctggcgctgccggcgcgcgggcgcaacatcacggccatcctcgccgggtacaaggagtacaagctttacaaccagtacctgtcggagacaaaggtgtgcgacaagatcaactcgcggaagtcaacttcaataaccgtcctgtggctgtccaacgaccccttgacaaccctggcctccaaagccgggaattggtttcccgc

SEQ ID NO: 51112 - DNA, 60 bp, Zea mays
  Clone ID: LIB3067-010-Q1-K1-D2
cggacgcgtgggcggacgcgtgggcggacgcgtgggcggacgcgtgggcggacgcgtggg

SEQ ID NO: 51113 - DNA, 396 bp, Zea mays
  Clone ID: LIB3067-010-Q1-K1-D3
acacttatgcccggtgcacacgctcggtttctgttgtccctcctgcatactacgcacacctgggagcattccgggcgcggttctacatggaaccagagatgtcggagaaccagacgtataagagctccaatggcacgaacggaggcttggtgaagcccctgcctgctgtgaacgagaaggtgaaaagggtgatgttctactgctgacaaggtgaccactttaacaaccattcacatgctgtagctaacttggttaggttcagtagggggattagattagctttctacaggaacgaagaggaaacgggatgcgtatttggatcatgaacaatcaatctgatagcgatcgctgtagaatactcagaaatgcctgtataataagtcttgtaggttcaaa

SEQ ID NO: 51114 - DNA, 429 bp, Zea mays
  Clone ID: LIB3067-010-Q1-K1-B9
tcgcggacgcgtgggtggggataggcgtaggaccgttatgaggccaccacaagttcttagggagggaacaaagaagacagtttttgttaactttatggatttgtgtaaaacgatgcataggcaacctgagcatgtgatgatgtttttacttgctgaaatgggaacaagcgggtcacttgatgggcagcaaaggttggtgatcaaaggaagatttgcccccaaaaactttgaagcaatcctgaggagatacatcaatgagtacgtcatctgcaatggatgcaagagccctgataccattctgtccaaggaaaatcgtctgttcttcctttgctgcgaacagtgtggatcttcaaggtccgttgctccaatcaaagctggattcgttgctcaagtcggtcgtcggaaggcatgagcatctatatgtggatg

SEQ ID NO: 51115 - DNA, 261 bp, Zea mays
  Clone ID: LIB3067-010-Q1-K1-A1
cccacgcgtccgaaaccctctggactagggtttatctgggctcgcctcgttagttgttacccatctgtgtattcgattgtaaggtcgatctgtgtcacatgctagtgctgcggtcattctatggttcatcagactcatgcatcaaccagcatggactgtatgatcgatggaagctgttactcctgtcatgatttgttctaagttaatcctaaggaaaaaattgagctattaggtgctgcaaaacatacatacaacggcagt

SEQ ID NO: 51116 - DNA, 462 bp, Zea mays
  Clone ID: LIB3067-010-Q1-K1-A2
cccacgcgtccgcatctagggagttctgtggcagctgcattggccagattcttgggttcacatgtacgggctttaaatgctacagatatcggcttgggaacagtaggcttccaaatacttgaggaaacattgccaacagaagtagctctttcccacatcaacatcagtaagaatcgtggtgggatcagagcagcatattttgtttccagattaatatgtcgagcaccagaccttgtctcagtcaatgcagcagggaaccttttaccacctgaatcattggaagtcatctgtaactccttgaagcaagggacttgtaatttggagcgagtggacctgactggcaacatgcatttatcaagcaatatttttcctgcattccttgaattcaagaagcatggaaagccaattctggtagtaccaccaaacttgagcacttttgctccatatgatgatgacccatga

SEQ ID NO: 51117 - DNA, 411 bp, Zea mays
  Clone ID: LIB3067-010-Q1-K1-A3
gccaagttgaggaatcataattcatataatgagcttgtagcacaaaagctggtggacatgaagaacagccaggttactataacggtcaatggcgatgaaatccgtatggatcagttagggaatgttgatgaccgtaaaaaatctggggttcaggcattgcaaataagatcttgctcccagtgtgccattttggagtctggtgtgctaaggcagcctatgcggtcaaggggactgcttgctcgaccttatatccattcaatgcttgctatagcagcagtctgcgtatgcgtctgtgtattcatgcgagctttgctgcggatcaattctggaaaatccttcaagtgggagaggctggattacggtacaatataattgtggggacacacctgagccttggggtattattaagtt

SEQ ID NO: 51118 - DNA, 341 bp, Zea mays
  unsure at all n locations
  Clone ID: LIB3067-010-Q1-K1-A4
cccacgcgtccgactcattagaccacatcctgccatttggaggcttgttcatgggatgacaggggtttaccttgtcgccctcactttcttgctttttcagactcgtgatgatgctaggcaattcatgaagtatcttcatcctgatcttggtgtcgaatttcctgaaagatcttatggaactgattgtcgcatatatgtccctgatcatccaaaaagcaggtttaacaatgtttatgagatcattttttgatgaatttgttatagctcatatccttggatggtggngtaaggctataatgatacgaaaccaaccactttttgtggtcttggcaattgggttt

SEQ ID NO: 51119 - DNA, 428 bp, Zea mays
  unsure at all n locations
  Clone ID: LIB3067-010-Q1-K1-A5
cggacgcgtggggtcgcgtatcacgacgaggagtggggagtgcccgtgcacgacgacgagtaagcaagccgccattattccttgctccttgcaagcgcaagctgatgctcacggcaacagctgtgctcacatgttcgagatgcactgaaacgacaggttgctattcgagatgctcacactgtctggcgtgcaagtcggggccgactggacttccatcctcaagaaaagacacgtgtacagggaggcgttctccggcttcaacgtggatgcggtcgccaagtacaccgagaagcagatggcgtcgctgaacgccgactacgggctggatttgggcaccgtcagaggaaccgtcaacaacgcctgccggattatcgaagtgcgganggacttgggctcgctggacaagtacgtgtgggcgttcgggaaca

SEQ ID NO: 51120 - DNA, 462 bp, Zea mays
  Clone ID: LIB3067-010-Q1-K1-A6
ccagtctcccgggcagaagaggcacgagaggaaggtggggaaggaaaccacagccgcttctggcgggcgctcaccctgccccttccacctcgcctcgcctcgcaatggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcactttacaacggacagggct

SEQ ID NO: 51121 - DNA, 424 bp, Zea mays
  Clone ID: LIB3067-010-Q1-K1-A7
cccacgcgtccgcccacgcgtccgcccacgcgtccgcccacgcgtccgcccacgcgtccgggctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctgcgacgacgtgggcctcgacgccgaccgctgcaaggtgctggtgaaca

SEQ ID NO: 51122 - DNA, 226 bp, Zea mays
  Clone ID: LIB3067-010-Q1-K1-A9
ggtgctcaacagaacaaaggagaccaagatcactggtgccaatgcttccatgaaatcacatggccctcttgtgcacctgtccgcgcttccagaaggcaccgttgtggactcgagatagcgacctctactcggaatttactttcagctcttgcatgtttgtggttgtggccatcatgtactgattttcccttttcaacagttgtcgtgaggctgtatcgtctggagt

SEQ ID NO: 51123 - DNA, 457 bp, Zea mays
  Clone ID: LIB3067-010-Q1-K1-B1
aaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcagaggaaacacctgctgtagaggaagcaagtgagactaccgaggaggaagaggctgagaaacctgagatcaagatcgaaacagctccagcagattttcgtttcccaacaacaaaccaaacaaggcattgtttcacacgctatgttgaatatcacaggtgtgtggctgcaaaaggtgaagatgcacctgagtgtgataagttcgccaagtactatcgatccctgtgcccaggtgaatgggttgatcgcttgaacgagcaacgcgaaaacggcacctttcctggaccttttgtatcctacaat

SEQ ID NO: 51124 - DNA, 52 bp, Zea mays
  unsure at all n locations
  Clone ID: LIB3067-010-Q1-K1-B10
ncaacgcgtccggttggcttctcctccccttccggttcggttccggttcctt

SEQ ID NO: 51125 - DNA, 375 bp, Zea mays
  unsure at all n locations
  Clone ID: LIB3067-010-Q1-K1-B11
cccacgcgtccgctgctaccagcaccatcctagcaccccaccgcgtctagggtttcctgctggaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcanggctacggcgtgcgccccgacgccgaggtgctcgacgcgatcgacacggcagcgcgccagaagcagcttgaggtggt

SEQ ID NO: 51126 - DNA, 456 bp, Zea mays
  unsure at all n locations
  Clone ID: LIB3067-010-Q1-K1-B2
aggccgcgtacctccacgggcacttcagcgcccgcgtcaagctgcccgccgagcacaccgccggcgtcgtcgtcgccttctacatgtccaacggggacgtgtacgagcggacgcacgacgagctggacttcgagttcctcgggaacgtgcgcggcaaggagtggcgcgtgcagaccaacgtgtacggcaacggcagcacggcggccggccgggaggagcgctacggcctctggttcgacccaaccgaggacttccaccgctacgccatccactggacccgcgacaggatcatattctacatcgacgacacgccgatcagggagatggtgcggacggagtccatgggcgcgcagttcccgtccaagcccatgtcgctgtacgccaccatctgggacggctccagctgggccacctcggngggccgctacaaggtggactacaagtacgcgcnctacg

SEQ ID NO: 51127 - DNA, 443 bp, Zea mays
  Clone ID: LIB3067-010-Q1-K1-B3
gataaagagccccatggaatttagtatgcccggaacaacaatatttcagtctgtcctttctgaggaagaccatgccaacctttacgcgcacgagccagtaagtttcacggagagacaagcggggtgcatccttagtttggctctatgttgtatcacctactgcaaatatcttgctaccatatgctacggcccacatcattatctggcagaccatgcaaaatatctacttgaaggtatcgatcctgcacaatgaatcttctttcttggcataggtgtgttgtgaaatcttatgctcttatgagttaatgtaaaacgtgtcgtgattatcaaggctgttgagcttattttctatatgattgtatgctgagctcgttatttattattttgtatggaaacaccatttttctaaaaaaattttgtcactgggaaattggatcactaat

SEQ ID NO: 51128 - DNA, 349 bp, Zea mays
  Clone ID: LIB3067-010-Q1-K1-B4
cccacgcgtccgtccacgctccgagctttttagttgcatcagactgaagacgaccttcccaaatttctgactctcagtgtactgtacctagttacattcactgccagtctgtcgctggacaatgctgagttctagagcaattgtggactgtgtttgtaaatggaggcagatgctagcgttgatcatttttcactgtacgtttcttccttctggttggttgtacgtgctctgctgcaatttcaagcgaacagatttcagcacctcgtgtcattttttttttataaatttgttatttctgtcaaaaaaaaaaaaaattattaaaataataaaagatgtaaaacttaataac

SEQ ID NO: 51129 - DNA, 241 bp, Zea mays
  Clone ID: LIB3067-010-Q1-K1-B5
cccacgcgtccggccacgcgttcgaccacgcgtccgatgaaaacaaaataaaggatttcaagtgggcacttaaaaaaaaaaaaaaaaaaaaaaaaaaaaaaaaaaaaaaaaaaaaaaaaaaaaaaaaaaaaaaaaaaagaaaatataaaataaaaaaaaaaaaaaaagaaaaagataaaatataaaaaaagttcacatgattatcttgtaataccatacaaaataatctagtttaaagaat

SEQ ID NO: 51130 - DNA, 173 bp, Zea mays
  Clone ID: LIB3067-010-Q1-K1-B7
cccacgcgtccggagagagtaagacaggcaggcaggccataacaaagattctcagactagagtacctgttattttactttaatatgtctctctcagactagagcgccttcttttacttgaatattggtgactgcattggtctttcactttaaaatcggtgactgcattgatcg

SEQ ID NO: 51131 - DNA, 413 bp, Zea mays
  Clone ID: LIB3067-009-Q1-K1-H9
caacgccggcgtcttcctcttcaacaacgctaccgtcgcgcgggtcacggccacgaagctcgtcgtccacgagatggactcgtcatacaaccacgactacatggcgccggtggcagacatctgatcgatgcaatgcaaccacgccactctgcaccgcaacaaattttccaacacacataaatataccaagcaattcccatctgtcaaattttcttatttccctgccatgattttggtctctatttttcctgctggctactacttatcttccagcactagtaatgtacgtactggctagtaactagggtatccagtgggaagacgtgtagcctttagttgtacatgcatgtatgatgctgtgtagcaccgtatcatgcacaccaaaccaatgcatatgagttataaatgttttt

SEQ ID NO: 51132 - DNA, 370 bp, Zea mays
  Clone ID: LIB3067-022-Q1-K1-E8
cccacgcgtccgcccacgcgtccgcccacgcgtccgcccacgcgtccgcggacgcgtgggtccagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgacggacttgtgaagggtctccgtgaggctgccaaggccatcgagaagcacgccgctcagctttgcgtgcttgctgaggactgtgaccagccagattacgtcaagctggtgaaggcactctgcgctgagcacaatgttcacctggtcact

SEQ ID NO: 51133 - DNA, 410 bp, Zea mays
  Clone ID: LIB3067-022-Q1-K1-E9
gctgaaagctctgcaagaattaaatgtttactggaaaaagataggtcactataacatgaagtgcagatggagtcctggctttcctgctcaaattcataacaatcataacttcagtgcagggtccattgaaactgatagcctgagtgagaggttaagtttaattaagtttgaaattcagctgtacaaaacaagagacgagaaatacctcctcgatttgcaaagagtcagtgggccacagctcctctttctggacttgtgcgcggcctttctaactcaactgagagttctttgatttctggtgtcagctttccatcagttgcattccttgcgtttcactagaggaatgtctaaatcgctcacaaagctgtaaatagtaatctccagtagattggattttctggagtatgtag

SEQ ID NO: 51134 - DNA, 404 bp, Zea mays
  Clone ID: LIB3067-022-Q1-K1-F1
ccagcttcatgctccaaggaggtgacttcactcttggggatgggaggggtggtgaatgtatctatggcatgaagtgtgctgatgagaacttcaagatcaagcacactggaccaggccttctgtccatggccaatgctgggagagatacaaacggatctcagtttttcatcaccaccgtgacaacaagctggttggacgggaagcatgttgtgtttggcaaggtgttgtctggaatggatgttgtgtacaaggtggaagctgagggccggcagagcgggcaaccaaagagcaaggttgtcatagcagatagcggcgagctgccgatgtgatgagctgaactgatgttctatctggaaggatgttaagaagttgctggtgaccatttgtcgttctggaacttttat

SEQ ID NO: 51135 - DNA, 247 bp, Zea mays
  Clone ID: LIB3067-022-Q1-K1-F10
cccacgcgtccgaagacgaaggaaggaggcggatattgtgtggtggcaagtttatatgctttccatccatccatccatttaattctttttacactcgagtcattgaaattttgttctggtagttttgtgattgatttggtaggttggagatgattgtagtagagatgccattgtttgtggagtaacctacaggatattgttacaattgttgacatactatagatgtgcagataattctttcaagagt

SEQ ID NO: 51136 - DNA, 403 bp, Zea mays
  Clone ID: LIB3067-022-Q1-K1-F11
agaataaagcagaagagataccgggatgtctaagacggctggcgtaggcagactcagaggagccggggcgtcggacgcggggcaataataacatttagcagctgctgtatgctaggagttctacggtcaatacgctgcatccatacactcttacaccatgcgccacatgatctatgatgactgctcatacaactgaatccctgttactaacgttaactccaagatcctatccaatgtaatcgagtactgcaacaagcacgtacatgccgtcgacgtcgccgtcgtcgcctcgaatgccggttccgacgacgtgggtgccttcttcgtcaacagtaccgacggcttcggtgaggaccttaagaactgtgatgcggacttagtcaaggtcgaacaggccacgctt

SEQ ID NO: 51137 - DNA, 420 bp, Zea mays
  Clone ID: LIB3067-022-Q1-K1-F12
cgccgctagctagcgttcctaatcaccgacgaataatctcttcttcacctcactaacaccgagctagcagctcgctctgtcctgcaacaatggccgctcgctcctgctcccagcagctggtcgcggcggctggtcctggcagcggcgctgctgctgctggcggcggtggccgggacggcgtcagcggcggtgagctgcggcgaggtgacgtcgtcggtggcgccgtgcctcgggtacgcgatgggcagcgcggcgtcgacctccgcggcgtgctgcagcggagtgcgctcgctcaacagccgcgcgtcgtctgccgaagaccggcaggccacctgcaactgcctcaagagcatgacgggccggctcggcagcggcgtcagcatggccaacgccggcaacatgcccggcaagtgcggcgtc

SEQ ID NO: 51138 - DNA, 459 bp, Zea mays
  unsure at all n locations
  Clone ID: LIB3067-022-Q1-K1-F2
atgagagttttgcagctggtcatagaggcccaaggaatggtgataagaaagatcataagtggaatactgacagggctgatgcatataggcttactcgtcgagaggacaacaggagggttgctagagatatggagaagccacaggagcaaccacgcccagagcctgagacctggcgtaagccggtggagcctccaaagctagaggttgcaacacctcgttttgggaaagcagcaaccgcgttggagctcgcccaggccttctcaacgtctatgtctgatactgcaccacagagccggttgaccagtgctcccagtccaagagttcctcctagcccaagggctagtagggatcagtctggcttttcaaggctcactgacagcaggacgttacactcgggccctttccagcgaaagatanatggctactgatcgctggcacacatattacatgtgccacgat

SEQ ID NO: 51139 - DNA, 341 bp, Zea mays
  Clone ID: LIB3067-022-Q1-K1-F3
cccacgcgtacgcgctgctcgccttgctggcgctcctcgcactggccatcgcgctcgtggtcgtgctcgtggtgaagccccgtaagccgcaaggtcgacctagaccaagtgtacatgcaatacatgctggtggcctcgccgacgtcaggcgccagcctgcttccatcgaccccaggcgccgactacatctgcatcaacatgacgctggtcttaaccggccagaaccccaacaaggtcggcatccggtacagcacgaccaagttcgacgtcatgtaccacggcgtgccgctcgagatggcggcagtgcccgggttcgagcagcccacgcacagcacccggct

SEQ ID NO: 51140 - DNA, 276 bp, Zea mays
  Clone ID: LIB3067-022-Q1-K1-F4
gtccagctttctcgctgtgagcctccaccagcgccctaagccacacgctgaggctgtcgccgatgtctacaaccgcgacgatcacccagccgatctgtataaatgccttaacgacacgacatccagtctcttgcttgccactatggcactgcaatgctcaaggctccttttgctgaccatcatgcaccaatggctgcctttcctaacattggtggccgtcctcgacacactgccgtcactgtctggaccggaccacaagacgcatttgctggccat

SEQ ID NO: 51141 - DNA, 255 bp, Zea mays
  Clone ID: LIB3067-022-Q1-K1-F5
cccacgcgtccgcccacgcgtccgcccacgcgtccgcccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaagagaaaaacaaacaagattcaaagattacatcacaaacagagcaatccaactgaataaacataaaagcaagtaaaaatcagcaaaatgcccaacaagatccaacgttcgggacagggaaaa

SEQ ID NO: 51142 - DNA, 379 bp, Zea mays
  Clone ID: LIB3067-022-Q1-K1-F6
aacctctccccttttctccgtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaggtcctcgagcgcctccccgacggcggcgccgacagccacgtcttctacacgcaggaccgctacgtcttccacgccaagcgcaccgacggcatcaccgcgctctgcatggccgacgacgccgccggaagacggattcccttcgcatttttggaggatattcatggaaggtttgtcaagacatat

SEQ ID NO: 51143 - DNA, 408 bp, Zea mays
  Clone ID: LIB3067-022-Q1-K1-F7
cccacgcgtccgtcttcatctcccaggttttcccctccaatcacccccaggtcttcctctcgcgagttgcggtctcgcggccccctccaccgaccgccgcctcctcacaaccgcggaagctgcttccctctccattggacgcggccagcttccatctctcggtcacctccctctacatcccacggccgctaccaccttccctctacctcacacggccgccggcctctccaaggtctgcacacgcattcagcgacgcatttgcctatatcagcactgtggtcataactctagtagagaaaggagaagatgcaagcatctagggcaaggcttttcaaggagtacaaggaggtacaacgagagaagtcagctgaccctgatatccaattaatatgtgatgattccaacata

SEQ ID NO: 51144 - DNA, 356 bp, Zea mays
  Clone ID: LIB3067-022-Q1-K1-F8
cggacgcgtgggcggacgcgtgggccaggagctgctgtcgacgcccggcgcgcccacggcgccgatcgtcggacggttcgccgccagccagaaggagttcttcaggagcttcgccaggtccatggtcaacatggggaacatccaggtgctgacggggagtcagggtgagatcaggaagaactgtaggatggtcaacggaagctagacccgtcgacggcacaagttactggtgaactgaaagcagttctgctgtatgtacgatgcctcaaacatgttgatgggataatggtgcgccgatcgatttatttgtcaaggagatccaataaattggttatttgcatttttttcaacaaaaa

SEQ ID NO: 51145 - DNA, 407 bp, Zea mays
  unsure at all n locations
  Clone ID: LIB3067-022-Q1-K1-F9
ccggatcccgtccgcccccggaccaagaatcccaacctcacagcgatggcagcatcccgcagcgaggaacgtgatcagaatcagccagtggtgcttgtgacggggtgctcggagggcggcatcggccacgcgatggcgcgcgccttcgctgcggccgggtgcgccgtcgtggccacggcgcggtcacgcggttccatgcgcggtctcgacggcgacccgcggttcctgctgctggagctcgacgtgcgctccgacgagagcgcgcgcgccgncgtggcgggtgcgctgcgggagcacggccgcatcgacgtgctcgtcaacaacgctggggttcacctcgtcgcaccactcgccgaggtgcccatggagtccttccaccaggttttcgacaccaatgtctatggtgc

SEQ ID NO: 51146 - DNA, 407 bp, Zea mays
  Clone ID: LIB3067-022-Q1-K1-G1
gtggaggccctggcgtgggagctgaacatgaagctgttggacatgaagcagcggtaggagcagtgcaccaccttcctagagcatgtcggttgtttgatgaatgctggttgatgaagaaacttaagatcgacaattttttatttgagattcccttcgcaactccaaaagtttagatttgttgcctctgatcttgaaccaggtgtcggcgcactgcttgtgggcgtaggataagtcccccttgcaggagcagtcgagcgtgatgccggcaccggactcggccgccgtgctctccaggccaaggtggcaaatgcgacagttctgttcggccttctcagggctggccttgatgatctcgctcagtccggccttcaggtcaacgtcgtccagcgagccctctgacacgcacg

SEQ ID NO: 51147 - DNA, 407 bp, Zea mays
  Clone ID: LIB3067-022-Q1-K1-G11
cccacgcgtccgcggacgcgtggggcgccgctcctttcggatctgggcgaggtgagctgcggcgccggacgtcgcggggaagaggatgaactggatcgggcgcaagatccacctctacaatgtcaccatcggcctctacatgctcgattggtgggagcgctacctcttcaatattttgatggtttgcctcttctggtacattctccgctatctccttgggttcttccaaagtaatgtgaagactcttttccaagaggggaactaccttgggcaaggcagtacataaccattgtcaaacaagatctgcttatgatcatttgccccatgtaattccatgtgtttaattagttgttaactacttaactgaggagctgagaagaagtaatttaagcaagtgttacagtgta

SEQ ID NO: 51148 - DNA, 387 bp, Zea mays
  Clone ID: LIB3067-022-Q1-K1-E7
ggaaatattagatgcactgcaaagtgccagcaagtctcttggttctgataatgttaaagtaaaacaagcagcttcatcaaatcctggtgttccaccatcttcattaatgtcattcatagggaagaacacgtcaacttctggagttgtgttggaggattttgattctcacttctccaatagattttatcatagctatctggataaccctgtaaacatcaattcctcgtcaatagctgcagccgctgctttggttgccaggtcgctgtatattcttgctagtgatgactcagttgttgaccttataacactaaacactataaaagtgaacgtttcattggtcgaagaacttattggatgcctgcttacttgcaatccttgtctttcgtg

SEQ ID NO: 51149 - DNA, 360 bp, Zea mays
  Clone ID: LIB3067-022-Q1-K1-D12
gaccatacgagaggtcaggagcagacatagtgccggcaggctatgagcttgacgacctgatggtttatggacagtggctgaaggacgctggccaacattctgtaagagccgaggatctcgctcagctggtgttgaatgttctacagatggcgattggggaagctgagaggaacacagacgatctgctggaccagttgacagagctcgactatctgctccttgtgctccacttgatcacaaacctgctgctgaacagtctcattgagcaaatcagattgctgctcatggtaccagactgaccagtaactaccacaggaccgatgttcagaacaccagcggctgtcttacggactgtgcttc

SEQ ID NO: 51150 - DNA, 397 bp, Zea mays
  unsure at all n locations
  Clone ID: LIB3067-022-Q1-K1-D2
cccacgcgtccggcgaatcgacgcgcctatctcagcttgctgcactgcactgcactgccctgccatcatatcgtacgtgagcccggccgagagcgagggagaggcatggctgctccgaagctcgcgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggngccatggccgcccagccgtgctgcggcggcatccgcagcctgctgcagcaggccaacaacacccccgaccgtcgcgccgtcgcgctgcccagcaccaacgttaactgcaacacgattaattaaatgaggcgtnctgtgcgcg

SEQ ID NO: 51151 - DNA, 388 bp, Zea mays
  Clone ID: LIB3067-022-Q1-K1-D3
cccacgcgtccgccagaaaagtgtacaacgaactttctgcttcagcagttaccattcaatcaggattgcgcggcatgtgcgcgcgtaaagagctccacttcagaagacaaacaagagctgcaatcatcatccagagtcgctgccgtcaattcttggcgagattgcattattcaagaacaaagaaagctgcaattactacacagtgtgcgtggagagggaaagttgctagaaaggagctccgcaagctcaaaatggctgcccgggaaactggtgcattgcaagctgccaaaaataaacttgagaaacaagttgaggagctcacgtggcggctacagttggagaagcgcatgcgagctgatctcgaggaaactaaatcacaagaaaatgc

SEQ ID NO: 51152 - DNA, 319 bp, Zea mays
  Clone ID: LIB3067-022-Q1-K1-D4
aatacctgtcgctcttgagtgtgtgttcgaactaagagctcaagcaatgaccattgagtcacgagggcctgccagtgtgcgcgcgtgaacaagccatgtttactatgaagcacgggaactgcattcatcatccaaagctgtttctgaaaaaccttgtcaagattgcatgattaacaaacttagagagctgatattactacacaatgagcgttgagaggtaatgttgctatacaggagctctgaacgctcaaaacgtctgaccgtgtgacttgtccatggcacgctgtcaacacttaactcgagaaacaagttgaggagc

SEQ ID NO: 51153 - DNA, 260 bp, Zea mays
  Clone ID: LIB3067-022-Q1-K1-D5
ataagatggaagtcagaacatgtagttgttttcgtttgtaattttgtttctatagtgtaagatttgacaaggctgttagtttgcacctcggatctgcttatatccacagggcaatcgatagttcagcaagtattgagctatacctatgtcccgagaagattagatgagttggcgtcttggcgatcgatgtgggcttttcccgttgttgttccttgcaatttattttcgaaaaaaaaagaaacatgttcgctttaagcttt

SEQ ID NO: 51154 - DNA, 421 bp, Zea mays
  Clone ID: LIB3067-022-Q1-K1-D6
gcctgacatctgtcttccagggctctcagacgtcattggaagttataaaagcggcaaagcactacaagctatttcagcgtgcgacccatgtctactctgaagcaaggagagtttatgctttcagggatactgtctcttcaaaactcagtgaggaaggcaagcttaagaaacttggtgatcttatgaacgagagccattacagctgcagcgtgctatacgaatgcagttgccctgagctggaagagcttgtgaaggtctgcagagacaatggagcactgggagcacgtctgacaggagctgggtggggtggctgcgcggttgctctggtcaaagagcccatcgtccctcagttcattctgaaactaaaggaaatgtactacaaatcaaggattgacaggggagtaatcaaagcaggtgatgt

SEQ ID NO: 51155 - DNA, 157 bp, Zea mays
  Clone ID: LIB3067-022-Q1-K1-D7
agccccatgagatggtattctaagtttctagttttggagttcgtaggaagctgttttgtctgtgttcttgtacttctgagttttgtaccagtagcgaacgtttcattgtgattgaagtcttcctgccaaatattataagatctaagaaagttctatc

SEQ ID NO: 51156 - DNA, 275 bp, Zea mays
  Clone ID: LIB3067-022-Q1-K1-D8
gataagccaagcagaggtggacggtacaccgtgtaagtcgcacacgaagatggtcgttgttcggactggacagaggctgagagtggagttttgtgctgagatcggcaccagctttcatttaatacagcctcagcttacctgaggcaattttcgcacctgttatgatgttgttttgctctcagataggtttatgtagcacaagaaagatatgttggagacgttgacgattttgtatgcaactaaatttctatcttaatatgccccgattcaacagc

SEQ ID NO: 51157 - DNA, 410 bp, Zea mays
  Clone ID: LIB3067-022-Q1-K1-D9
cggacgcgtggggtgctgaggcggctgcgggagctgaagaagatcgtgccagcgggcgctcgccgccggaaggcagacgtcgacgtggtgctccggcggaccgccgagtacatctgcgcgctggagctgaaggtggcactcctccggaggctctctcacatgtacggtgtgtagcctgtgccgccggtcacccacgccattgcctgccaccacccccaccaaagtagtagcccctatatatgcgattggttattggtcacatatggtcatatggacgtgcgtgtgtgtgtgtgtgtctagctagtagttaagatctggctgggaagaaagccagcccccggcccgttgctccagctctgagtgcaagagagagagagagagatgctttcgctgctggtggctgtgtcaat

SEQ ID NO: 51158 - DNA, 372 bp, Zea mays
  Clone ID: LIB3067-022-Q1-K1-E1
cccacgcgtccgcggacgcgtgggctgggcagatgcgttgagggcgcgtatgaaagtgcctcgcaaatatctgacttcttgaccaagtatgcctacaagtgatgaaagaagtggagcgctacttgttaattgtttatgttgcatagatgaggtgcctacgggaaaaaaaaagctttaatagtattttttattcttattttgtaaattgcatttctgttcttttttctgtcattaattacttatattttagttcaaaaaaaaaaaacctgaatggtagaatgggacgcaacactgaaaaggaacataaagcacagaagatgtaaaggatacgcacaagagtgaccgataaaaaaaagggggggcctttttaaa

SEQ ID NO: 51159 - DNA, 357 bp, Zea mays
  Clone ID: LIB3067-022-Q1-K1-E10
cccacgcgtccgcccacgcgtccgcccacgcgtccgcccacgcgtccgggtcgctccacaactcgccggagctgccgcttgggcacgcggcgcggctggccaagaaggccgagtgccgggccatcttcatcttcggcgccgaggagaggtcgctccacaacatccgtgacctcgtcgaggctgcgcgacacacgcttgggctgctcaaccgtggccgcctcccgtagagaggaacgaggaatctatctgtaagatttggttctggtgcgtgccgatgaatggctaaatttgtctgttctagtataagctactatcaatatactgtacacttgctaattaaaagaaagaagttttatg

SEQ ID NO: 51160 - DNA, 390 bp, Zea mays
  Clone ID: LIB3067-022-Q1-K1-E11
cccacgcgtccgtgaaagacggccggcaccttgcctacagggaggaaggagtgcgcagggagaacgccaggttcaggatcgttttcatccatggcttctcctccaccaaggagagcgggttccccgtgtcccaggagcttgtggagcagctgggcatatacatgctcttcttcgacagagccgggtacggcgacagcgacgccaacccgaagcgctgcctcaagagcgacgccacggacgtcgaggagctcgccgacgcgctgcagctcggggacaggttctacgtggtagggtgctccgtgggcggctacccagcatggagctgcctcaaatacattcccaacaggctggccggagtggcactgcccgcgccggcggtgaactactggt

SEQ ID NO: 51161 - DNA, 412 bp, Zea mays
  Clone ID: LIB3067-022-Q1-K1-E12
cccacgcgtccgatttgctaggatcatggataagcatttgaaggcccttgctcctgtctatgtgggaacaaaattcatcaagcttgatgctgaaaatgctccattctttgtagccaaactggcaatcaaaaccttgccatgtgtaatattgttcaagtaagtgtacaagttattcattactcctacctatttgacaatgttttttgctgtttggtaccctgcaatcttcctacttcaccatactatcatccctgtcctatttcaggaagggtattgctgttgaccggttagttgggtttcaagatctcggaagtaaagacgatttttcaacaagagcgttggaaaacattctcaagatgaaagggataatcgatgagaagaagaaagatgacgacgatgatgatgaagaaag

SEQ ID NO: 51162 - DNA, 417 bp, Zea mays
  Clone ID: LIB3067-022-Q1-K1-E2
cccacgcgtccgagcagcaaaaacacaggctacctcgatctctagctatagctaccagtgtcttcttcagttccttgagaggaggagagaacccaagaatataatggaggggaagaagagcagcctcgcctgctgctgcctgctcatgttcctgctgctgtcagcgcagcagcagcaggtggcgggcctgtccaagttctgccgctgctaccggaactgctacaccgactgcaggaagtccacgggccgctacccctgcaacgccaactgctttcaggactgcatcaacgggatgctgccgccggctccggcggaggtcgtcgtccccgccgactgccgcgacatctgcctcatgggcttctgcggctccatggagatcgccggtgacgccgtggctggggatgccgaggcgtgtgt

SEQ ID NO: 51163 - DNA, 374 bp, Zea mays
  unsure at all n locations
  Clone ID: LIB3067-022-Q1-K1-E3
cccacgcgtccgcccacgcgtccgcccacgcgtccgggtcaccacgctcgccaccaccagcgtcgccaagaaggactacacctacgaagcggagagcaaggacgacaccgtcacgctcgacaccaccgtcgtcacctccaccatccaggccaccgtcagggacgacgacccgctcgccgtctacgcttgctccaagttcctgcagcctaaggagctgttcaaggccaagaccgctgatctcgcgcctgcgccggctccgcaagggcccaagaagaagagcaagaagaagcccaccggcacctcggcggccttcgcgccctcggacgatgaatctgcagatggcccgtctgccgacgacgactcgtncgatgatg

SEQ ID NO: 51164 - DNA, 374 bp, Zea mays
  Clone ID: LIB3067-022-Q1-K1-E4
caagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagctcggaagaagagcggtaccgcatcagccccgtgtcctacctcctggtggacggcatccctcacgaggaccacatgaaccaca

SEQ ID NO: 51165 - DNA, 414 bp, Zea mays
  unsure at all n locations
  Clone ID: LIB3067-022-Q1-K1-E6
cccacgcgtccgcccacgcgtccggcaacaatggccgctcgctcctcctgccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagccccaccgtcgactgcaccaagatcaactgatcg

SEQ ID NO: 51166 - DNA, 343 bp, Zea mays
  Clone ID: LIB3067-022-Q1-K1-D10
cccacgcgtccgcccacgcgtccgcccacgcgtccgattctgtggtgtgtcattgacaaggacacgtagttcgctggtgtctgattgaatctgggtctgctctagtcgatttggtccctagtagtatgtaacaggagaagataagagtttgttggatgtgcttgaaagcttcgtcctgttctcgcttccccaaccattctagagtcagaattccatgtcattcaagctgatcttctcattcatcgttttgctgcatagtgcgtcttggtccaattgtcttcatttaggttctagtttgagaaccctattttttcaatggatttttatttttacaaaaaagaaa

SEQ ID NO: 51167 - DNA, 405 bp, Zea mays
  unsure at all n locations
  Clone ID: LIB3067-022-Q1-K1-B12
cccacgcgtccggccaccaagagctccgtcgggtcggccgccgtccggctgggcgtctcggagcccgcggcgtcggccgccgcgtccgccgcggcgggcgtgtccgcggccgtcgcggcgcaggtggtgtggacccccgtagacgtcatcagccagcggctcatggtccagaccccggacgcctgccgctaccgcggcggcgcggacgccttccggaagatcctcctcgcggacggcgtccgcggcctgtaccgcgggtttggcctgtccatcctcacctacgcgccgtcgaacgcggtgtggtggtccacctacgccgtggcgcagcggtgcctgtggcgcgccgtggggaccgagcgctccgagagctgcgcctgcctgatggctgtgcanggcgcgagcgcg

SEQ ID NO: 51168 - DNA, 338 bp, Zea mays
  unsure at all n locations
  Clone ID: LIB3067-022-Q1-K1-B2
aacaaagctgctctgggccccataaatgaagcagctactacaggggcggcgaactactcctcgtcgccaaaaccctactgctgcttgtatgccatggcgagcagtgctagccaggcgagcctcctgctccagaagcagctcaaggatcttgcgaagaaccccgcggatgggttacacgncaggcttgtaaaccacagctacatcttcgagtggcaggttaccatcatcggaccgtctgacaccctatatgatggaagctacttcaatgcaataatgaccttgggccagaactatcccaacagcccgccatcagtcagatgcacttctgagatgtggca

SEQ ID NO: 51169 - DNA, 215 bp, Zea mays
  Clone ID: LIB3067-022-Q1-K1-B4
tcgcccacgcgtccgcggacagtttgccagaataatggcagcagcttgctcagctccgagaggaaaccagctgtgaggttatcaggaacttgtatggtttcaatttgtttgtggtttttaacacatggcagatcgatcatcctttgcctcaaatgaagtacacatattgctagtagctcgccttctgcatgctttgggatatgtatgcttcaata

SEQ ID NO: 51170 - DNA, 385 bp, Zea mays
  Clone ID: LIB3067-022-Q1-K1-B5
gagacgccgacgcggcgcccgagaagaatttgcggatggattcgctgcgcagcgtgttggagtcgattcaggcgatgcagatccgccccgtggtcgcccaaatcatcaccctagggatgatcctaacttcggcattgatcctatggaaaggattggtcgtcgtaacagggagtgagtcgccggttgtggtggttctatctggaagcatggagcctgggtttcgaaagggtgatgtcctgtttctgcacatgaataaggaccctgtccgcacaggagacatagttgttttcaatgtcgagggccgtgatattccaattgtccatcgtgtgatcaaagttcatgagcgccatgatacggtggactctgacattcttacgaaaggtga

SEQ ID NO: 51171 - DNA, 390 bp, Zea mays
  Clone ID: LIB3067-022-Q1-K1-B6
gtttctgtctgctaccagcaccatcctagcaccccaccgcgtctagggtttcctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcgccagaagcaactgaaagtggtggcgaaactgtactggggc

SEQ ID NO: 51172 - DNA, 398 bp, Zea mays
  Clone ID: LIB3067-022-Q1-K1-B7
gagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgcaactgcctcccgtgatcgtcaggctagccagatcaccttttcccaggacgggaccgttcctaccaggaaggcaacctcagtggctggggtggcaaggcagcgtgagcttagccataccgtcgagagtgagggggacaagtagat

SEQ ID NO: 51173 - DNA, 275 bp, Zea mays
  Clone ID: LIB3067-022-Q1-K1-B8
cccctcttctccgaatctggaacgtgttgttcatcttggaccaccccctaggcttgggattttattactagtataatgctagtgtccgcccattgcttaatctggaatgctaccagccagatctccatgctctcctgtgagccactcggcagagtgaggattactaggtagggtggcatgtcatgtgctccaccctccactggtacgagtcaatcaactaaagctacccccggattgatgaggaacatcccgcgcgattagtggggcatgtcatt

SEQ ID NO: 51174 - DNA, 359 bp, Zea mays
  unsure at all n locations
  Clone ID: LIB3067-022-Q1-K1-C1
ggcctaccacacctacgccatcctgtggaaccccgacgccatcaccttcttcgtggacgacgtgcccgtccgccgctacgagcgccgcaccgagctcaccttcccggaccgccccatgtgggtctacggctccatctgggacgcctncgactgggccaccgacgacggccgncaccgcgccgactaccgctaccagcccttcgtcgcgcgcctcgaccgcttcgtcgtcgccggctgctccgnncagcgccccgccgcgtgcaggcccgtgccggcgtcccccgcgggggccgggctcacgccgcggcagtacgcgggcatgcgctgggcgcagcanggccacatggtctactactact

SEQ ID NO: 51175 - DNA, 409 bp, Zea mays
  Clone ID: LIB3067-022-Q1-K1-C10
cggacgcgtgggtctcaccaaactttctaaagctcaccatttgccctgcctacttgggtcgtacgcaaccctcgccgagagcagcccccgtaaaatcttcctctgcatcctattcgctattgcgggtggcatcgccggtggcgttcgtgtgcttctcggtacggtgaaacctttattgccgttcctgccgcactttcctcatttcttgagactttggccgttggacggtggactctgcgggatccccaatctcctgctgagcttccgcacagagggcgggcatggctggaaggcataccatcattctcatgcaaccatcacagaacagatcgacgaggacatttatggactacgattcagttaaccactcgctggatggaatatgtggtctttacgaaaggaaaatcag

SEQ ID NO: 51176 - DNA, 415 bp, Zea mays
  Clone ID: LIB3067-022-Q1-K1-C11
cccacgcgtccgaccgacaggacgagactcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaggggctgcgacgcgtcagtgctgctcaacgcgacgggcggcagcgaggcggagaaggacgcggcgcccaacctgacgctgcgcggcttc

SEQ ID NO: 51177 - DNA, 145 bp, Zea mays
  Clone ID: LIB3067-022-Q1-K1-C2
cccacgcgtccgcccacgcgtccgcggacgcgtgggcaaatgaccatttgcatgtgtgtgatagtgtttcttctgtttgatactttgttgcctttttctgtctgaatgtatattttgaccattgattatgcaattattttatgtc

SEQ ID NO: 51178 - DNA, 412 bp, Zea mays
  unsure at all n locations
  Clone ID: LIB3067-022-Q1-K1-C3
gccggctcacttctccaggtaaggaaagtgttcgtcctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggccttatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtnctcaggaagatgagatcggctggtacgcacactgacaagaagaaataaagcatttcaagttcatgaatgtggcagccagagatta

SEQ ID NO: 51179 - DNA, 265 bp, Zea mays
  Clone ID: LIB3067-022-Q1-K1-C4
aaaaaaaaaaaacaaaaacaaaaaaaattaaaaaaaaaaaataaaaaaaaaaaaaaaaagagaaaagggcaaaaacgtgaggaaatcaaatcaaaataaacacatacctccgaaattggttcaccgttatcatgcacccaaattttaatccccttgctttccacttgatagacctcttcttgggaaacctaaattcattctccagttccaatagtttacaaaaatattcctctttaaaaccctggcctaatccactttaatcccc

SEQ ID NO: 51180 - DNA, 184 bp, Zea mays
  Clone ID: LIB3067-022-Q1-K1-C5
ggcctaccacacctacaccatcctgttgaacccctacgccatgaccttcttcatgggggacctgggcgttcgccggtacgagcgccggaccgagctcaccttaaccgaccgccccatgtgggtctacggctccatctgggacacctacgactggggcaccgactactgacgggcccgatccgac

SEQ ID NO: 51181 - DNA, 358 bp, Zea mays
  Clone ID: LIB3067-022-Q1-K1-C6
gaacaaggacaaggaaaaggtagccagtggcctgccagatcggaatttgctgtttacgcttttgacctggcgaaatcgaatcagaataaaagaaagctctgcacttcgttcatcgagagcatccatagcaagaggaagcggctgaggttggctcgggtgagcaacatggcggagaagctgacgccggagcaggtggacgagtgcaaggaaatcttcgacctgttcgacgccgacgaggacggtcgcatcgccacgggcgagctcgtgacggcgctgcgctccctgggccagaacgtggacgaggcggaagcgcggcgcttcctggaagacgcgggcatcgcggcgggcgccggcgaca

SEQ ID NO: 51182 - DNA, 250 bp, Zea mays
  Clone ID: LIB3067-022-Q1-K1-D1
cggacgcgtgggggcatccaggtaccatcgccctgatcgctgtcagggagggcgtcgtgcagctcggctccatgaaaaaggtaacggaggacctgagctacgtggtgatgctccgccgcaagttcgggtacctcgagagcatcccgggggtgctgctcccgcacccgtcgtcggcgggcgtgttcgcggccggtgggtgcgtggggcccccgccggacatcgccgcggcgtggtcgtcgggcctgatgcc

SEQ ID NO: 51183 - DNA, 355 bp, Zea mays
  Clone ID: LIB3067-022-Q1-K1-B11
cccacgcgtccgcccacgcgtccgcccacgcgtccgcccacgcgtccggaaggggatgcataccaagtttgaagagaccaatgcactgctacgagctgtcttgaaacttcagaaagattgaggtagggatgcataccaagtctgaggatgatgcctttgcttaaggtttttctaccttgctagaacatatctgtggttagaactttgtcagaactacgtgcaatctgtttgaatgcttcaaacctttgtggtggaacctttgtatgtttgaacctctgttgtggaagaactagtgtgctggaattgtgtatgacttgtgatgagaatgttgtgtatgatggcttttctgtgtatt

SEQ ID NO: 51184 - DNA, 345 bp, Zea mays
  Clone ID: LIB3067-006-Q1-K1-E4
gcgaatcgacgcgcctatctcagcttgctgcactgcactgcactgccctgccatcatatcgtacgtgagcccggccgagagcgagggagaggcatggctgctccgaagctcgcgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtc

SEQ ID NO: 51185 - DNA, 242 bp, Zea mays
  Clone ID: LIB3067-006-Q1-K1-E6
gcaccaagggcggttttccctagcattgttggccgtcctcgccacactggtgtcatggtagggatgggacagaaggacgcatatgttggcgatgaggcacagtctaagagaggtattcttactctcaagtacccgattgagcacggtattgtgagcaactggtatgtcatggagaaaatttggcatcatactttctacaacgagcttcgtgttgccccataggagcactctgtgttgcttac

SEQ ID NO: 51186 - DNA, 157 bp, Zea mays
  Clone ID: LIB3067-006-Q1-K1-E7
catacgcgtccgcccacgcgtccgcccactcgtccgcaacttcaagcaggctggcgagagatatcgttccttctaccctgcaaggcaagaccggttcatgcagcgatgggtagactcaatgactgaccctcgcatgacccatgaacaccgtaccatt

SEQ ID NO: 51187 - DNA, 348 bp, Zea mays
  unsure at all n locations
  Clone ID: LIB3067-006-Q1-K1-E8
gtcgcatatgacgggaaacttcaaacttctccatcagaaaaagggaatcagctagacgtagttgaagtggataattgttctcatccttctaagactgtgaagccacttgatggtcctcagtcagattctattacagagaataatcagccttctccataagctacccttaatatccagaacaaagtgcaaagtagttccaccagaagctgcaagaaggttcatcatatgttgcacctttttccttgctagtagtcattccttgatacataaatgctnactaggcccaaaccttcaattgaatacttctcaaagtatgctccatagagtttatgtactctggatcccttt

SEQ ID NO: 51188 - DNA, 285 bp, Zea mays
  Clone ID: LIB3067-006-Q1-K1-E9
gttgttcggagcgggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatcttgcaggaaaacttcaacacaactgttaaagcacttactgagcct

SEQ ID NO: 51189 - DNA, 388 bp, Zea mays
  Clone ID: LIB3067-006-Q1-K1-F1
cctttcttgatcccaaaactaccgccaagatacatgttcttgggaacaaataccaaagtaagctgcttgaaataattgacgccagtgaattgccggaattccttggtggcacttgtacctgtcctgaatacggaggctgccttaaggctgaaaagggaccatggaaggacccaaacatacttaagatagtccaaagtggtgaggttcattgtgctcgtcaaattgtaactatttccaatggtgaagaaaaatttattacttatgccaaaccgaagcaccattcaatgcgagggagtgacacatcaactgctgagtctggctcataagctgacgatgctatctcccccaaagctctcagaggttacatacaacatcctaagttgacccc

SEQ ID NO: 51190 - DNA, 427 bp, Zea mays
  unsure at all n locations
  Clone ID: LIB3067-006-Q1-K1-F10
gctccagcccatagtgaatctcccggagtcgcccaaacaacagcgacaaccatggccgccgccgcctgctattcgccagcgcgcatcatcatctcctgctcagctaccaccacctcctcaccgtcgtcagcgcgcacgctgcgcgtcgccgtagtggggggtggccccgcgggcgcgtcggctgccgaggcgctggcctcggcgggggcccggacgttcctcctcgagcgcagccccgcgggcgccaagccctgcggcggcgccatcccactctgtatgctggacgagttcgccatcccgcgggacctcgttgaccgccgcgtcacccggatgcgcgtgctctcccccttcaacctcgccgtcgacttctcccgcgcgctgccccccggggcgcacatncccatgctccggcgcgaggtgctcgatt

SEQ ID NO: 51191 - DNA, 450 bp, Zea mays
  Clone ID: LIB3067-006-Q1-K1-F12
ggtaattgctgtaacagttattgtcatgagtctcatgagtcatggaccatacacttccacttcagtagttcagttgcctgtgatggggaaatatcaagtactgattggaatagcatcgaaggggctaatcttgttcttgtatgtagcgcattgaaacaagtactaaaggaaaggtcgtgatttggtttgcgtaccttttattcacttccctatattatttttaaaagcacttcgtgattttcagatgaatagcaatgtctgcatattagtgcgttcattgatgaatttgtttctaggtttcctctcatacaatataatggtgtcaaagcctgtagtgcttgtcttcctgttggtggtactcataatcacatcccagtttgaatggaagcaacagcttgtaaacgagttggaatctacggctcgcaaccagaaacatgtttcaagtagaga

SEQ ID NO: 51192 - DNA, 385 bp, Zea mays
  Clone ID: LIB3067-006-Q1-K1-F2
cccacgcgtccgcccacgcgtccgggttgcgtcgactcgccgcctgcactgcgcagccaccacccatgactacaacgtgttcagcttccacccggacaactcgccgtgccacggcttcgaggaggtcctcgcctgctaccgcaagatcgtgccgcacctcaagctttccgggccgacgtcgttcgcgcccatcgtggaggcggccgtcgacatcgtggaccggagcggggggcagtaccacgtgctcgtcgtggtcgcggacgggcaggtgaccaggagcgtcgacaccggtgacggcgacctcagcccgcaggagaagagaacggtggactccattgtcatggcaagctcctacccgctgtccatcgttctggttggggtcggg

SEQ ID NO: 51193 - DNA, 348 bp, Zea mays
  Clone ID: LIB3067-006-Q1-K1-F3
cggactcgtgggttcaaaaggatatgaactcgtctccggtgggactgacaaccatttagttctggtgaatctcaagaataaggggatagatggttcaagggtggagaaggttttagaaagtgtgcatattgcatcatacaagaacacagtgcctggggatgttttatctattgtgccaggatgcatcatgatgggaaccccagctcctacgtcgagaggatttgttgaagaagatttcgctaaagttgctgacttcttcgatgcagcagtgaatctggccttgaagattaaggctgcaacgaccggtggaacaaagcttaaggtctttgttgccacttggcaatctga

SEQ ID NO: 51194 - DNA, 406 bp, Zea mays
  Clone ID: LIB3067-006-Q1-K1-F4
cccacgcgtccgccctcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatctgtgttggagagcgtggttgggaaggatttcctaccgaggggttcaggcattgtaacccgtcgtccgctggtgctgcagctccacagaattgatggtgacagggaatatgcagagttcatgcatcttccgagaaaaagatttacagattttgctg

SEQ ID NO: 51195 - DNA, 387 bp, Zea mays
  Clone ID: LIB3067-006-Q1-K1-F5
gcgagggaaaagttggcaccgtatgcaggcttgtcatctgaagaaagctaccagagtcgcgaccttgaaaaggcatctcagcaattttcaaagaacctgtacgagttcaaggttcatccaacaacattgatcccatagcaagttgggaatatgtatacagtatcacttctatgctgctcttgcatcggttatacataatagacatgaaactctggcaggccagaggattgttatgttttcgtatggcagtgggttgacatcaacaatgttctctttcaagattaaagaaggccatcaccctttcagcttgcttaacattgcatacatattggatgtttccaagaaatttaaggcaagacttgttgtgcatcccaagaaatttatcga

SEQ ID NO: 51196 - DNA, 386 bp, Zea mays
  Clone ID: LIB3067-006-Q1-K1-F6
cgagctggcaaaggctgttttggaaaagaagcaagttccagatattatagtaaacaatgctggtacaataaacaagaataacaagacatggaatgttccagtggaagattttgatatggtggttgatacaaatatcaaggggacagcaaatgtgcttcgtcattttgtaccacttatgatagcgaggagacatgggattataattaatttaacctctggttggggaagatccgctgctgcagaagtcataccgaaagccaccaaatgcattatagttgatcctttctgttgaatcaaaatccttattgcatactaaattgcacgttgccatttcaggttgctccatattgtgcttcaaagtgggcgattgaaggcttgacacgctc

SEQ ID NO: 51197 - DNA, 416 bp, Zea mays
  Clone ID: LIB3067-006-Q1-K1-F7
cccacgcgtccgcccacgcgttcgctcacttctgatgctcagaggctgttgagcatccaagcgagcattgaagagctgaagcagaaaatggaggggcagtcaaagggaaaatcccctatgaactctgagtacagcagtgtgagcgctcaggtgcatgagacagagggccatgtcttggaacagatcaatctgaacaacaaattgactaggacggctgagaactaccccacactgtcagataatatgagcaccgagcgagaagggtattccagcaggaggaagatcttcgagcaggtgcagaaagggtcggagaatgtggcaaggttggaactggagcttcagaagattcagtatgtcttgctgaagcttgatgaagagcacgagtacagaaggctcaaagtctctgataagcgcac

SEQ ID NO: 51198 - DNA, 347 bp, Zea mays
  Clone ID: LIB3067-006-Q1-K1-F8
ggcacggacacgacggtgatctcggtggagtgggcgatggcggagctgctgaggaaccccagagtgcaggagaagctgcaggaggagctggaccgtgtcgtcggtcgcgaccgggtcctgtcggagacggacttcccgaacctgccttacctgcatgccgtcgtcaaggagtccctgcgcctgcacccgccgacgccgctgatgctcccccacagggccagcgccagcgtcaagatcgccggctacgacatccccaagggcgccaacgtcgtcgtcaacgtgtgggcggtggcgcgcgaccccgaggtgtgggacagcccgctcgagttccggccgagcggtttctc

SEQ ID NO: 51199 - DNA, 326 bp, Zea mays
  Clone ID: LIB3067-006-Q1-K1-F9
cgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggacggcgagggcggcgccgtcgtcagctgggccatggagttcgacaaggccaacgaccaggtgcccgacccggacgtcatcaaggagaccgccaccaagacgtttcacgacctcgacgactaccttctcaagaactagattgagcgacaactggagatggtccagtacagtacag

SEQ ID NO: 51200 - DNA, 160 bp, Zea mays
  Clone ID: LIB3067-006-Q1-K1-G10
cccacgcgtccgctgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcgttttctgtt

SEQ ID NO: 51201 - DNA, 394 bp, Zea mays
  Clone ID: LIB3067-006-Q1-K1-E3
cgctctttcgcttcctccctcggcgtctcccacctcgaacttgagggcgtcatcaagagcctctcagctttccgcatcgtcgacagcacagacatcatcaaggagacatgggtgctcaccgaggaggccaagggctacgccgccaagggctcccccgaggcacagctcgtcgccgcaatttcaccggagggtgcctctaaggacgcactcaaggcaatattgggagatgctttcgatgttggcatgaaagcagccgcgaggaacaagtggataggtttcgagaaggggaataaggacttagtccttatgaaggttgagagcgtaaaggatgagctgcaagagcagcttataagactagagaatggtgaagttgtttctgataaagtgatcgatg

SEQ ID NO: 51202 - DNA, 421 bp, Zea mays
  Clone ID: LIB3067-006-Q1-K1-C1
gtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagctggtaggacatcaccgagctcattgccgcgggcagagagaagtttgcttcagtcccatgtggcggcggcggtgtggctgttgcggcaggtgcacctgctgctggcggagctgctcctgcagctgatgcaaagaaagaagagaaggtggaagagaaggaagaaagcgatgatgatatgggcttcagcctcttcgactaggttgcacagtcatcacagtattggttccggcagtgaaatcaaagggaaccagagtcatg

SEQ ID NO: 51203 - DNA, 141 bp, Zea mays
  Clone ID: LIB3067-006-Q1-K1-C10
gacgatcttatccattcggatgtgatactagggtctgaaaagattgaggctcctgtattgtttcgaggaattggacacatggctaatccatcaaacagtttggttctgaaggttctatcaacctctccatcagcttattca

SEQ ID NO: 51204 - DNA, 257 bp, Zea mays
  Clone ID: LIB3067-006-Q1-K1-C11
ggacattgttgcgctttctggtggtcacaccctgggaagatgccacaaggacaggtctggatttgagggagcctggacgtccaaccctttgatctttgacaactcttacttcaaggagcttctgagcggagagaaggaaggccttctgcagctaccaagtgacaaagccctcctctctgatccatccttccgcccacttgttgacaaatcccaattctgaaagcttcaggtgggcctcggctagttctagatcgcga

SEQ ID NO: 51205 - DNA, 408 bp, Zea mays
  Clone ID: LIB3067-006-Q1-K1-C3
tcgcccacgcgtccggggcgccatcccggcgctgcccacggtcgccaccgcccaggacctcatcgccaaggccaactagatggccgcacgcccgccgttccaccacgtcactgtccccctcgtcgtcgacgtcctcggtttcggttcattaggtagatcgagtcttagcgttcgtctttgcgcctctacgctgagacggtttgtttgggttaattaagttagctttcgtggagatttcgccccggggcatcaaataaaatgttggcatgcgtggtgggatgctatcctttatttttattttattgtattttttagcttggatcagtttgggttttgaacattgctagtgtcgtgtgattgggaagggctaagtgatgcctttcatgcagaagtttcaatgaatgcctt

SEQ ID NO: 51206 - DNA, 191 bp, Zea mays
  Clone ID: LIB3067-006-Q1-K1-C4
acaaaagatcatacttttgttgtttcgctagtgtgctgtggcccggtcattatgcataggtgttttacattgtcgtagtgtttgataaatgatggatggtgactgggtttgttgtgtcaactgtcataactattgtgcatttttggacgctatatgtgtagccttgatatgaatagatttactgtacttat

SEQ ID NO: 51207 - DNA, 418 bp, Zea mays
  Clone ID: LIB3067-006-Q1-K1-C5
cccacgcgtccgcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgacgacaggggcgcgggcgccctgtcgcagtcggagttggagtcggacccggagaaccagtgcgtgtacacggtgtacgtgcggacggggtccatctggaagggcggcacggactcgaccatcggcgtgacgctgctgggcgccgacggcacgggcatccggatccgggacctggcggggtggggcggcctcatgggcgccggtcacgactactacgagcgcggcaacctggacatctttcgcgggcggggcccctgca

SEQ ID NO: 51208 - DNA, 171 bp, Zea mays
  Clone ID: LIB3067-006-Q1-K1-C7
atttggatatttagactaacttcttggattataggcgattggatgttcactttgtacgatgtattagcgttgacattactggaagccctaattgtgagaagtagaaacatatcatgtgtgttgctacgggcattaaaaaaaaaaaaaaaataaaaaataaataattataat

SEQ ID NO: 51209 - DNA, 390 bp, Zea mays
  Clone ID: LIB3067-006-Q1-K1-C8
cccacgcgtccgatctgtatgagtcgggaaaagtgtgcctcagcctcctgaagacatggacaggcactggtaacgaagtgtggaatgctgagagctcaactgttcttcagctgctgttatcgcttcaggcccttgttctcaacgaaaaaccttactttaactaggcgggatacgacaaatttgtgggcaaggctgatggagagaagaactccatcacgtacaatgagaatgccttccttctgtcatgcaaatccatgatgtatgttttacgcaagccttcaaagcattttgagacgttggtcaaggagcatttcacctgcctggccccgcacattgtggatgcctgcgaggcttatcatgggggcgatctcgttcgacatgcgcacgaca

SEQ ID NO: 51210 - DNA, 307 bp, Zea mays
  unsure at all n locations
  Clone ID: LIB3067-006-Q1-K1-C9
cgatatcggctgtcacccttgtcctccctgtcgccaccaacatcttagtgccaacgtcttctgtgaaaggaggcagcttatcaattggaggttctcttcagcttcttggtttctgcacctttgaggcatgtgttggcatattctggccgtcaatcatgaagatgagatctcagtacattcctgaggaagcgagaagcacaatcatgaacttcttccgcataccactcaacttatttgtttgtgtggtgctttacaacgtgaatgcattccctatcactgtcatgnttgggatgtgttctatcttcct

SEQ ID NO: 51211 - DNA, 252 bp, Zea mays
  Clone ID: LIB3067-006-Q1-K1-D1
tcggtggaagtacgagtcaaccactgcaagcactctggtggcctaagcaaggagctcagcgtcgggcgcttgaagccgagggcattgttggaaatcatttttatgtaccgttttaagagtttggagtgaactagagatggtgaatgtccctcctctggaggatgccatggaccctatttgtttacatagaactgccctgctgttaaacttttgctacttggcgaccagattttttcagctattttttttctc

SEQ ID NO: 51212 - DNA, 142 bp, Zea mays
  Clone ID: LIB3067-006-Q1-K1-D12
gtgttatattacattcagttgtggaaaaattgagtactatttctagcttctaagaaatgaagcatcctattatcgcatctaatggcgcaaagataatcgacaaaaaaaaaaatattttttaataatatttaatttatttttt

SEQ ID NO: 51213 - DNA, 57 bp, Zea mays
  Clone ID: LIB3067-006-Q1-K1-D2
cccacgcgtccgttttttttttttttttttttttttgtttttttttttcttcttttt

SEQ ID NO: 51214 - DNA, 82 bp, Zea mays
  Clone ID: LIB3067-006-Q1-K1-D3
tcgcccacgcgtccgtccacgcgtccgatcagttggtagataagatggagcaaactttctcttgtatgtaatgttgtcaggc

SEQ ID NO: 51215 - DNA, 105 bp, Zea mays
  Clone ID: LIB3067-006-Q1-K1-D5
cctgtatcgacccaattttcagtgcatgactccaacttcatcaggagtccaagcccagatgggcctggtgctatgacaagaaaaggcgctaatactgttgataga

SEQ ID NO: 51216 - DNA, 212 bp, Zea mays
  Clone ID: LIB3067-006-Q1-K1-D6
atctcctgatcctcgttcctctccgccccgcttgcgccgcgcctccgcccccgtctcctgtgagatcagctccggcggcacgcggatatgactacttcaaggctgtttgctgtcatgattagtgcaaagtttcagaataacattacaaatagggtgtttgtagtagataccactgtgaaaaagagcaatgactaccctgttggacctatagt

SEQ ID NO: 51217 - DNA, 320 bp, Zea mays
  Clone ID: LIB3067-006-Q1-K1-D7
cggacgcgtgggtccggttcggaccggttttcacgccttcgaaggccgggcaggcaggcagcacccgcggagacgcggagcctccactcctgatcctgtcacccaccgtcttcgtcggtgctgttgcctcctatatcacccaccgcctctgaagaagaagacgcggattcgagggtaggtaactgctgaagaagaagatccggtacggagaagacgcggagcagtacttatccgatctggatgttggttaggttcatcctgatttgaacggtaatctcactgataacgagttcctgggatgaggaagcttgtcaattttt

SEQ ID NO: 51218 - DNA, 293 bp, Zea mays
  Clone ID: LIB3067-006-Q1-K1-D9
ctcaccgtggagataccagcaaggcattcttttattacaggtggccgctgacaggtttctcagagctactcatacagtaacgcaagtacgcaacaggagtttcttcctcgcagcttctcaccagaaaagcctacacggcacagcaacatctcgcgcggtcactggtactgactggcaagctggccttccttgacgatgtagttctgcacggggaagtcctcgcccttgaaatacctattcagcatgtccctcacaccatccgcataccgcagctgcgcatcaattgtagtccc

SEQ ID NO: 51219 - DNA, 403 bp, Zea mays
  Clone ID: LIB3067-006-Q1-K1-B8
cggacgcgtgggaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacatgcagtctggagaccccacggcgtctggtgattccgacaagtccaagtccgaggtgaacgactaggacgaggatggtgactagtgatgtatgacggatgaaactctgtccaagtgtttgcagtcagggaaaaaatctcgtcgttgtcggcctaaccgggttttctcgaaggactttctagatgcatgttattagtgccgtcttctgagtagtttccttgcaagtgtcgtcccgtc

SEQ ID NO: 51220 - DNA, 435 bp, Zea mays
  Clone ID: LIB3067-006-Q1-K1-E1
acacgcctcacccccaccacaagaacaccaaagccacatcccatccatctccacggtgaggcttgagcgatccgagcaaaaaaaatcatccgcgacgcagcgacgcaggtttgttctctgatctctctggttcttcttttagcagcagggacgcacaacacaagaaaaggtccggttcaagaggctcttctgttgggtttttttagaatcctcaagagaagcgtgttcttgggttaggatttttttctcacctcataacacctctcctaggaggaacagagatccagagaaccttttttctcttctggatccttgccgccttttggcgttcgaaagggggttgttttgcaataccctctctctggtttttttttctttcttggcacaaacccaactcgtttctctacttttattgaggaacagagctggtttttc

SEQ ID NO: 51221 - DNA, 340 bp, Zea mays
  Clone ID: LIB3067-006-Q1-K1-E10
gacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgttt

SEQ ID NO: 51222 - DNA, 468 bp, Zea mays
  Clone ID: LIB3067-006-Q1-K1-E12
aaaaaaaaaaaaaaaaaaaaaaaaaaaaataaaaaaaaaaaaataaaaataaaaaaaaaaggatataaaaaaaaaaaaaaaaaaaaataaataaaaatatataaaaaatagaaattattttatttaaattaaaatttatttatatgttttatgattaaatatattttatttttttaaatatattttattttttattaattggtttttctttttttaaaattttttaattattatttcattttttttatctattttatttttatttttttttttatttatttttttatttatgttttatatttaattattttctttttataaatttttttattaaatttttgcttattttttttttttttttttaatcattttttatttttttcttttttttttgattttttattttttttttttcttttttattttttatattttgtatattttttttttttgtttttttattttttt

SEQ ID NO: 51223 - DNA, 294 bp, Zea mays
  Clone ID: LIB3067-006-Q1-K1-E2
cattaggcgccacgtggacctggagacggtgaggtccaggctggacggagggtccggcagctacgcctcggggaccgagttctaccgcgacctgctgcttctgtgcgcgaacgcgctggtcttctacccgcgcgggtcgcccgagcgttccggcgcggcgcggacgcgcgcgctcgtcgccaagcacatgtccaaggatcagccggggccctcggggaaggctgtcgcggggcccgcggcgttcaataaggccaaggcggaagccgacgttgggtcgctgctggagaagactgc

SEQ ID NO: 51224 - DNA, 404 bp, Zea mays
  Clone ID: LIB3067-006-Q1-K1-A11
gcgggaggggagaggggcaagtgcgagtggtggtggtcgctgcgtcgtcggcggcggaggcacccagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacctcgcggtgcggctgctcgagcccatcaag

SEQ ID NO: 51225 - DNA, 452 bp, Zea mays
  Clone ID: LIB3067-006-Q1-K1-A12
agctccaaagagttgctatatgcctctgccttggaaagcctgcagatatctatctgattgatgaaccaagtgcttatcttgattcggagcagcgtattgtggcctcaaaggttatcaagagattcattcttcacgcgaagaaaactgcatttattgttgagcatgatttcatcatggcaacatacttggctgacaaggtcattgtttatgaggggcgaccttctattgattgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgaggaagcacagattcttcttggagagccatatggcgcatagtcttt

SEQ ID NO: 51226 - DNA, 410 bp, Zea mays
  Clone ID: LIB3067-006-Q1-K1-A2
tcggttctagatcgcgagtggccgctgccaccgtcttcgacgaagcggctgctgccggcttcgggcttggccacggcgcgcgtttcgcgcgcaagcatggacgtgctgccgctgagatgccccagtcggagccacaacctaaaactaagccggagccccatatgcagacactgacccagccagaacctaaaccgaaacctatgccacatccagagccaaagcctgaaccttaaccaaagcccaaccctgaacctcaaccaatgcccaagccttaaccaaaatccaaaccagagccattgcctacaccgaagcctgaacctaagcccgaacctaagccagagcctaagcccgaacctaaaattaaatcaaagcccaaacctggaccaaaaccagagcctatagcagagcat

SEQ ID NO: 51227 - DNA, 376 bp, Zea mays
  Clone ID: LIB3067-006-Q1-K1-A3
atttcagccattcaggagggccaccgtacgcagcgagaccagccagcaggcggcgatgttcgcgacggcggtgcggtgggcggcgaagaaggggaagcccaagatggcgccgatcgagctgacggcgccgccggagcaggcgcagtccatcacgcgcgccatcttcgacgccgtccgggagcacggtccgctcaccgtctccgacgtctgggaccacgtcaaggatgtcgggcttcgaggtctggcaagcaagaggcagatgaagatcatgctgcggtggatgaaggagcgccagaagctaaagctcatctgcgaccacgacggcccgcacaagcagttcctctacaccacctggtttaccaaccccaggaacgcg

SEQ ID NO: 51228 - DNA, 416 bp, Zea mays
  Clone ID: LIB3067-006-Q1-K1-A4
cccacgcgtccggctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggttatccggtcgattatggtttacatatacggacagctatcttcagatagtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgt

SEQ ID NO: 51229 - DNA, 191 bp, Zea mays; identical to SEQ ID NO: 51206
  Clone ID: LIB3067-006-Q1-K1-A6

SEQ ID NO: 51230 - DNA, 440 bp, Zea mays
  Clone ID: LIB3067-006-Q1-K1-A7
cccacgcgtccgcaaggctaagcgataccttgaggatgttattgctcacaagcaggcaattcccttccggagatactgtggaggtgttggtcgcaccgcacaagcaagtctcgccactccaatgggcacggtcgctggcctgttaagtcagccaggttcatattggatttgctgaagaatgctgagagtaacgctgatgtgaaaggcttggacgtggacaacctctatgtttcacacattcaggtgaaccaagcccagaagcagaggcgccgcacctaccgtgctcacggacgcattaacccttacatgtgcttcccttgccacattgagctgattctgtcagagaaggaagagcctgtgataaatgacgctgacaacattgtcgcggcaaggaagcagtgaagtatgttaacctgctgataatggcattctttcgaagc

SEQ ID NO: 51231 - DNA, 406 bp, Zea mays
  Clone ID: LIB3067-006-Q1-K1-A8
gcgcggacgcgtgggcggacgcgtgggttcagcttgtttcaggatctcctcttgaagcaagcgaagacagttttcaagaagaaaaactggatgtgcatcctcctgctgtattagaagaaatttatgctgcccatgatgagcagaagcaatgtgatgttttatcaccagtaagagtattctgatgaagggtggcaagcagctagtatgagaggaagatctgcaaatgtaaggaagaaaagcagtcgcaggaaaccggctcttatgaaattaatggttgatcattttgaagatggtcatacaggttctgtgtataggactggtttacaacctcagacaaaaggaggcaaagaagattctgtgagtgcttctagccagctttcatttggaagttttttgaaaacggatt

SEQ ID NO: 51232 - DNA, 224 bp, Zea mays
  Clone ID: LIB3067-006-Q1-K1-A9
acgcccacgcgtccgccaccctccagcgcctacaccctcctcgccgcctcactccctctgaggtcgcagatccgtccggttagacgaagccggccgcacccatggcctccggtgagctcgcctgcacctacgccgccctcatcctcagcgacgacggcatcgccatcaccgccgagaagatcgccaccatcgtgaaggcggtcaacatcaaagtcgagtcctac

SEQ ID NO: 51233 - DNA, 340 bp, Zea mays
  Clone ID: LIB3067-006-Q1-K1-B1
ggtggtttgaacctcaactgaatacagtatttgaccaaaagggtgttaattccctcatgacaacctagtctggtcgattccatgtgggataatggtttgtggttggtccagtaaattcgagatttcaagggcgatgggttagcattattcccaagctgtcatggatatcagtatcgcagggtctgtaacaggaccataatcgtcgaacatgagtctgggtttttgagcaggctactctctagggtttgcgtcatttagttgtgttttatatctggctactgtatagcctgagtctaattatctgcaaggccgtatggcattcctgagtggtttggttttg

SEQ ID NO: 51234 - DNA, 414 bp, Zea mays
  Clone ID: LIB3067-006-Q1-K1-B10
cccacgcgtccgcccacgcgtccgcccacgcgtccgcccaagcccctgcgaccccgagataccaaagccagcagaagaagggatgcagcagccgatgcacatgcagccgcaggcgccggcgatagccccagctgccggaatcaccacggagcagatccaaaagtatctggatgagaataagcagcttattttggctattttggaaaatcagaacctaagaaaattggcagaatgtgctcagtatcaatcacaacttcagaagaacctcttggaattcgctggaatcgcaaatgcccaacacgagactggtgtaagccggactcaaaatgcgccgccctggtggatctcctggagtagggcagtccatgtcacaggtgcctatgttcccaccgaggacacctttaacaccccagc

SEQ ID NO: 51235 - DNA, 450 bp, Zea mays
  Clone ID: LIB3067-006-Q1-K1-B12
attcgttgatattttgagtaccccctctgtttgttttgacaaggtacctgtacatttggagattccagttttgttttagcaataattataacacaatacatgacaataattttgtgtggttacaataatttactaatggtaaacatgagatattggcaagtttaataaagccttactgtttctttgttatggagtaatgttgtaatggtttttctgttttacaaattttagctattttgtacaaattttcacaaatactttaattattttgtaccaatgtaaaagcacctgaacatgtattggtcaagtcgactctattgaatagaattttgaaagaaagattcttgatcacccaagttaaaagagaaacttagccttgcctttcagattaaactagaggagacatgtatgaaaatggctggaaagactacaagatgcaattaatcattt

SEQ ID NO: 51236 - DNA, 411 bp, Zea mays
  Clone ID: LIB3067-006-Q1-K1-B2
gccacggattcattggcattcttactgaagtggcttgaacgctttcctcaatacaaggaacgcgaattttatttgacaggggagagttatgctggtcactatgttcctcaactggctcaagccataaaaaggcaccatgaggctactggtgacaaatcaattaatctaaagggctatatggtagggaatgctctcactgatgatttccatgaccactatggaatatttcaattcatgtggactactggcctgatctctgatcaaacatacaagctgctgaatgttttctgtgactacgagtccttcgtgcattcgtctgcacagtgtgataagattatggatattgctagcactgaatctggaaacattgattcatatagcatcttcacacctacatgtcatgcatctttt

SEQ ID NO: 51237 - DNA, 95 bp, Zea mays
  Clone ID: LIB3067-006-Q1-K1-B3
gcgcccacgcgttcgttcacgcgttcgcccacgcgttcgcccacgcgtccgctcacgcgttcgcggacgcgtgggaaaaaataaaaaaaaaataa

SEQ ID NO: 51238 - DNA, 306 bp, Zea mays
  Clone ID: LIB3067-006-Q1-K1-B6
agaaaagtgattgtgagacagcagaggtgtatttgaatggtctagggttgctgctgcgattattcatacgcggtcatatagattcagctaaagagaggttaacgacattgctagatgcacttaagaatgagtctacatggcatgtgtaatggctcctggtcttgtctatattgtgggcactatcaagtatgggtgagctaaaaagtgcacataatatgttggattcattgaattcaagggtacgtttaatggacaggaatctgttgcaagctttgcaaaaggcaatctagctggctgatgctgctt

SEQ ID NO: 51239 - DNA, 358 bp, Zea mays
  Clone ID: LIB3067-006-Q1-K1-B7
cccacgcgtccgcccacgcgtccgacattgtggtcattggccatgtcgactctggcaagtcgaccaccactggccacctgatctacaagcttggaggtattgacaagcgagtgattgagaggttctagaaagaggctgccgagatgaacaagcggtcattcaatgttgcgtgggtgcttgacaagctcaaggctgagcgtgagagatgtattacaattgatattgccctgtggaagttcgagaccaccaagtactactgcactgttattgatgccccgggacaccgtgacttcatcaaaaatatgatcactggcactttccaagctgactgtgctgttcttatcattgactcaaccac

SEQ ID NO: 51240 - DNA, 239 bp, Zea mays
  Clone ID: LIB3067-006-Q1-K1-A10
ctgacaacatgtacctgaggagcaagatcgccgagaataatgaaacggggcagccagcgatgaacatgattggagtgccgtcgacgagcgagtacgatcacatggccccttttgttgactcgagaaactttcttcaggtgaacatgcagcagcagcagccttagcactacttccatcaactgcaaccaacgacccttcaactcggatgatgtaatttagaatcttttgccaacaattca

SEQ ID NO: 51241 - DNA, 424 bp, Zea mays
  Clone ID: LIB3067-014-Q1-K1-A7
gacatgatagctgctagagctggactaaagaaggttccttgggatggctatctgaaacacaaccgtcctagtcccaaacacactgaagagaaacaacgcatatttgccgaatctgtcttgatgagactggaggagaaatgaagggacgtcaagccgtacaagtgcacttcgttagggttttacatgcagctaccttgtaattcggttggcttccagaaaaaaaaatgtgagcctggacacgtcaagtgaccacctcagttttgttgtaaatttgttactagtttgataggattattagtatgtacttatcatgaaaagaattctcagtatgtgttttggctgcccattcaatgataggtcagtgattaacaccataataattattattttgttgtttttattcttattttattttttttttatt

SEQ ID NO: 51242 - DNA, 226 bp, Zea mays
  Clone ID: LIB3067-014-Q1-K1-A8
gcgcaaagcaaatgaatcagcaggaagatcaagacaatcaatgagtccatagaacagttatgagggtcaagaaggtccaagcgatgtcgtcaaggatcagtctgaatgtggggtacatctgtttcagttgatattcgatacaagtttcttcctcttgagaacttatttgagtctgtgccttgtagttggctatggattcttgccttacttaatcactgtggattat

SEQ ID NO: 51243 - DNA, 172 bp, Zea mays
  Clone ID: LIB3067-014-Q1-K1-A9
acggaagcatcatcattagctgcaacatctgaagatgatgaactaataatttgggagctttaaatgcaaagagatacacaagacgaggctgactccagagctaagatgaacgagcatgcaaatacacctgaataattctcagcaaaaattgtatctgcatatacacggccag

SEQ ID NO: 51244 - DNA, 324 bp, Zea mays
  Clone ID: LIB3067-014-Q1-K1-B1
cggacgcgtgggctgtctgaacgcagcgcatctgcggcggcgatagggagagaggagagagtctgcacgatccagcatgccgagggaggagtcagcggcgggccggagaatattagcggcaactgcgcgaagaaagtggtcgatgcggctgtgaaagccggcaggaccatcatcgactgggacagcatggccaagttgctcgttaccgactaggctcgcaaggagttcgccgtccttcgacgcgctttctatgacgtcaaccaccatcttcagaccaagttctttcatgaaccccagccgattgaatgggagttctacataaat

SEQ ID NO: 51245 - DNA, 359 bp, Zea mays
  Clone ID: LIB3067-014-Q1-K1-B10
cagtactgttagagcatgatgctgtactggaatgtgctgtccttggcttgcctgatgaagcctatggggaggttatatgtgcaataattgtgcctaaggaggatgcaaagaaaaaggctggacaggactcaaagccagcgctaaccttggaagcattaacaagttggtcgaaagataagcttgctccatacaagattccaacaagactatacttgtgggattctcttcctcggaatgccatgggaaaggttaacaagaaggagctgtagaaattgttaggagcttagccatgtgtatagatgtatgtatctcttcaatttcttcttaaagtttaacaagtcgttctcattaaattgatt

SEQ ID NO: 51246 - DNA, 379 bp, Zea mays
  Clone ID: LIB3067-014-Q1-K1-B11
aggacatcgtcgttttgagaacttcagaaagactgttaatccagacaggatgaattttgtgaacctgatagatgaattcgatggaggaagagtgccttgggatatattcagctcagaagtgaaaagattacacaaagatagaataggtgctccatattttagggagcctggcgaattcccaaagctagaagagtctttctttgcaaatcccttgcctggctgtatatgtgagcaacatagtgaagaatgaagatgcatgtgtgctgatggttcttaacccacgcctttgaagtcagaaaatatatgccttttactgtctgccagatgttacttacaccgttgtcgagccacggtcagtgaatttgtccaatgaattcac

SEQ ID NO: 51247 - DNA, 303 bp, Zea mays
  Clone ID: LIB3067-014-Q1-K1-B2
gaacaatgcaaatgaatcagcggaagatcatgacaatcagtgagtcctagaacagttatgagggtcaagaaggtccagcgtcgtcgtcaaggttcagtctgaatgtggggtacatctgtgtcagtagtcgccgttacaagtttctttcccttgagaacttagttgagtcggggccttggagttggcaatggagtcttgccttccttaatcactgcggataatggtcaagaacattaatttgttatgtgtgttgtcaagaacattcattttgctctttctggctgaacttggttacttgtcttt

SEQ ID NO: 51248 - DNA, 211 bp, Zea mays
  Clone ID: LIB3067-014-Q1-K1-B3
ccatcacagctagctagcgttcctaatcaccgacgaataatctcttcttcacctcactaacaccgagctagcagctcgctctgtcctgcaacaatggccgctcgctcctcctcccagcagctggtcgcggctgcggtcctggcagcggcgctgctgctgctggctgctggggccgggacggcttctgctgctgtgagctgctgcgaggtga

SEQ ID NO: 51249 - DNA, 114 bp, Zea mays
  Clone ID: LIB3067-014-Q1-K1-B4
cagtttttcatcaccaccttgacaacaagctttttggacgggaagcatgttgtgtttggcaaggggttgtctggaatggatgttgtgtacaaggtggatgctgatggcctttat

SEQ ID NO: 51250 - DNA, 460 bp, Zea mays
  Clone ID: LIB3067-014-Q1-K1-B6
cccacgcgtccggtttggtcaattaaaacatatttttgtagacaaaagtactgccggttttgtgtacctgcggtttgatagtataacagccgctatgagcgcacagaaagcactccatggaagatggttcgcagggaagatgatcacagcaacttttatgaccccacaacagtatgaaatcaagttcccgagctagtgaacagatgcatgattaatatggacgtagttgcttgggctcggtgggtgctggcatttctatattttagcgttttgagcttgtgtcaacttattactggaggttattataaaaaaaaactagtggaggaaaatttagtggaagctagtgtatcgggtaatggcttacgataaatggtgtaaggaatgagtttctagtcctgtgggttagtgcttgaattgaaactgtactgtgtattggaatttttacctgtagtgctttttc

SEQ ID NO: 51251 - DNA, 288 bp, Zea mays
  Clone ID: LIB3067-014-Q1-K1-B9
cccacgcgtccggatgccaacaaattcattggttgctagctgaaaaacaacacccacacatgcatatatacatgtaactggcacacatgagaaaattaaaggtagctagctagagagtcttgtgaaggttagccattccgttcctgtttgtgaaaagggtacaaaagctagctttcacttcacacatgagagaagaagctaaggagaagaggtacaggctgctgtgggtgggttcgatggtaggtgagacatcacaatgctatgttagatatggggtctattccatct

SEQ ID NO: 51252 - DNA, 262 bp, Zea mays
  Clone ID: LIB3067-014-Q1-K1-C10
ctttgcggcaaaccaagatggatttactgctgtcaccaagttccaggagtttttatgcatgcattggtgaaggcacccatgcttatcagagcccatctaaagatttggctgctataaatagccgcctaaattataatggtcggagagtaaacagtcgattaaactttgacatggtgagcgactcattggtagctggtagtctaggccagccaaatggttgttctacttccttggatcctgcatctgcatttagcctcctttt

SEQ ID NO: 51253 - DNA, 298 bp, Zea mays
  Clone ID: LIB3067-014-Q1-K1-C11
aaaaagaagaaaaaaaaaccagacctcaaacggccaaacctccttggacacgactcgccgcacccatccccatccgccgccgctgccatggccgacgagattgacacgaggccggcctccgcgggctcccgcggccgtcctgcgcacgctaccgaggacgacgacagagaggagggcgagatcgtcgcctacgccccctcgcctgcccttctcgtcgtgcacccgctcgagcactcgtggaccttctggttcgacaacccgcacggcaaaaacaagattgcctcctgggggagctcca

SEQ ID NO: 51254 - DNA, 292 bp, Zea mays
  Clone ID: LIB3067-014-Q1-K1-C12
ctgcttctctctcgactcacccgttccatttaggagctctacagcttcatccaggagcaggcgctgaaccaggagctcatcaagcagggctccttgcacgtgaaaatccccgagcaggaccctgaggacgcaaagatcgtggaggtcatcgaggccgagttccacaagcttggcgtgcataacgggtccgccaatggcattgaccaagcatagcacctttgtctaataaggccagcctgattcaaccgagacgttgcttgccacttttgatgcaactaattctactgtttat

SEQ ID NO: 51255 - DNA, 382 bp, Zea mays
  Clone ID: LIB3067-014-Q1-K1-C2
cgtcctcgtaaccctagacaacccataaggccataccctccaaccgctggatcgggtatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagtcgagagcgactgaagtgggcagaagcactgcaccggccaatacttcgactactggtcatgcgttgacaagtgtgttgcaccaaagctcttcgacaaactgaaatgataacggaacgcaactttgaaggcgcggctccttttaggaaagtcaatagcttcaataaac

SEQ ID NO: 51256 - DNA, 325 bp, Zea mays
  Clone ID: LIB3067-014-Q1-K1-C3
ctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcattccgcacgcctttgccagtctcgtctggctgtgcgagccgctgtccggcctacttgtccagcccctcgtttgtcatctttt

SEQ ID NO: 51257 - DNA, 54 bp, Zea mays
  Clone ID: LIB3067-014-Q1-K1-C6
ggagaaaacaaaaatataacataaaaagatataaagaaaaaaataaaaaataaa

SEQ ID NO: 51258 - DNA, 368 bp, Zea mays
  Clone ID: LIB3067-014-Q1-K1-C7
aaggactccaagtatcgcaagttctggaactggtaccaccactgggtcggcaggctcgccctcttctttgcagccatcaacattgtgctcgggatcaaggtcggcggagcaggcaactcttggaagatcggctacggtttcaacctggctgtccttctgatcaccatcgtcaccctggaagtcctgctctggacgaggtggaaaaacagcaccggttccacgggggcatattagctacttaccgatttttataggtgtttgtgatggtcagtgaatgaggttcgtatacttttgttcgaatatttttgcgtgtatgcagttgctgtaatgtccgcgtatgctgcgtgatgtgttttccttttggtgca

SEQ ID NO: 51259 - DNA, 279 bp, Zea mays
  Clone ID: LIB3067-014-Q1-K1-A6
gagcgaggccctctacaagtacgtgctggacacgtcggtgctgccgcacgagccgtagagcatgcgtgagctgcggctggtgaccgacaagcacgagtgggggttcatgcagtcgtcccttgacgaggcgtcgctgctgcggatgctgatcaagctgatcggctcgcggcggacgctggaggtgggcgtgatcacggtctactcgcttgctggcgacggctctggcgctgtccgcctactgcaaggtcatcgcattctacgtgtgcctcgagtactact

SEQ ID NO: 51260 - DNA, 327 bp, Zea mays
  Clone ID: LIB3067-014-Q1-K1-C8
gctgaaccttccattcaaacttgacaggagaaagacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctcccgaaccaagccctcttccactgctaccaccttccttcgttgtacccggattatttcgtgttaagatcacatgtgatcctaataattaaaacgtgagtctgtttatcataatattattttttatatattttttttt

SEQ ID NO: 51261 - DNA, 369 bp, Zea mays
  Clone ID: LIB3067-013-Q1-K1-H10
cggggatatggccagaaccgtggcttcagtggtgacaatggcaatgacttccagggaggttatggtggcggaggctatggggatggtgctgtaactggtggatctgaaggagaaagggagagagacactcgtcccccgtaccgtggcggatgcagacgtggtggttacaggaatgttgagtttgctgatgactctgagaggccaccacggagaaactatgagcgccacagcgggactggccatggctatgagatgaagcgtgatggcgcatggcgagggaactggggcactgccactgatgaacttattgcccaggatgcataggactcttcgaagatggaagatgctgctcctggtgctgagaaacaa

SEQ ID NO: 51262 - DNA, 457 bp, Zea mays
  Clone ID: LIB3067-013-Q1-K1-H11
actagttctagaccagctcagcgagcccgggtcgcccgagaacatcctctactaccacatgatccccgagtaccagaccgaggagtccatgtacaacgccgtgcgccgcttcggcaaggtgcgctacgacaccctgcgcctgccgcacaaggtcgtcgcgcgggaggccgacggctccgtcaagttcggccagggcgagggctccgcctacctcttcgacccggacatctacaccgacggcaggatctccgtgcagggcatcgacgccgtgctcttcgcgccggacgacgccaaggccacgcagaccgccgaccccaacaggaagcctcccgccatcgtcacccacaagaagaagatcaagctccggcgaggttagtacctacctaccttcagatctggacctttgctcctttgtgtcctactcgtaccattacagattgctcaaaagtatcccacc

SEQ ID NO: 51263 - DNA, 345 bp, Zea mays
  Clone ID: LIB3067-013-Q1-K1-H12
gcctcgcgtgcggtctaaacagtcgtgacaccattactgacactgcaactgtgtatactggtgagatactcatcaatatgctctttagatacacaaatgcttacgcaaatgctcaaccctactagcaacacttatgccacgaactacactactgactccagctctttaccgagtgctttaccagatgctgagccagcggttgatttgccgcttggacgggccaagtctcgtgcctagactgaatcattcattgtattgatccatgcgatgtaacctgcgggacaagctatcgaactggaggcctgagtgaacgcctgagctcgcgcttcaactcattctaaaaca

SEQ ID NO: 51264 - DNA, 305 bp, Zea mays
  Clone ID: LIB3067-013-Q1-K1-H2
gatggaaccatagtggaggtagctcgctcgttggatggcagcgtacgtggccatcagcagcatgcagtcgtcgtcgtagcagagatgtcctagctacgtgtgtgtcatgcatgagactggcacataataaagaagtagatcatgcacccactagtgatcacttggtctagtgtcccttcgttcaatgtcgtcgtcgtcgtcgggtaccttacgtgacatgctgtagcacgtacgcttgcagagcagcaccgtaatgtccttgggtatgctttgctggctctatgaatttgtctttgtgttgcttt

SEQ ID NO: 51265 - DNA, 434 bp, Zea mays
  Clone ID: LIB3067-013-Q1-K1-H5
ctcgtctgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatcttctctaaagccatgtccatcatgaacttcttcatcaacgacatctttgagaagctcgccgccgaggccggcaagctcgcgcggtacaacaagaagcccaccatcaccttccgtgagatccagacc

SEQ ID NO: 51266 - DNA, 441 bp, Zea mays
  Clone ID: LIB3067-013-Q1-K1-H6
gtgagcctgcaccaagtatcatatcttgtccttgatgaagccgaccgtatgcttgatatgggatttgagccacaaataaggaaaattgtgaaacaaataccaccgaaacggcaaactcttatgtatactgccacatggccaagagaggttagaaaaatagcgtctgatttactggctaacccagttcaagttaacattggaaacactgatcagctagttgcaaataagtcaattacacagcatgtggaagttatcccacatatggagaaatcaagacgacttgatcagatcttgcgctcacaagatcctggatcaaaaagcataatattttgctccactaagaagatgtgtgatcagttagctcgaaacctatcacggcagtatcgtgcttctgctattcaaggtgataaatcacaggctgagagggattctgtgttgaat

SEQ ID NO: 51267 - DNA, 332 bp, Zea mays
  Clone ID: LIB3067-013-Q1-K1-H7
actagttctagaccgctcgcagcaagatggaagaggctatgccccacagcagaattatgcacaaggtggtcaggatggtagaggttttggaaggaatgattacacagaccgttcaggctacaatggaccacctgattttcgaagtcaaactcagtaccaagggcatgtaaatccagctgggcaaggtcaaggttacaacaacccccaagagcgtatcaacttctcgcaagggcagggaggaggttttaggcctggtggtccttcagcacctgtgtcttatggccaaccatcagcacctggatcttatggtcaacctaatacacttggtaact

SEQ ID NO: 51268 - DNA, 393 bp, Zea mays
  Clone ID: LIB3067-013-Q1-K1-H8
cggacgcgtgggtccggagcaagcatccaagtcgactgtttccattcctgatgatgctacgacggtgaaagaagcgcccgctcaggcacggaagctaagtatcgattcgtcgctcacaagtgaagaaagggagctgaagcggaagcaagcccgcgtcagagccacgttcgtgcaggacctgctgctctctactctattcggcgactgatgacgaaccagagcgagcctggtattatcactggaaggtgcagagttgatgtgggcgtgatgtatctttctaagttattgtaagccggtctctgtcttcacaactgacgatctgtgtgtggtacgcaccacgcacgcaagtcgcggttgtgcgtgtacgtctgaactctggagcattggtttgtt

SEQ ID NO: 51269 - DNA, 333 bp, Zea mays
  Clone ID: LIB3067-013-Q1-K1-H9
ccacagagtcccaattcacactctacttaccagataattctgtcatttctaagattgctgtttggacaacggtggcaaatccaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcttgttttttggcgatcctcaagacaaaagttgggt

SEQ ID NO: 51270 - DNA, 309 bp, Zea mays
  Clone ID: LIB3067-014-Q1-K1-A1
tcgccacgcgttctgccacgcgttcgggcgagggggaggattgggtttaagagagctgtcgtggttgggttgggagcttctgcggtgatcgccttggctgggctggcgtggcgctttccatattcccagaagcgtatacagcaactcattgttgctccattacactatgttcaagagaaattgccaacaatagagtcaacagagacaaccaaggaggatgcaagtgacagggaatctgatgaaattgaagtttctagtgcaacacatgattagaaggctgaagcaataactgatgattcaaggcaaaac

SEQ ID NO: 51271 - DNA, 331 bp, Zea mays
  Clone ID: LIB3067-014-Q1-K1-A11
cccacgcgtccgcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacatggcttgggcacttcataagagcacaaccatgtaccaaccttctacctaaaggtgtcaatagttcaagatgttgatactatatacttatgcttgtctctgtatagtcta

SEQ ID NO: 51272 - DNA, 92 bp, Zea mays
  Clone ID: LIB3067-014-Q1-K1-A12
gcgccaacttgctgaacggtctgatcaacgcgaccctggggactccgtccaggaggccgtgctgcacgctgatccaggggctggcagacctt

SEQ ID NO: 51273 - DNA, 459 bp, Zea mays
  Clone ID: LIB3067-014-Q1-K1-A2
cccacgcgttcgaaacgagcgcaaagcaccgggttttcttttgcatttttcttggaatgcctgagcaaaggcagagctggcctggccagtggccaccattttattgttgaggcgtggagctttgtacatcacggttagtttggatgacactcatgttgtgcataactttgattgaataatactagtcttattatatactatatatatttttttaaattttttatttattttattgttgttttttatttttttttttttattgtttttttttttctcttttatttattatttttattgtttcttttttttttttatattttttttttattattttatattatttgttgttttttttaattgtatttatgttatttattcttctatttgttttatttatttattttttttttgttttaattttatttattgatctttttttttatttttttttttttaatt

SEQ ID NO: 51274 - DNA, 384 bp, Zea mays
  Clone ID: LIB3067-014-Q1-K1-A3
cccacgcgtccgggcgggcgggaggtgcagctgtacctggacaagtccaccggcacgggctttcagacgcggggctcctacctcttcggccacttcagcatgcacatgaagctcgtcggcggcgactccgcgggcaccgtcacggccttctacctgtcgtcgcagaactcggagcacgacgagatcgacttcgagttcctgggcaaccggacggggcagccctacattctgcagaccaacgtgttcaccggcggcaagggcgaccgcgagcagcggatctacctctggttcgatcccaccaaggagttccactcctacttcgtcctctggaacctttacatgatcgcgttcttcgtggacgacgtgccgatccgggtgttcaag

SEQ ID NO: 51275 - DNA, 473 bp, Zea mays
  Clone ID: LIB3067-014-Q1-K1-A4
cccacgcgtccgcccacgcgtccggaggcatactgttgctgccctgctggaataaatgtgctactttcccctgccttgttaagggaaagggttttgttcacgatgttaccttgtaaccttgtacttatgtttcatacttggaatgaatgttcatggaacaaaaatattcaaaataatatatttttaatattatatttaactattttaattatttattttaattttttttttttttcttttttttatttcttttttttatttttattcttttttttatttttttttatttgtttttcttaatatttatttatttttttttttttttattatatatttctaactctttttttttatttgttatttttattttatttttttttttattttatttttttttttattttcattctttttattttatttatttattattttttctcttatattagtttttttattatatattttatttc

SEQ ID NO: 51276 - DNA, 97 bp, Zea mays
  Clone ID: LIB3067-014-Q1-K1-A5
tcgtctgattgtcttttctaacagttgctctttttgaatggctaatggtactgcgccctgtagtggctctttaagcgcgtttggtgtggtggtttct

SEQ ID NO: 51277 - DNA, 417 bp, Zea mays
  Clone ID: LIB3067-013-Q1-K1-H1
cccacgcgtccgattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagctctagcaacagcatgagcaagctcctgaagagcagcaatctgcatgaaagtggctgagaatattgctcagaagctatcacccgattcatagttctcattt

SEQ ID NO: 51278 - DNA, 442 bp, Zea mays
  Clone ID: LIB3067-013-Q1-K1-F12
cggacgcgtggggcggaccttcagcttcttcaccgcggctccgcctcttctttcacggctccaccacgcactaaccctaaagcttccccgcgttgccggcgatgagcagccttcgagccatctcctccctcctccatatctactccacgtccgccgccgccagacgaggagccgggcggctgggcttcgcgccgtcgcccggcgggagattccgggtaccgtcgaattccggtccgcccgcgttcgtgttggacgaggtcgcgagggctgccggcggggttcggaggagggcgttcacgcgcgcggcgagttgggactcggagaaatcgccgtacgagacgcttgagctgggtagggatgcatacgaggagaccatatagactgcctacagaagattggccaagttctatcaccctgatgtttatgaaggttaggggaaccc

SEQ ID NO: 51279 - DNA, 295 bp, Zea mays
  Clone ID: LIB3067-013-Q1-K1-F2
cccacgcgtccgcccacgcgtccgggagtccttgcggagaagcagctctgattgcacattccgaagtttgccggcttgcatcagcagatcattgtagaattttacaccccagaacattgccgtatcatctgaaatgggacaaacaaattacatcaggaggtaggttgctttatttttgttcttttctataaggatggcaagtttacttacttatgccaccaccatatggagtaagtggtttgtagtagaagctgaacaactgagtgatattatcaaagtttggatgctgagctac

SEQ ID NO: 51280 - DNA, 317 bp, Zea mays
  Clone ID: LIB3067-013-Q1-K1-F3
gaccaaccatctgcggcggcgatggggatcggtgagcacttcgagggcgtgaagcagcactgggcgagcaacttcgccttcctcgactattacaagaaggtctacggccgcgccgagcccctccccaagtggtccgacgccgacgtcgacgagttcatcgcctccgacccggtctacgggccccagctcaaggccctgcgggagtcgaggaagttcgcgcttgtcggggccttcgccggcgccgtccacctcggcggcgtcgcgctcaagtactccaaggcgccgcacggcgtcttgctggcgaccgggttcggggc

SEQ ID NO: 51281 - DNA, 427 bp, Zea mays
  Clone ID: LIB3067-013-Q1-K1-F4
caaagagatggacgatggatacaagagcatgtgttgaacttccctccaaaactgttttggcatgttatattgatctttctgcagaggagcgtgaatactatgatcagatggaacaggaagggaggaacaaaatgcaggaattcggtgacagagattcgattctgagtaattactcaaccgtgctttatttcattctgaggctccgccagctctgtgatgatgttgctttgtgtcctttagacatgaaagcatggtttcctgcaagctctatcgaagatgtgtctaaacacccagagctgttgaagaaactggccttattggttgatgatggagatgactttgactgtcctatttgcctttcttcaccaactaaaactgtcataaccagctgcactcacatatactgtcaaacctgcatcctaaaaat

SEQ ID NO: 51282 - DNA, 316 bp, Zea mays
  Clone ID: LIB3067-013-Q1-K1-F5
ctcttcgccgtgcccggcgcgttcacgcccacctgcacccagaagcacctcccggggttcgtggccaaggccggggagctccgcgccaagggcgtcgacaccgtggcctgcgtctccgtcaacgacgccttcgtgatgcgcgcgtggaaggagagtctggggatcggggacgaggtgctgctcctgtcggacggcaacggctagctggcgcgcgccatgggcgttgagctcgacctcttcgacaagcccgtggggctcggcgttcggtcccgtcgctacgcgctgctcgcggaggactgcgtggtcaaggtgatca

SEQ ID NO: 51283 - DNA, 369 bp, Zea mays
  Clone ID: LIB3067-013-Q1-K1-F6
catggtcatacttagggattcttacggaattttgagcaagcgcgacaagattctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaatgaaaacgatgcgcttggattccgtgaaggaacgatttctttgtcagcacctcagaatttggccacttgatagaatctgatgcttgaagtttcctggttctgtgtacacaagtcgtcttaatgtcagtattgagccgtttgaaatattttta

SEQ ID NO: 51284 - DNA, 354 bp, Zea mays
  Clone ID: LIB3067-013-Q1-K1-F9
cccacgcgtccggcagactagcaaggccttcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaggaggtcatcttggattctggatttcatatcgttaaagaaaccgaggtccagcttgatgctgatagggcatttggtctttatgctgagcattcccagttaagcttattttgaca

SEQ ID NO: 51285 - DNA, 354 bp, Zea mays
  Clone ID: LIB3067-013-Q1-K1-G1
gccgtggactctcttccgtaagccctagcccctagccgccagtgtcgtgcattcgtgctgaggctctactgctgatccgtcttccaagctctggtttcatccctgagcactgatttaagatgtatctccagtactacatcaacgagaagggggacaaggtctacaccaccaagaaggagtcacctcttggggtgccaacgcagtctgctcacccagctcggttctcaccagatgacaagtactctcgccagcgatacctgttgaagaagagatttggacttctgccaacgcagaatccaggaccgaaatactgaagcttcaagtcaactgtccaaccctgcgaagttctttttt

SEQ ID NO: 51286 - DNA, 429 bp, Zea mays
  Clone ID: LIB3067-013-Q1-K1-G10
caccactgccacgcgcgcgccggatcgagggagggcacgcagacgcggaggagggaggatgagtctcttcgggcttggacggaaccagaagacattccgccccaagaagagcgctccatcaggcagcaagggagcacagctccgtaagcacatagatgccactctcggcagtggaaaccttagggaagctgtgaggttgcctcctggagaggatatcaatgaatggcttgctgtgaataccgtggatttctttaaccaagttaatatgctgtatggcacgctcacagaattctgcacacctgagagctgcccaacaatgacagctggcccaaagtatgaatacagatgggctgatggtgtgcagataaagaaacccatagaggtatcagcaccaaaatatatggagtatctgatggattggattgaaag

SEQ ID NO: 51287 - DNA, 438 bp, Zea mays
  Clone ID: LIB3067-013-Q1-K1-G11
gactagttctagatcggcgcgatgtatagcgccccgatcatgctccgcctcgcatggcactccgcggtcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctgggaggcaggacaagcctgagcctccaccggaaggccgccttcctgatgccacccaaggttctgatcaccttaggcaggttttctccacacagatgggtttgagcgaccaggacattgttgcgctttctggtggtcacaccctgtgaagatgc

SEQ ID NO: 51288 - DNA, 329 bp, Zea mays
  Clone ID: LIB3067-013-Q1-K1-G12
cggacgcgtgggcggacgcgtgggcggacgcgtgggcggacgcgtggggcttcagaaggacgggtccctcggcgccgagacacggtaggcgggggccggccaccgcctaccgccacccgacggagaagtgatctgagtgttcgtcgagctgtagtcaggtgattcgattccacgcacgttccattttacacggtgaatcttcagtcgagcttgtagtttcttgggtttgtgattgtaaagatggtggttgtgcttgtgcccgtacgtactgtagatgcagcaacgtgtacctacacaatttacatttacagagaaaatgcatgctggag

SEQ ID NO: 51289 - DNA, 324 bp, Zea mays
  Clone ID: LIB3067-013-Q1-K1-G2
cttctaccaccaacagttgctgctgttggatcagttcctggggcacctgtgcttcctgttacgactcagaatgtgaccatgtctacacctacagaattcttgttgcttaaaaacatgtttgacccatcattggagacagatcctgattttgactcggatattcgagatgatgtccaagatgagtgttccaagtttggtgcagtgaagcatatttttgttgacaaaaatactgcacgctttgtgtatctgcagttcgatagcgtgactgcagcatcaaatgcccaaaatgccctttacggaagatggttcgctgggaagattatt

SEQ ID NO: 51290 - DNA, 168 bp, Zea mays
  Clone ID: LIB3067-013-Q1-K1-G3
cactttacgtaaacgaaatagcatgttaaacatcagaccaactgaactgtttttgattttccgtatcaaaagtatcgaggtacaaaaaggaactagtctacttttgtgcagcaccatctgttagcttccgagagataagctgcgcattttcgatctatttataggcat

SEQ ID NO: 51291 - DNA, 244 bp, Zea mays
  Clone ID: LIB3067-013-Q1-K1-G5
accactcgtacgttgacgcgtcccataatgaattaaggcgtggtatcgacgagtacgctgttatacacttccagtattacagtcaggggttcatctgtaagcgcatcagatgaaccttgccaaaagcctgctgtctactggttgggatgtctttagaatccgctcctttagttattgaaacagttatgacggcatgttcttatggtcagctatacagctttgacttgattacaagcttaatgga

SEQ ID NO: 51292 - DNA, 454 bp, Zea mays
  unsure at all n locations
  Clone ID: LIB3067-013-Q1-K1-G7
gccatgctttgtctgataagacttgaaacagatccacaagacaggacccaactgcggctgacagttgcctcgggcgatcaacatttgacattcgagttgaaagagttcgtcaaggaacatttgattgatatcccaaggactcaggctgccccacctatggcaatggtccagccacagttgcttactgcagcacctgccacatacaatgaccctggtgccatgcttgctggattgctatgagaagtaaaaaaacaaaagccatagtgttttgatgtacatgacagatgttgatctaacatctccaaaagcatcttgctgccaagacgaacacgtggagcaacgaaagggctggcggagtagtcttcagctggattctaaaccgagaaaaagctagattcntttgggcggtttgaaggccttcttccccttcatggagcagtccccatattgtgta

SEQ ID NO: 51293 - DNA, 245 bp, Zea mays
  Clone ID: LIB3067-013-Q1-K1-G8
atcatgagttgagagatcaggctctgatcatcatcacagaagctgataaagctgcggcagagactggttttgcactgagaacattagccattccagtggaatgagtgcaacaaggaacatttaattgatattccaaggactcaagttgtgtcacctatggtaatggtccagacatatatgattactgtctttaccttgtatcatacaattaccttgttttatattctttctcttatctgtattaa

SEQ ID NO: 51294 - DNA, 260 bp, Zea mays
  Clone ID: LIB3067-013-Q1-K1-G9
caaggacaaaggaagagctttttgcctatgatataaactgggcgatatatgacaagcatgagttgcaagagagaatgaggccttggatttcaaaaaagataattgaatttcttggcgaggaggaatcaactttggtggactatattgttttctgcaccaaagaccatgttcaggctgaaaagatgctagatcttctacagtcgattttcgatgttgtggccgatatgtttgttcttcatatgtggaggattcttatattt

SEQ ID NO: 51295 - DNA, 452 bp, Zea mays
  Clone ID: LIB3067-013-Q1-K1-E9
cccacgcgtccgacatgaccagggccctgcagctgcccgccgcgtgcaaggtcaagacgccgcccgtcagcaagtgccacgtttctgttcctggtgtgcccagcgcgtctcctgttccggctccctcgtccggggccccagacttcgggcagtcgccgacgccgtcgccgtcaaccccttcgggatcaccggcagcaacccggagccagaccagcggcgctccagcgccctccctagcgcgttccgtcgctgccggcctctcggcaccaccactggccttcacctttctcgctgtcgtgactcttttggttgtccggatcttgtgagctgtgctcatttattctatttcatgcgcttcgtccgtaccatcttacccctagtctgtcctcttatcattgtctttgttttgtttcttgtgagctttttcgtttcgtttttttacctctgttttt

SEQ ID NO: 51296 - DNA, 224 bp, Zea mays
  Clone ID: LIB3067-043-Q1-K1-E7
cggacgcgttgggcttgagggtttagttttctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaataacttcagttattccgcagcgtgatgggattcaagataactacaatgatcaa

SEQ ID NO: 51297 - DNA, 224 bp, Zea mays
  unsure at all n locations
  Clone ID: LIB3067-043-Q1-K1-E8
aaaagaggaaagggggatagcttaanctttccatccaccgnctctcagttgagactctagcgctttttcattccacagttatatctgtaggacggatgttcaaactctgctagattcagtctttctagctgagaactgagctgtagctgaaggttcagtcattcttcacgctcgagctactacatcttcttgctgctgagtgccgggagctgagatcgatcgag

SEQ ID NO: 51298 - DNA, 243 bp, Zea mays
  Clone ID: LIB3067-043-Q1-K1-F1
ccgacccactcgtccggcgtttaattaacctttatacatgtagtttatattctccataacagtgtctgtttcagtgcagtttcctttactttcaaaaagtgcctttcttgaacggtcaattgaagaaaattctgaccaagaataatgcatcatcaaactaaatgacattcctggggtgccaagtcatttgagctagttgcaaggttctgctatgggtgtgaaaatagagcatcaaaagctact

SEQ ID NO: 51299 - DNA, 375 bp, Zea mays
  Clone ID: LIB3067-043-Q1-K1-F10
gcggagagaaggaaggtcttctgcatgatcaagtgacaaagccctcctctctgatccagtccttccgcccacttgttgacaaatacgcagcggacgaggatgctttctttgctgactacgccgaggcccacctgaagctttcagaattgggatttgctgaggcgtaaagtgagagagaacgaaccagaagagtgtggtggttgtcgtcggccggcaggccttgtgtttttgttgtctgcttttctcttgaatgaagatgtgatgaactctgctgaagatgtattgtgtttgttgtcatggttcatttttctattttatttatctataatatctgtcggagaagctttgatatgaatcgggatctgtttcggaaca

SEQ ID NO: 51300 - DNA, 387 bp, Zea mays
  unsure at all n locations
  Clone ID: LIB3067-043-Q1-K1-F11
cccacgcgtccgcccattcgtccgcggactcttgggctgctctgatttttgtttatctggtctgattgccaactgtccaggctagcctgaagtgtggtaactctatttgtaatgaaccctaggttttctttgagccttctgaggtgacctatcagaccttcaacgactgntatgtctccggttgcgatccagttcttgcatgcacatttttttcacaccggggaatacttgttcaccgtgagaaactacctacacgaacaaaattgtagcgtctagtctgtgacttatgttccatatactaactggaattaagttggtttaagttaacagtatttgtagttcggtttatgttatcttatgtttgttgcaaaattttatgatctttat

SEQ ID NO: 51301 - DNA, 444 bp, Zea mays
  Clone ID: LIB3067-043-Q1-K1-F12
cggacgcgtgggtgattattgcgggttattgttctaccgtggtaattacctcaaattcgacaatgctataagagaggcctatccagacattcagatgatttcaaactgtgatggttcatctagaccacttgaccatcctgcggatttgtatgatttccatgtctatactgattctaagactttgtttaacatgaggagcacatttgacagaacatctcgtagtggacctaaggcttttgtgagcgagtacgctgtctggagaagtgacgcgggtagaggcagtcttcttgcttcgttggctgaagctgctttcctcactggtctggagaagaacagtgatattgttcagatggcaagttacgcaccacttttcgtgaacgacaatgaccaaacctgtgacctcgacgctattcgtttcaacttctggcatcactattgaacttc

SEQ ID NO: 51302 - DNA, 406 bp, Zea mays
  unsure at all n locations
  Clone ID: LIB3067-043-Q1-K1-F2
gggaacgggagcggtaggggaatccaattgcgatggcctccgactcgggcgatttcggtggggagaacaagtcgttggaaacggtgaggcggctgctggaggagaccttcacgagtgaggcagatgcggaggcgctaccgagcttgccctcggggttctacgacgccttcgtcctgaggggaatccgcgtcgtccaggccctccagcccggcacactcctctgccacttcaacgtgccctccagactactcaactcgggcggcttcctgcacggcggcgcaaccgccttcctcgtggatctggttgccttcgncgccttcgccactgccgggctacgcaccaggggctcaccccttgagatgaacatctcctaccttgatgctgcttttgctgatgaagagattga

SEQ ID NO: 51303 - DNA, 227 bp, Zea mays
  Clone ID: LIB3067-043-Q1-K1-F3
ggcagacgtgatcaattgaggctcgcattgcgcttggtgggcccactgcggcccgcaggggggccttgctggagcgcgctgttgtcagatgatatgcagggactcactgctgtgcagtaccgctagaatgcggctggtgctgaccgagtccaacatgagcacccgtacgaacgtcatgcttgctaggccggcttttgaggccctggccaagcccgggatggcccatg

SEQ ID NO: 51304 - DNA, 209 bp, Zea mays
  Clone ID: LIB3067-043-Q1-K1-F5
gcgcccacgcgttcgcggtcgcgtgttctctttcactcgggcatcatcgacatcgagttcaccagggtgccgtgcgagtgccctggcctcaagatcgggttccacgtggaggagtactcgagccccgtctacttcgcggtgctggtggagtacgaggacggcgactgcgacgtggtgcatgtggacctgatggagtccaagacggcgcg

SEQ ID NO: 51305 - DNA, 130 bp, Zea mays
  Clone ID: LIB3067-043-Q1-K1-F8
cgcacgcgtccgcggtacgcgttggaactaagatgagctcatatgtcaccttggagaaggatatgctatacctagaaagaagggacaggatagggatgaactaaaaaaaaaagaacaacaaagacaaaaa

SEQ ID NO: 51306 - DNA, 437 bp, Zea mays
  Clone ID: LIB3067-043-Q1-K1-F9
cccacgcgtccggaatttccaactgcgagttttcaggacaccacccagatccacacccacgtgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggccttaagacccgcaagtacacggaggtcaagcccgccctgaccaacatggtctccgtcgctaagctcatccgcacccagcttgccagcgccaagtgagcaccttttttttgcctttt

SEQ ID NO: 51307 - DNA, 325 bp, Zea mays
  Clone ID: LIB3067-043-Q1-K1-G1
ctagcaccccaccgtgtctagggtttcctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaagtccggatccccgctgatcccactctccgagttccgggagcccgaggtgatgcagggctacggcgtgcgccccgacgccgaggtgctcgacgcgatcgacacggcagcgcg

SEQ ID NO: 51308 - DNA, 380 bp, Zea mays
  Clone ID: LIB3067-043-Q1-K1-G10
cccacgcgtccgctcattcagaacattcttggtcgcttcaccactccactcgccggaggccgtctgtcgccgccgaggggatcggagcaagatgttcttccacatcgtgctggagcggaacatgcagctgcacccacgacactttgggccgcaccttcgcgacaagctcgtttccaagctcatcaaggacgtcgagggcacctgcagcgggcggcacgggttcgttgtggcgatcacgggtgtggaggacatcggcatggggctcatcctgtaaggcacgggatacgtcaccttccccgtcaagtaccattgcgttgtctttagaccctttaagggcgatatcctcgaagctgtcgtttccatggtgaacaagattggct

SEQ ID NO: 51309 - DNA, 398 bp, Zea mays
  Clone ID: LIB3067-043-Q1-K1-G11
ctgaggtagacgaaatttttgatgtactcttggagatgttcctcaaggatgagaacagggcatcgtatgagcgagaaaagatgggccagacattcacagttcattacttcacttatgagaacggaatccagaagtacttaatctggggtctgaccgcccgcatcttgatccatgctgcttcagttgtatacgagcgaccgccagactttacagagcgaagagcacatttcaaattgccaaagttcacaaaggactgctcttcaatgcgcaggacctgctaaacattagtgcacactgcctacgctgctatctcagctacatgctatttggattacatgatgttgcaccaacagagtttattgaatctaataggcgtccaaatcacttgatgtcatatg

SEQ ID NO: 51310 - DNA, 412 bp, Zea mays
  Clone ID: LIB3067-043-Q1-K1-G12
cttcgtcactttaccgtcttcacttatcttatctagtaacgctgacattgtggtcccggggtggtgccttggctgacctgaccagcaagcaaataggcccagccaactccgatcccaccggcaccagccgcccgcaacccgcaaagctgcttcccggactagctagggtttcgtctacgccgcttgatctagtcctctctcccggcacgcgagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaaaccgttcagcagtgggaggatgattgggatgacgatgacgtgaacgatgatttctctttgcagc

SEQ ID NO: 51311 - DNA, 395 bp, Zea mays
  Clone ID: LIB3067-043-Q1-K1-G2
cccacgcgtccgcctacgcgtccggaatcagatgtaggctggccggcgatgtcgccggcactcggaaggccgtcatcgacatcgtcgagctctgctacaaggccggcgcgtggaagacgctaaacgaccagatcgttctcctctccaagaggagaggccagcttaagcaggccattactgctatggttcagaaagcaatggactacattgatttgacaccagacattgacacacgagtcgagctaatcaaaacactgagcagcgtctctgctggcaaaatttatgttgagatagagagagcaagattgatcaaaaggcttgcaaatatcaaagaggagcaaggaaagattgacgaggctgctgatttgatgcaagaagttgctgtcgaaacattt

SEQ ID NO: 51312 - DNA, 416 bp, Zea mays
  unsure at all n locations
  Clone ID: LIB3067-043-Q1-K1-E6
cccacgcgtccgagataccattctcgattgaaaacaatcctgaaaccaagccatgggtctgcaggagaaatttgaggagtatgctgttaaggcaaagaccttgcctgagaacacgatcaatgagaacaagctgatcctatacggtctctacaagcaagccacggttggagatgtgaataccgatcgtccgggcatattctaccaaaaggacagggccaagtgggatgcctggaaagctgttgaaggcaaatcgaaggatgangcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatct

SEQ ID NO: 51313 - DNA, 388 bp, Zea mays
  Clone ID: LIB3067-043-Q1-K1-G4
gatgaatttgctcattctggctgatcattccagttacgtacaataatacatgacctttcttgttgagtttgagccgtcaacatacatgacatggacgccaagctcttgcttcaggtcctgtctcccggatttctgccaagtttttgcttcagcccaagagcaggaaaccagataatgtagatgctaaaaaaaagctctttgggtattggaccagtgagtctattgcgtgaaaggttcaagttttgaagaggacagttgcttagactccaaggtattatctccactgaggccattggcatccagaacaaatctagaaagcactgttaaatttctaagagtttctgggattaaattgctgagagtttctggtatattcgggcttcttgag

SEQ ID NO: 51314 - DNA, 371 bp, Zea mays
  unsure at all n locations
  Clone ID: LIB3067-043-Q1-K1-G5
gacgcgccgccctactggatcttactncttcacgcacctgcccacggggcggttctccaacgggctcaacatccccgacatcatcagcgagcacctcggctcccagcccgcgctgccgtacctcagccccgacctccgcggcgaccagctgctcgtcggcgccaacttcgcgtccgccggcgtcggcatcctcaacgacaccggcatacagttcgtgaacatcatcaggatctggcagcagctgcacaacttccaggactaccagcagaggctggccgcgttcgtcggcgacgacgcggcgaggcatgtcgtgagcaatgcgctcgtcctcatcacgctcggcggcaacgacttcgtcaacaactactacc

SEQ ID NO: 51315 - DNA, 203 bp, Zea mays
  Clone ID: LIB3067-043-Q1-K1-G7
cccacgcgttcgagctcacgttgaaattttcgacctgcaaaggagcatataaggcataccagaatctgcagaaggtatacatgggagcgacagtaatatgctgtgctgccgctggtattcctccagatgttcagctcatgttatcgatcggtacggctgcttaagtcagtgccgctgtagcatacgcattccatgagctccag

SEQ ID NO: 51316 - DNA, 206 bp, Zea mays
  unsure at all n locations
  Clone ID: LIB3067-043-Q1-K1-C8
agaagtcctagtgttactagctttcctttcgctgcatctcagagttcccaccttgggttggtagataataagaatgttattgatacacaaaggctagaagaagaaaagaaaaggctttaccgaagggagctactgctattgttctacttgttatatttgatgatgcaattggttatcatttatctactcttgatcagttnttataa

SEQ ID NO: 51317 - DNA, 443 bp, Zea mays
  Clone ID: LIB3067-043-Q1-K1-C9
cccacgcgtccgagcatttattgaggatattcacaagatcaaaatatcggaacttggcggaagtcatcctcaatcagcagaggggacaggagatcaaaatgataagttaaaaagtttggaagtacaggcttcacaggaagacagtatagaagaccaaccctacaagctttgtgctgtatgtcacagcctgggtggtgcagttatgctgatgtatgtggttacttcaaggatcacacaaaagccccacagattgtctagactggtcctgctatctcctgcaggttttcatgaggattccaatgtggtattcagtatggtagagaagctcatcttgtttgttggtccagtgcttgcaccacttattcctggactttacataccaactcggttctttaggatgcttctgaacaaattagcaagggatttccacaattattcagctt

SEQ ID NO: 51318 - DNA, 327 bp, Zea mays
  Clone ID: LIB3067-043-Q1-K1-D1
caattcatcacggcatcacccccaattttttctactccaccgaaacataaatccgtagcctggtcttctgcttcgcagaaagatcttgcggaaggtggcagacgcatagatgagggtgagagcatttggcggtagcgcttgacgagcgacgagtaaaccctaatgctttgatcgcggcggcgtcgtttgagacactcccgaatcgatccgcctacatgcctatgaatcctacttcctcgtcgactcctgagtcggcgtcttcgacgcctgctgtggccagctactttcctctacctttccacctgcagcagcaccagccgcagccgc

SEQ ID NO: 51319 - DNA, 442 bp, Zea mays
  Clone ID: LIB3067-043-Q1-K1-D10
ggaaaggagaagagagggtcggaatatattcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtcgacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgtcgctggcactacgactgcttctgcctcggcgtacgtctaattcaggagatgtgatgtgtagcaaatagcgcgcgc

SEQ ID NO: 51320 - DNA, 386 bp, Zea mays
  Clone ID: LIB3067-043-Q1-K1-D11
acccactcgtccgcccacgcgttcgcggtttcgtgggcttctcttggcccagaatgggggaatggctcgggggcctgttgacaatcctgctgagagtgaaatgtgcaagtttcaagtacttctaacttctaattacctgcattacaaatatcattttttcccaaatataacatagcatcaggtttttctctgttcatacttttttagtaacttaattcctttgagttatgtagtattaaaattatgattggctatcttttgatgcaatgaagttaatatctgtaactttttactatggaatctttctgactttaagttactaatatttgttttgagttctccatattgctctgatattattgatgtttgcaaccaaacttaagcta

SEQ ID NO: 51321 - DNA, 443 bp, Zea mays
  Clone ID: LIB3067-043-Q1-K1-D12
cccacgcgtccgcactttgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatattaaaccttctcgcaatgcatgaatttcctaactgaagaaggaaggaaaaagagagag

SEQ ID NO: 51322 - DNA, 381 bp, Zea mays
  Clone ID: LIB3067-043-Q1-K1-D3
agctcttgcactagctagagaccgaactgagagttattggagaaccatgatgaggtctggccttatctcgctatgtttccacctagccctggccatcacactggctgcaagtgttcctggccttgctcgtagtagggtaatcgacatggaaccgcaactcaaaccgacgctgcaactagaaccaaagcatggtgtatctcaaccagacagaaaccaagaacccaaaccgacaccacaatctgagccaaaaccagagcctaaaccggaacctgaacctgcaccacaaccagaccccaaacccgcaccacagccggacccaaaacccgcaccacaacccgaccccaaaccagaacccaaacctacaccacagcccgacccaaa

SEQ ID NO: 51323 - DNA, 53 bp, Zea mays
  Clone ID: LIB3067-043-Q1-K1-D4
cggacgcgtgggcggacgcgtgggcggtcgcgtgggcggacgcgtgggaaaaa

SEQ ID NO: 51324 - DNA, 362 bp, Zea mays
  unsure at all n locations
  Clone ID: LIB3067-043-Q1-K1-D6
cggacgcgtgggcggacgcgttggcggtcgcgtgggcggacgcgtgggctcccggagaaccagaatgctactctcacccttcaaggctgtggcggggccatggacgaccttgtcgagcgctttaaggacgggctccacatgtgcatgaccgaggtctatgacaagaagccggagttgttcgagcctctcatggcctgtcaggctcccaagtacatggtgttcgcctgctcagactgccgcgtgagccctgcggtgacactgagacggcagcccggcgaggtattcaccgtccgcaacatcttcgccatggncccagcctacgacaagaccaagtacactcgcatcgggtccgtcatcgagta

SEQ ID NO: 51325 - DNA, 336 bp, Zea mays
  unsure at all n locations
  Clone ID: LIB3067-043-Q1-K1-D7
cccacgcgttcgccctcgcgttttcccacgcgtccgactagttctagatcttgcgacagtactcactgacgctgaggtccccctggacggctacggtggtggccgtggaggcggcggctacggcggtggcgggcgccgatcggtttcggagaagagaagcaaatcaagatgtttctcggctcgctcccgcggcgcccgagcaaggaggctgcttacaagcagctgcngtcggacatcatcatcatggcctgctgcgccgtcgtgaatgcggccaccccttacattctgcaattcgctcgcccgcgacggcgacattcaggaactcaagctagatct

SEQ ID NO: 51326 - DNA, 62 bp, Zea mays
  Clone ID: LIB3067-043-Q1-K1-D8
gacccacgcggccgccagccgccgtcggatcggattcgaactatagcaagcagctgcagccg

SEQ ID NO: 51327 - DNA, 372 bp, Zea mays
  Clone ID: LIB3067-043-Q1-K1-E1
ctcgtagagagaaggaaaaatatccccttaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgggttatccccgagttcatgtgccagggcggcgacttcacccgcggcaacggcaccggcggcgagtccatctacggcgagaagtttcccgacgagaaattcgtgcgcaagcacaccgtccccggtgtgctcttcatgggc

SEQ ID NO: 51328 - DNA, 238 bp, Zea mays
  Clone ID: LIB3067-043-Q1-K1-E10
cccggccgacccactcgtccggcggacgtcagcacgttcctcctcagcctcggcgtgctgtgccagtcgctgccgcgcgtgctgcgctacgcggtgggcgccggcgagcactccgtcgccgcggccaccacggtgctcgacctctcccgcgcctgcagcgtcgtcatgctgctcgcctacgtcgcctacctcttctatcagctcaagacgcacgcgcagctgttcgagccgcatgagg

SEQ ID NO: 51329 - DNA, 426 bp, Zea mays
  Clone ID: LIB3067-043-Q1-K1-E12
cggacgcgtgggcggactcgtgggcttgatgcgtgggaccgtgacttcatcaagaacatgatcaccggcacctcccaggctgattgtgcggtgctcatcattgactccaccactggtggctttgaggctggtatctccaaggacggccagacccgtgagcatgcgctccttgctttcactcttggtgtgaggcagatgatctgctgctgcaacaagatggatgccactacccccaagtactccaaggctcggtacgacgagatcgtcaaggaagtgggttcctacctgaagaaggtggggtacaacccggacaagatccccttcgtgcccatctctgggttcgagggtgacaacatgatcgagaggtcgacgaacctggactggtacaagggccccacccttcttgaggcgctggaccagatcaac

SEQ ID NO: 51330 - DNA, 380 bp, Zea mays
  unsure at all n locations
  Clone ID: LIB3067-043-Q1-K1-E2
cggggtcaaaagcagtatctataccatgttacgatctacatgcgccttagcccaacagatgagattggtgaaaaccatgagctcagtgggcatatgacagtgcagcttggtctgctactgcttgctctggactctgngcctcggatgttgattccaaaacctgttctactgaagaagctacatcagcaaaggcatcaaggtcaccagtacgcaatgcttcacggcgtcgatgaatcagtgggagcagaacctggggaacatcatgagggagcacatgtccatgaggagtttgagttcagcgaagttcttgatcaccagctgattcacacgaacgaatttggtcttggtgcagtcccaaacacagctgtcgaccttcggcc

SEQ ID NO: 51331 - DNA, 203 bp, Zea mays
  Clone ID: LIB3067-043-Q1-K1-C5
ggaaaacagctttgtcgactttcattcattatatattacaggtacagcacatgatgtgtatattgtttcagtagcttgttggacgaattcctgttcctggtcatccggccgccgagaagccttctcgccatctagcattctcctggtcatgttggccctctgaacgagccgcaccagcgcttgcaccagctgcatgacattga

SEQ ID NO: 51332 - DNA, 287 bp, Zea mays
  Clone ID: LIB3067-043-Q1-K1-E3
cggacgcgtgggcgtgtacgcgtgggcagtagatgttatgtgtagcaaatagcgcgcgcgcaccagtcgtcaataaataaataaataaataaataaataaataaataaaggccaacgtacgacgacaaattagtggcgcgcgcggtagtagctagcagagtatgcgccgtcactgtgtcgatctgcagtttggtcgtttaaaagtgattgtagtgtgtactatgttcagctcgatgatataggagtcgctatatacgcttgctcccgtgctgaacaggttatcgatc

SEQ ID NO: 51333 - DNA, 393 bp, Zea mays
  unsure at all n locations
  Clone ID: LIB3067-043-Q1-K1-E4
cccacgcgtccgatgagtacatggagactatggcttctgttcataatgcttttactgatcgttccaatgctttgcttcgagtgctaaatctgtcagcagatctatattccttgcataccctggctggaaaacttgaatctgtatcagcgagaggaatggatcaggagagatcaaggtatcaaaagatagaagaattgaaagaaacagtaagagccacggaagatgcaaaaacacgtgcacttaaagaattggaacttatcaaggataataacatgaatgaaattaaaagatntaacaaggaaaggcgccaagatttggtggagatgctaaaagggcttgtattggatcaggccacatnactcggatcatttgctacaatatggacaaaagtag

SEQ ID NO: 51334 - DNA, 431 bp, Zea mays
  unsure at all n locations
  Clone ID: LIB3067-043-Q1-K1-E5
cgttcaccccaagcttccaacctgcgagtagcgacaagttcgtctctctcgtggccacgactggccgccgcccccgcctccgtcccctcgcagattcccaggtcttcgccgctcccttcgccgccaaagagcacccactaggttaaatccgccagggggaaatctccatcaagtggctcgtgctaattatgcgatcttcatgggctgactcagttgcgaacgccgaggaatcggcgcccgcgactgctgctgctaatggctctgntgcaactcatagcacctcgcgccctacgcgcagctcctacgtgccttcacatcttcggggccgctcagctggtgctgcttgtgaagctcaagcaggcttagtagcaccagcacaaggtggaccactggcattggcttctgcacaaacttctggtcagggtgctgct

SEQ ID NO: 51335 - DNA, 362 bp, Zea mays
  Clone ID: LIB3067-043-Q1-K1-A6
aagaaaaacaccagttagcatgtttccttgtaatttcattagcagaagttcctagcaaacaagcaagaaatgatcatgaggcagcagagaagcttaagtttgtcatttatcaaaggcccaaagcattccaaaatggaagcactgatttgggaaacaagaatggtgcaccaaaaactgttgaagagagaatagaggaatataataaagcacgagcacgcatcttcaatggttctgtttctgcagattctgatgctgcaagtgttctgggaactctttgcactggcagagatgagtcagtaaatgttgaaccttctgttgattaaatcaaagtcagcacgatgaacaaccgttccatagttgct

SEQ ID NO: 51336 - DNA, 406 bp, Zea mays
  Clone ID: LIB3067-043-Q1-K1-A7
catcctttcagggtttacattgtgttttatgggaaagtttactccagcagctataaatctgcagtttacaagggcgctcatcggctggggcttccagctcatggtcctgaaaggtctgctctactcgatgggtggtggcgaggtgccactgctcgacttggtagcgtacggtggttatttattcgccgggctatcgctcgccgtcgtcgcgaggctcatgtgggcgtactcgtactatgtgatgatgccgtggatgagcctgtgcatgggggtgttcctggtgaggacgatgaagagggtgctcttcacggagatgagaagcagcgagaggcactcgtcgcggcagcactacttccttctcttcatggcaatcgcacagttcccctgttcttctggctcggcagca

SEQ ID NO: 51337 - DNA, 432 bp, Zea mays
  Clone ID: LIB3067-043-Q1-K1-A9
ttatgccacgagcttggcactatgtacgtacgtaacccactaaccagacatgatcacatgaatcatgccagagaataacgtaacgtgcagagtgcctgggcggtccatcgtttattctttcacacaagacaacaacaaaagaacagactcgaaaccaacccgtaatcactcgaccacagtcgccctgctgctgctgctagtcagtatacaacgcttctgcagcatcagctcccgaaacctacccgcggcgtcggcgaggccggcgcgcaggagggcgtccagcagccggttgcaggcggagacgtcgaactcgggggccttggagcgctgccactggtcgacgacctccccggcatcctccaagccgccgcacgccaggtaggacgagaccacgcagacgtagttccggctcgtcatgcgctgctgcgactg

SEQ ID NO: 51338 - DNA, 332 bp, Zea mays
  Clone ID: LIB3067-043-Q1-K1-B1
cgccaggagtgctggaatcagtaagattgaaattcaaacgatcccagggaagcagttaagggagcagatgttgtgtatacagatgtttgggccagcatgggccaaaaggaagaagctgattatagaaaacagaagttccagggattcacggtggatgaagccctgatggagattgctggcccacaggcctaccttatgcactgtttgcccgcagagagaggagtggaggtgacagacggtgccatcgaggctccaaattcaatcgtgttcctccaggctgagaacagaatgcacgctcagaacgccatcatgcttcatgttctcggtgctta

SEQ ID NO: 51339 - DNA, 335 bp, Zea mays
  Clone ID: LIB3067-043-Q1-K1-B12
aataccccgcccgacccactcgtccgaacaccttcttttcttttcttttgttttatatttttccttttcttcttcttcttcgggggtttcaggtttagtaatctgctagtgagatggaagaactgaggtcagatcagacgtggtggtgactagccatgaaagtgaactttactgttaccgtactgtgcgatcaactggtgggggtaattagctagctagctagctgctggggttatggttaatgcatgaactgctattagttaccaggtgttagtgttactctcgagtcctgctcttggtactgtttgtgtactgactgtgtcactccactacta

SEQ ID NO: 51340 - DNA, 342 bp, Zea mays
  Clone ID: LIB3067-043-Q1-K1-B2
gttcgagacaccaagtataaagtttcttttcagcgttaagcaactaactgaggaggacaagtctgcctggtcagaacttgtggtttctctgaagtcagaatatccgaagtacacacctttgctttctaagattttgcaatgtgtcctccagaaaggaactgatggtgataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagatacgcgggatcagttggctgatgcactata

SEQ ID NO: 51341 - DNA, 422 bp, Zea mays
  unsure at all n locations
  Clone ID: LIB3067-043-Q1-K1-B3
gctgtcagaggtcgaagtttctcaacaaagcttttaccatgcacannaggagatctggtgtgccgtgatttaacgtgagaagctatcttggtataatggcacccacagnccatcaaatggcctgatccaaagcccaagctcaaagctcagtatcnagagggttgttaacaatctcaagggcgtcaatactgctgatgaaatgggcctgcacgtcaaagcaatgagagcactcaaaaccagacttcattggaagaagacttcacaggccaaagggctgaaaagtccatctcggcaagtttccctgtagattcccttgggccttgaagaaagtattcgattacccttccaggcagagtgaggttgacattggcagccctaaggcatatgacggagaagtgatctgaaaagcttgggcattccaa

SEQ ID NO: 51342 - DNA, 199 bp, Zea mays
  Clone ID: LIB3067-043-Q1-K1-B4
cggacgcgtgggttttaaaggtaatagttgtatataagcagagttctctgacactcgagccattttaactggatgtcattttccaattgatacaaaaaaaaaaaaaaaaaaaaaaaaaaaaaaaaaaaaaaaaaaaaaaaaaaaaaaaaaaaaaaaaaaagaaaaaaaatgataaaaaaaaaaaaagtaaaacaaatta

SEQ ID NO: 51343 - DNA, 368 bp, Zea mays
  Clone ID: LIB3067-043-Q1-K1-B5
cccacgcgtccgcaatatccatcaatacttaattgatatggcagatgaggtcattaatgctggtcgttttgatcaaagaacaacccatgaggaaagacgaatgactctggagacactcctgcatgatgaagagagatatcaagactctgttcatgatgttccttcattgcaggaagtgaaccgtatgattgctaggactgaaagtgaagtcgagctttttgatcagatggatgaagactttgattggacaggtgatatgacgaagcatgatcaggttccaaagtggcttcgtgttaactccaatgaagtagatgctgtggtggctagtctgtccaaaaagccgtcaagaaatatgtcatctgggggca

SEQ ID NO: 51344 - DNA, 195 bp, Zea mays
  Clone ID: LIB3067-043-Q1-K1-B7
tcgcgcgagcgttcgccctaaatttttcattttagaagcgaggcaaattgcccaggacactgattaaagaaatggggctgttccattccatgactgaatatgtcatgtacataacaccctattgccatacggtaacaaatgatagcaatctgttgcagacatagattattcgatgatgcttttaaagatatgcat

SEQ ID NO: 51345 - DNA, 143 bp, Zea mays
  Clone ID: LIB3067-043-Q1-K1-B8
accacgcgtttgcctacgcgtttgccctttcgatcgcccacgcgtccgctgacgcgtgggttgacgcggcggatgtttgtaattccaatgatacaactcagatccaaaaaaaaaaaaattaaaaaaaattaaataaaacaaaa

SEQ ID NO: 51346 - DNA, 443 bp, Zea mays
  Clone ID: LIB3067-043-Q1-K1-C11
tcggagagggtactccctctctacgagcgctgtgcgggagattgtcagggacataaaggagaagcttgcctacgttgcccttgattatgaacaggagctggagactgccaggagcagctcctctgtcgagaagagctacgagatgcctgatggtcaggtcatcaccattgggtcagaaaggtttaggtgccccgaggtgctgttccaaccatcccttgttggcatggaatcgcctggcgtccatgaggccacgtacaactccatcatgaagtgtgatgttgatatcaggaaggatttgtatggtaacgttgtcctcagtgggggatctaccatgttccctgggattgccgatcgtatgagcaaggagatcacgttcctggctcctagcagcatgaaggttaaagtgattgcgccacctgaaaggaagtacagtgtctggatcg

SEQ ID NO: 51347 - DNA, 355 bp, Zea mays
  Clone ID: LIB3067-043-Q1-K1-C12
gccgccgtcgcaggctttcccccatcgtctcacaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggactgtcgcaccctcgccgactacaacattcagaaggagtccaccctccacctggtgctccgccttcgcggtggctccaagaagcgtaagaagaagacgtacaccaagcccaagaagatcaagctcaagcacatgaaggtgaagctctccgtgctgcatttctata

SEQ ID NO: 51348 - DNA, 276 bp, Zea mays
  unsure at all n locations
  Clone ID: LIB3067-043-Q1-K1-C2
cacgggaacatcaagtcttccaacgttttgcttggttcagactttgaggcttgccttacagacaattgcttgtcgttcctcctggaatcatcagaagtcaaagacgatgctgcttacagagcaccaganaacatganatccaacagaatgctaacgcccaaatcagacatatatgcttttggtgtcctncttcttgagctccttagcggaaagccaccgcttgagcactcaatcttggtcgcaagcaatcttcaaacctatgttcagtcagcgaga

SEQ ID NO: 51349 - DNA, 390 bp, Zea mays
  unsure at all n locations
  Clone ID: LIB3067-043-Q1-K1-A5
gctgcattaacaccactccagtatcagtttatatggtgtaggtccgcaacagaaaagttgttctgtgagctgggtgcccactaacgtctcaggcagaagcaaggcggcgttgccttcgcatgatcctgaaatggaggtagatccatggaatcttctcgaagatggcacaagctgcccctcaacagcatctggaagccatggcgcgagtggagtgacgggtgaccatgctaatctgaaagcgtgcagctggcttaagggtgctgtgagggtgaggaggacagaactgacctacattggctctntagacgatgacacctgacgtgtgtatgattattttggtgaattgtggaagaaattagtctcacctgttggcactggagtgaatggtgg

SEQ ID NO: 51350 - DNA, 383 bp, Zea mays
  unsure at all n locations
  Clone ID: LIB3067-043-Q1-K1-C3
cccacgcgtccggccacgtcagacaacatcaaatgttgggcacctaaataagccatctattcaggctcttatccatgggctgaatagacactactactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaagaggaggacgaactgcctnctgagaaacttgcgatagcaaatgtgggtcggcaagatgcaaaaaagcatttggaagagcatgtgtcgaatttgatgtcatcaaacatag

SEQ ID NO: 51351 - DNA, 220 bp, Zea mays
  unsure at all n locations
  Clone ID: LIB3067-043-Q1-K1-C4
aggcacagaagattgttgcattcgnggttcncattcgcaatgccaagcgaaagcaacgaatggcagtcaagcaccgggatcacatgaggcgaaagataatggcgatgaagattggcaggtggatgagatagcttggtatttaggctctgcggaatgcggtgaatcatataattgtagtggataatttttcgtgctacaagtgctggcataaaactatgtt

SEQ ID NO: 51352 - DNA, 443 bp, Zea mays
  Clone ID: LIB3067-029-Q1-K1-A11
ctcttcttggcctcctcgccctccgctccggagggcaagttaattgttgccagcgtcctctgttgctcgacctcgcctgagaatgggaaggaaaacaagcccgagaagggtatggaaaattcgaagcccgaaaacatggtttcaaacgggataaccatggcctcacctagatctcacaacagcacaacacgttccccataggaatcgaaattggaattgtaggccaggatgagccatgtcgcgggtacagatccacgtcgacgcggccatggcggcgagcagggagatgggcctcgacagtagtggtggcatggggagggaagaccacatggcacatgtcgtgtgtggacacgtaggggccgtggagccagcggcggcgcgaccaggcagagcgcgtgtcagagtgtctgcacctgcaggagatggagaggaggagcacgaga

SEQ ID NO: 51353 - DNA, 450 bp, Zea mays
  Clone ID: LIB3067-029-Q1-K1-A12
cccacgcgtccgtccacgcgttcggccacgcgtccgatgaagagggctcacttaggagtggcaagagaaagaatgctcagcaaactaagactaaaaaaacaaaggatgctggaacaaaaactggtgcagaccaagcagggaatggagatgctgaggatgatgtgcaagataaactcacagggaactctgtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttggtgttggacctgaaaggaacaatatacaaaacaactatagttccatccaggacattttgtgttgtgagtgtgggacaatcagaagcaaagatcgaagctattatgaatg

SEQ ID NO: 51354 - DNA, 463 bp, Zea mays
  Clone ID: LIB3067-029-Q1-K1-A2
accaatttgatgaggcactcctttgttctcatgaaggtgcttcaggttgccacttacatactgtggaagaatgtaccccagggagctgcgactacttgctacgtaggactgagccctcaactcaagggagtgacaggaaagtactttgctgactgcaacgtggagaagacgagcaaactggcgaggagcgaggagttggcgaagcagctctgggacttcagcgaggagctgatcaagtctgcgaagtgagagccgaaagagctggatcagagaaaatgttgtggtcctgcttggcatctagtggtacaagtgatgactgattagtatatagcacggaagaggaacctgggcgatggctggacctcatggtgttcaggaataaaatctgcttgctttcgtacattaattagtcccgtgtggcatacatcaatttgtagtgctgtcaatatctgttcaatatacg

SEQ ID NO: 51355 - DNA, 253 bp, Zea mays
  Clone ID: LIB3067-029-Q1-K1-A3
cccacgcgtacgcccacgcgtacgcagtgatttatcatagcgaaagaaataaaaaagcggcggtgtttcttgataaaaaaaaaaaaaaaaaaaaaaaaacaaaaaaaaaaaaaacaaaaaaaaaaaaaaaagggtcaaaactttacaaatactaacatcaacgtacacattcaatcgactacaaacatgtaacatagagccacctaaacagaatcaactatcacatcttttaacaacataaagactaggaaaa

SEQ ID NO: 51356 - DNA, 377 bp, Zea mays
  Clone ID: LIB3067-029-Q1-K1-A5
tcgcccactcgttcgtccatttatccgatgaaaatggctcactgagcactggctatatatagagggcggaacgcactaagactaaaacaacaaaggatgctgtaacaaaaactggtacataccaagcatggaatggagatgctgaagatgatgctcaacataaactcacagggaactctgtctcccataagttaccattaatatttccagataaacctcaacgttcaaaggcattgattcaatgtcatggtgactcgatcgatttaactagagatattattgcacttgacaagatagtagtttcaaatagtcctactgcaaaaccagatttgttgttggacctcataggaacaatatacacaacatctatagttcca

SEQ ID NO: 51357 - DNA, 418 bp, Zea mays
  Clone ID: LIB3067-029-Q1-K1-A6
taaaaaaaaaaaaaaaaaaaaaaaaaaaaaaataaaaaaaaaaaaaaaaaaaaaaaaaaaaaaggaaaaaaaaaaaaaaaaaaaaaaaaaaaaaataaaaaaaaaaaaaaaaaaaaaaaaaaaaaaaaaaaaaaaaaaaaaaaaaaagtgcctacctttttaaagatcccctttttccttcctcttctttcaaattattaaccttttttcagtttgcccaaatatcaattacctcacctatcttttaaaaccatagcatttgaaaaacccttgtttttcccaattttaatcctttttaaaattatcccttttttcccttttggttattaccctaaaagcccccattattccccctttccaaatatttccccctccttattgcctattgtaccccccctttaattggtccttaaacccc

SEQ ID NO: 51358 - DNA, 405 bp, Zea mays
  Clone ID: LIB3067-029-Q1-K1-A7
atcgatttggagctagggatgtaatatgatttagaaaatatccgaaccagtattgactaggttagagtcagtactgggtcggatggaatcttcggatatccgcactctttgcgataactggtacggatgcggatattgtattcggatatcgaattcgaatacaatatgtctgatatctgtcggatatcgaatatccggatattttctcggataaatcttctcggatatccggatagctgtgtgtattttgttgatctttttgtagaaagaaattaataatacacaaatattctcaaaaaataagaaggctaataagcaaactaactcacacaaattgagatgaatctaaactgaacgttatccagtaaataaaccttaaacagcaaaattaaaagggggggccgt

SEQ ID NO: 51359 - DNA, 399 bp, Zea mays
  unsure at all n locations
  Clone ID: LIB3067-029-Q1-K1-A9
gtcggggagttcgggggcaacgactacaacgcgccgctcttctccggcgtcccatggtctgatgtcaagacttacgtgccccttgttgcaaaggctatcgccaatggcgttgagaaactgatcgagcttggggcaacagacctcctggtgcctggcgttctcccaattggctgcttcccgttgtacctgacgctgtacaacaccagcagcaaagcagactacaacgcccggaccgggtgccttcggaggtacaaccgnctggccttccaccacaacagggagctgaagcagcagcttgacgagcttcagaagaagtaccccaagacgaagatcatgtatgggagatacttcaaggctgcactgcagtttgtcgtcaaccctggaaaattggttttagca

SEQ ID NO: 51360 - DNA, 403 bp, Zea mays
  Clone ID: LIB3067-029-Q1-K1-B1
caatcagtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggtgccggcgagggcaagaagggcaagaagaaagccaagaagagcgtggagacctacaagatctacatcttcaaggtgctcaagcaggtgcaccccgacatcggcatctcgtccaaggccatgtccatcatgaattccttcatcaacgacatcttcgagaagc

SEQ ID NO: 51361 - DNA, 366 bp, Zea mays
  Clone ID: LIB3067-029-Q1-K1-B10
cccacgcgtccgggaagagaatcaagctcagtgctgagaaggctatcttcatatttgtgaagaacacccttccaccaacagctgctctgatgtcttcaatctatgaagagaacaaggacgaggatgggttcctctacatgacttacagtggtgagaacaccttcggactgctctagatggctcaccgcaatcgggtcgggtagccttgcccatgcctcctgtaaataagacctgccaagcaactgtgtatattctggtttcgtcgttgcaagtggttgcgctctactgctaaagcctacctatcagttgtggagttgtcgtcgatgttatggacacacttaatcaagtttattaattgactggacc

SEQ ID NO: 51362 - DNA, 430 bp, Zea mays
  Clone ID: LIB3067-029-Q1-K1-B11
ctcgctccaaacacaccaccactccacagtgcacttcactctacagcaacgacagagaagtgagcagcagacagcagcagctgctgccatggaggcgtggagatctctcctcgcgagcttcgtgctcgccgtgctggccgcgcaggccttggtggccgtggtcgagtccaggaccggccccgtggagcaggcgagccaaggtgacgacgtgaagaagccggactgcgtgccggggatagacccgcgctcgttcccgggcaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccc

SEQ ID NO: 51363 - DNA, 451 bp, Zea mays
  Clone ID: LIB3067-029-Q1-K1-B12
cccaatgcggccgacgccggcgctcgacgccggcggacgcatggtaacaagcttcctatgcgccactgaatggatgcttccgtctccggccacgcaagtccacaccatctccgtacttccctcccgtcgcgacttcgccttctccaacctcacgatgtcgctcaggaatagcggcggcaacgagggagagagtggcagtactaagttccacgtagtacgggacgacctcctccacccgctcgccaacggcaacaaggcgcgcaagctcgacgccctcctgcccgtcctccgccgctgcggcgctactgacatcgttacgtgtgggggttgccagagcgcccatgccgcagctatcgcggttcactgtgccgaatggggaatcaggccacatatactactgagaggcgagcaactggatgttcccacagggtataatctcatctcattgatg

SEQ ID NO: 51364 - DNA, 428 bp, Zea mays
  Clone ID: LIB3067-029-Q1-K1-B2
cgcacggagaggtacgttcaggagacatcttcgagaagctgaaatggctcctaaagctgcggctggcaagaagggtgatgccaagacccaggccttgaaggttgccaaggctgtgaagtctggggcagcctagaagaagaccaagacgatccgcacgtgtgtgacatttcaccgacccacgaccctgaagaaggctagggaccccaagtacccacgaatcagctctaccggaaggaacaagcttgatcagtaccatattctcaagtacccccttaccacagaatcagcgatgaataagatcgaagataacaacactgtggtcttcattgctgaccttaaggcagacatgaagaagatcaaggctgacgtcaagaagatgtatgacatccatgcaaagaaagtcaacaccttgatcaggcctgatggga

SEQ ID NO: 51365 - DNA, 68 bp, Zea mays
  Clone ID: LIB3067-029-Q1-K1-B3
aaaaaaaatagaaaaaaaaaaaaagaaagaatagagaagaagaaaaagacaaacaaacaagggcgggc

SEQ ID NO: 51366 - DNA, 462 bp, Zea mays
  Clone ID: LIB3067-029-Q1-K1-B4
cccacgcgtccgcccacgcgtccgaaggaattggccttaaaccttgaagttggtcctatgagcatgaccaagtggcagttgtttttacagattgagcagtccttccaggttcatcgtagttatggaagtatgcttgaaggcgaggctgatgaactcaagagggttttccttgaaggaaatccttatcttcttggattgaccatgattgtttctctattacactctctgtttgatttcctggccttcaaaaatgatattcagttctggaacaagaacaagtccatggaaggtctatcggcaaaatctgtggttctgaattttgtgtgtcaactaattgttttcctgtaccttcttgacaatgacacttcatggatgatccttgctagctctggaattggtgtttgcattgagttttggaagatcggaaaggcgatgcatattgaagtcgatagaagtggaaaa

SEQ ID NO: 51367 - DNA, 459 bp, Zea mays
  Clone ID: LIB3067-029-Q1-K1-A1
cggtacaagagtggctgcatcagcggcttcgatttctcatggttcagagaggaaagcctggctcatccttgcatgggtcagcaccgtggctgggaaagcctggctcatccttgcatgggtcagcaccgtggctgggaacctcaccctcctaggctctgcggcgaatctgattgtctgcgagcaggccaggcgggcccagttcttcggctacaacctcaccttctggagccacctccgattcggggtcccgtcgaccatcatcgtcacggcgattggtttgctcatcgtcatcagttactgaaacagctgaaggcagaagagcgtagtgtaagagaagcagaatggataaaaatccttccaataagaagtacatgtaaattaggcttgccctataactcaagtgtgtatcggtacgttatgtctccgtctgtgctcttgctcgtgagcaagcagcacatg

SEQ ID NO: 51368 - DNA, 441 bp, Zea mays
  Clone ID: LIB3067-028-Q1-K1-G5
cccacgcgtccgcccacgcgtccgcggacgcgtgggcgcgtgcgaaccaagcagaccccggcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatga

SEQ ID NO: 51369 - DNA, 449 bp, Zea mays
  unsure at all n locations
  Clone ID: LIB3067-028-Q1-K1-G6
agcaccattgatttcacaaatttgtcaacataagacattgcagatggagacgaacaagtgaatctggatccagatgatgacaacgattggttgcataggaacgagacattccaggcaaacaacattgtcacaagtaaagaccttctaacaccaggtgatgatgatgagggtgtcatattcgaagaggaggatgatgatgatgagaacgatggatacctattcgctgggcaatgcacttcctattccaacaattgatgtcattgaaggagctgcccttggtggtgggctagaactgggagacaatctaacctcttcaaaatccaacataaaggttgcaaagtagacatgccctatttctatagttcatgcttcatggatatgatggtcacacttcatggtctgcggtgctganggaacagtgatagattgatatgagggttgcaagtcag

SEQ ID NO: 51370 - DNA, 361 bp, Zea mays
  Clone ID: LIB3067-028-Q1-K1-G7
accaccattgatttcacaaatttgttaacataagacattgcacatggagacgaaggattgtatctttatccagatgaggacaactattgtttgcatatgaacgagacattccatgcaaacaacattgtcacaagtaaagaccttctaacaccatgtgatgatgatgagggtgtcatattcaaagaagatgatgatgatgatgagaactatggatacctattcgctgggcaatgcactttctattccaacaattgatgtcattgaatgagcttcccttggtggtaatctataactttgagacaatctaacctcttcaaaatccaacataaaggtttcaaagttaacatcccctatttctata

SEQ ID NO: 51371 - DNA, 363 bp, Zea mays
  Clone ID: LIB3067-028-Q1-K1-G8
cgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatactgggcctggctgttgctgtaaggatctacaccaagtcggaatctgcctagtcatctgaaccaagttagcgagggttgcatcttgtttaccagagtcgcatgtcagaaacttggagtctttgctgtcatacggttatatttatatgagacttctatcggtaaaatgaaatggatgtcag

SEQ ID NO: 51372 - DNA, 453 bp, Zea mays
  Clone ID: LIB3067-028-Q1-K1-G9
gagggatggtccacagtaacgacagcaaaacaatttattacaggaagggtgggacggaagtcgataatgttgatgaccaccctttagaaaagcaagaccaccaggatacatcaagtgacggatctaaaaagagaagccgatctgtggacaacgcatctggtggcaacagaccatacttggatgagagcaagaagcgtaatctcagagaagatggaagatatgctcattatgaagactggagaagtgaaaggaatacagcagcagacacgtctggatataaggcccaatcagaagagaagcctgtatggacaaacactcgaacaggatcaagggagcattcactggacaggcaaaggatagagtgtggtgacagctatcgtggaacctataacaatagacaaagacatgaatggccgcacgctagtggtaattcctcgagaattggttgggatg

SEQ ID NO: 51373 - DNA, 444 bp, Zea mays
  Clone ID: LIB3067-028-Q1-K1-H10
ctcaggcaattttgggagggacagttcaagtcccaactctcagtggagacgttgttctagaggtcaagcccggtactcaacctggtcagaaggtagttctgagaggaaaagggatcaagacaagaaactcaccgtactacggagatcaatatgtccatttcaatgtcaacatccccgaaaatttgacgtctagacagcgggagctgatcgaggaattcgcgaaggaggagcaaggcgaagacgagaaggacgccaaggcagcagctggagcatcggggggatagccggttttaggagccacagtagtgccttttagctggtatttataccgtgaccatagacctgtctcaaattcgcagcggaaaaaatatatagataggtctttggttcggattttgtagcttggataaatggataatacgtctaaaactggttttctgtctt

SEQ ID NO: 51374 - DNA, 449 bp, Zea mays
  Clone ID: LIB3067-028-Q1-K1-H11
actagttctagatccagatcaccataccaccggggctgatctcgcggcttgggaagctgcaggtgctggaggttttcaccgcgagcatcgtctccgtcgcggacaactacgtcgcgccagtcattgacgacctcgagagcagcggcgcgcgcatggcgtcgctcggcatctggctcgacaccacccgcgacttggagcgcctcgcgcggctagcgccgggcgtgcgcgcccggtcgctgcacctgcgcaagttagaagggacgcgcgccctgccgctgctgtccgcggagcacgcgccggaacttgccggcgtgcaggagagcctgcgggagctggtggtctactcctccgacgtcgaggaggtcacggccgacgcgcacgtgcccatgctggaggtcatcaagtttgggttccttacgaagctgcgcgtcatggcgtggtcccacgcc

SEQ ID NO: 51375 - DNA, 342 bp, Zea mays
  Clone ID: LIB3067-028-Q1-K1-H12
cgcagtagcagcagccgccgccgccgccgcccagccgcaggaaacaggaggaagatgccggcggggcacgggcttcggtcgcggacccgcgacctgttcgcgcggccgttccgcaagaagggttacatcccgctcaccacgtacctgcgcacctacaagatcggcgactacgtcgacgtcaaggtgaacggcgccgtgcacaagggcatgccgcacaagttctaccacggccgcaccggtcgcgtctggaacgtcaccaagcgcgccatcggcgttgagatcaacaagcaggttaatggccgcatcatcaagaagcgtatccatgtccgtgtggagcatgtg

SEQ ID NO: 51376 - DNA, 358 bp, Zea mays
  Clone ID: LIB3067-028-Q1-K1-H3
ctcagcgtggccctgaacctgtcgagatccatccggatgttctgcttgtccaggtacgctgagggaggccatgagccggttgccgtcggctccgtgaccggccgccgtgccccggcccggaggtagataggttggtgtatctatcgtccccgttgtcatgctctcaacaagttgacttaatcttcttcttcttctccgtcccccctttttatttttattatgtcactagcaagattcttttggtccattgttttgttgtgttgtttactgctgctacataaggaatcaatctcatgggaagatgatgagcaaaagcaaagcaagaccaggttgctgttataaatttatatatatatat

SEQ ID NO: 51377 - DNA, 457 bp, Zea mays
  Clone ID: LIB3067-028-Q1-K1-H4
catttatggatatgaagttgtccctgaagccattgaagatgcgcgaaagaatgccaagttgaacggtatcaacaatgcaacatttgttcaaggggacctcaataaaatcaatgaatcattcgggaaggaatttccaaagcctgacataatcatctcagatcctaatcgccctgggatgcacatgaagttaatcaagtggctgttagaagttaaagctcctcgaatagtgtatgtctcatgtaatccagctacttgtgctcgggatttggactacctatgtcatggcgtggaggagaaagatttgagaggattctatgaactgaagagtgtaattcctgtggatatgtttcctcatactcctcatattgagtgtgtatgcttattggagctgcgttgattttcagttttggtcaggtaaacccactggagccttgtttgggtgacgagtattcacctc

SEQ ID NO: 51378 - DNA, 407 bp, Zea mays
  Clone ID: LIB3067-028-Q1-K1-H5
gcaaggccacacacacacacacaccactagtaggctagcctagccttttagtcggggaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcccgggttcagcatgcccggcagcggcagcagcctacccgggttcagcttgcccggcagcggcagcatgcccc

SEQ ID NO: 51379 - DNA, 422 bp, Zea mays
  Clone ID: LIB3067-028-Q1-K1-H6
cccacgcgtccgcccacgcgtccgcccacgcgtccgcccacgcgtccgcgtcgtcgggggaattgagtgtgagagctcgaaaaaacccaggggatcggccggaccagcagcgagcgagcgcgagctctgcgtgcgtgtgtgtgtctgctctagattagatcacctccatcgtcaataattgcaggcagatccatagtctgctggtggcgagacaaagcaacggatcgtcgtcgatccggagagcggaaagcgcgcagatcgcgacggccatggggcgcggcaaggtggtgctgcagcggatcgagaacaagatcagccgccaggtcaccttcgccaagcgccggaacggcctgctcaagaaggcgtacgagctctccatcctctgcgacgccgaggtcgcgctcgtcctcttctcccacgcc

SEQ ID NO: 51380 - DNA, 423 bp, Zea mays
  Clone ID: LIB3067-028-Q1-K1-H7
cccacgcgtccgaaagcgagccgaggggaagagccggaaccctagcccagcaccggagaggcgcagagacaggcgtgttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctatcaacaccttcttcagtgagactggtgctgggaagcacgtccctcgtgctgatattgctgaccttgaaccaactgtcatcgatgacgtgaggactggcacctaccggcagtttttca

SEQ ID NO: 51381 - DNA, 449 bp, Zea mays
  Clone ID: LIB3067-028-Q1-K1-H8
cccacgcgtccgcccacgcgtccgcccacgcgtccgcttccatgtcctaagagcatttggagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagctgctcaaaattgagcatgaattatgtgagagggtcataggccatcttgaggaagggaaagatgtccgtttaggggattggaaagctgctgacattgagatcttgaatacattccagctactttcagctaagccagttgtctatttggtgaatatgagcgagaaggacttccagagaaaaaagaacaagtttctacccaagatacatgcttgggtgcaggaacatggtggtgaaaccatac

SEQ ID NO: 51382 - DNA, 80 bp, Zea mays
  Clone ID: LIB3067-028-Q1-K1-H9
aaaaaaaaatacatccagaaaaccataccatcaatactaactctaaaaaatctaaaaactgcaggggcttccaaattttc

SEQ ID NO: 51383 - DNA, 414 bp, Zea mays
  Clone ID: LIB3067-028-Q1-K1-G4
gggacggccagggtggtgagagcgagggcaagacgttgttgccatattgcaggggcctcgagttattggtggacagcagattggtcgagagaaagccatcggcaactgaacaagctccagcacatgttgcaaaggatgcagctaccatccgctctcaccaacaaggacaacagagacctcagaacttgtcgaggcaggaattcttggacaggtttaagaggagcgctggactggtcgcttcaggtgttgcgaagaatctaaacaaaacagccaattatatcaaagaaaatattcaggacatgtacaccgatcgtcgtccaccaaagtagcaaccatgccgagtgattgtcgtcaagagctgaagaaatcgcttgctactggaaactttacatcaggactacctggaaactttac

SEQ ID NO: 51384 - DNA, 452 bp, Zea mays
  unsure at all n locations
  Clone ID: LIB3067-028-Q1-K1-F10
gttattcgggacacgttacttgttggattgacagggtactccaagcagggacaacctgtgtatgcatttggtgtgggtcttagtacttttgacaaggcctcggtgaattactatgtgcaatcacacatacagatgaatgaatatcgagatcgtgttgtcctgccggctgcatcaaagaagtttgggagacagattaatacctgcttgaaggttatggatatgactggcctcaagctgtctgcactgagccaaaataaaaatgttgccgatgattactactgttgatgaccttaattatcctgagaaaacggaaacttattacattggtaatgctccataatgtttttcagcgtggtggaaaggtgtgaagccactcttacaagaaagaacttaaaagaagatccaagtnctgtatggctctgggagggatgagttactgaaggtcatggact

SEQ ID NO: 51385 - DNA, 377 bp, Zea mays
  Clone ID: LIB3067-028-Q1-K1-F11
gccacgcgtccgaccacgcgtgcggccacgcgtgcgaaataaaagcagggacaacactgaggatgcatatggtgtgagtctggagtacttttgacaaggactgggcgaacgactatgagcatccacacatactagacgaatgcattatccagattatgttgacttgacggctgcctcaatgaaatttgcgagacagattaatacctgcttgaacctgataaaaccgactggcctcaaactgtattcactgagccgaatatacatgttaaccaagatgactactgcggatgaacgcacttatcctgagacattgggaacttatgacattgctaaatgtccataggtacgcgccgtgtattggaacgttaagaccccac

SEQ ID NO: 51386 - DNA, 400 bp, Zea mays
  Clone ID: LIB3067-028-Q1-K1-F2
cccacgcgtccgcccacgcgtccgtgaatactctcctttacttgcatgcttcattttgttggatatctgaatgaggtgccgaatataagcaaattcaagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaataaaaaataaaaacaaaaagagaaaaacaactaaaaaaatgaggaaaacattcaaaattaaacacaatttccctccttaaaaaaaaaccccccaacgtcatctatactgtccactaaaaaaaaaacggcgggactttttaaaaactttttttacc

SEQ ID NO: 51387 - DNA, 415 bp, Zea mays
  Clone ID: LIB3067-028-Q1-K1-F3
cccacgcgtccggtggggtgctcgcaggcgcaactgccttctggctgctgtttgaggtcatggattaccacctcctcaccctgctatgccactgcctcatcctcaccctggccatcctgttcctctggtccaatgccacgactttcatcaacaagtctcctcctaacatccccgaggtgaagatcccagatgacctggctgtgaatgttgcacgttccctgagatatgagatcaacaggggttttgctaccttgagggagattggccaaggccatgacctcaagaaatttctgattgtgattgcaggactgtggatcctttctgttcttgggagctgctgcaatttcctcaccttgtcttacatagtttttatggtactgtacactgtaccggtcctgtatgagaaacatgagga

SEQ ID NO: 51388 - DNA, 115 bp, Zea mays
  Clone ID: LIB3067-028-Q1-K1-F5
cggacgcgtgggcagaagccaagtgttctgatgatttgttttttcaattgtgttttttggtattggttcagcaagcacatacatgatttatgacatggcatctgctatctttgtt

SEQ ID NO: 51389 - DNA, 440 bp, Zea mays
  unsure at all n locations
  Clone ID: LIB3067-028-Q1-K1-F7
gttatatttgatgaggaagctgtcgagtcaaaactgctaaaagcacggatgaaaaggcggcaaaaatacattgatcagttccatatgttatacgatgacttcaacatcaccaagcttcccttgctttcagaagaggtttgtggtgttcaagctctccaaaacttttcccagcacttccttacaccatacaagtctactcttaaaaggggcaccgtcgaggagctcgaacagagaataactatattaaaatctgcactgcaagaagctgagacagagttagatagggttaggaaagggaagcagtcagtgtgattttttttccacaggtcaagtgtgtaaaaccagagagacgatcaattttttcgtgtcattacactcttgttgatttcactatcatgtttcctcatcgaggagtttagacttngtatagctaatcgcag

SEQ ID NO: 51390 - DNA, 421 bp, Zea mays
  Clone ID: LIB3067-028-Q1-K1-F8
agccaaaacacgcccgcgcgcctgtttgttcggccggaggacgccatggccatggaggagggatcaggagcggtggagaaagggccggccgtgggcacggtggctgacgcctccgccagcgtcatcggcgaaggcgccgtgaaggaggaggccgggggcagacggcagccgtcggccggctacgcggccgtcgtgattggcggcaccttcgaccgcctacaccagggccaccatctcttcctgaaggcggcagcggagctggcgagggagaggatcgtggtcggcgtctgcgacggcccgatgctcgccaagaaacagtacgccgacctgatacaaccgatcgagaagcggatgcagaacgccaaggattatattaagtccataaagcccgaccttgatgttcatgtggagcccatcgtcg

SEQ ID NO: 51391 - DNA, 445 bp, Zea mays
  unsure at all n locations
  Clone ID: LIB3067-028-Q1-K1-F9
gcaccacgacgcggttaactcgggacggaagcaacgcaactcggcacgaagaaggaaaagccaccaccggttcctccgccgtccccgcggtttcagttccttgcttgcttgcttgctcttgctctccctctctcgtggaagccagccacacaaggcagaaagagagagtgacgttgtgttccatcccgttccgctgaagcaaccgctctcctacaccaaaccacccacaccactctaggtctctagccgatgcgatggatgtggatccagcagcggaccagcggaggaagaacaagggcgggctggagtcggagctggagcgccactacgacgacctgcagcgggagatgatgctgatggccgccgatcggccgcacaagcaactgcaacagcatcgacgtcacgggcaccgncccgatctgctccagaactgcgacctgccccc

SEQ ID NO: 51392 - DNA, 385 bp, Zea mays
  Clone ID: LIB3067-028-Q1-K1-G1
cccacgcgtccgcccacgcgtccgcttatttgcttaaaaattggacattcctttgttacatatttgtgttgtactgtgttggagctagcgttcctggtattctagctatattgcactggggtggaagaacgggggacactgtcgccgtggtcttaagtctatcagcaatggttttctttagatttctcctcctgtatcacttttttgcgtcacatcatcaatattttattctatacctttttttatctctaaaaaaaaaaaaaaaaaaaaaaaaaaaaaaaaaaaaaaaaaaaaaaaaaaaaaaaaaaaaaaaaaaaaaaaaaacaaaaaatataaaaaaaaaaaattttacaaacacaaacttacaaaagtttaacataaaata

SEQ ID NO: 51393 - DNA, 319 bp, Zea mays
  Clone ID: LIB3067-028-Q1-K1-G10
acggagggatggtccacagatacgacagcaatacaatttattacaggaacgatggtacggaagtcggtaatgttgatgagcaccctttagaaaagcaagaccaccaggatacatcaagtgactgatctaaaaagagaagccgatctgtggacaacgcatctgatggcaacagaccatacttgaatgagagcaagaatcgtaatctcagagaagatggaagatatgctcattatgaagactggataactgaaaggaatacagcagcagacacatctggatataatgcccaatcataagagaaacctgtatggacaaacac

SEQ ID NO: 51394 - DNA, 448 bp, Zea mays
  Clone ID: LIB3067-028-Q1-K1-G11
gagtgacatgaataaaacgaggaatccataaaacaagctgaattccttgtggtagccaatggagagtaccaggatcaaccgagtccacagtaccaggttcattttcttcttcttctcgtggtcatcgtgtcgccaaagttagtttattttattcctagtttgggggcattagtgccgtagatgcgtcattccacatccatctaggagggagcactgtcgtttactgtatacggatttcgtgatgtatcccgggaaatttttgtagatcggactcgtagaagaagagattgcaattgcaatactgtgtatcactctgatgttgtccagtttgagaacttgacaggtgtatgggatttgccccgaggctgctggttttcctgctgcttggtttgggaaaccgatctctcgattgtgagatacaggcaggtttgcgcacgagagtactctc

SEQ ID NO: 51395 - DNA, 388 bp, Zea mays
  Clone ID: LIB3067-028-Q1-K1-G12
cccacgcgtccgcccacgcgtccgattgactgtaagctcaaatgagttcacgccatcgaacgccatgccaatggtagctcgtctagtcgagaatgggtcaactggatacagcgcacaggacactcacgacgcttctcagaattcagcgcccaaagctgcaaatcacgcgaaccaaactggacctcagaacaacagcaaccattcaacgttggtccctgtgaagcccgcgccgaaacgccgtggcaggaaaccgaaacgcgttgtgcacaagcagctggacatcccagatatctgcgaccggcttacatcgtctgtggcgtgcgaagaaatactgtactgtgaaggaatggtctgctatgactatgatcagaactcccttctcttaaaa

SEQ ID NO: 51396 - DNA, 409 bp, Zea mays
  Clone ID: LIB3067-028-Q1-K1-G2
agatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgc

SEQ ID NO: 51397 - DNA, 417 bp, Zea mays
  unsure at all n locations
  Clone ID: LIB3067-028-Q1-K1-G3
gatcattcaggatgggctggtttttaggcaaaacttctggattcggtcctatgagattggtgccgatcgtacggcttctatagagacattaatgaatcatttacaggaaacagctcttaatcatgtgaaaacagctggccttcttggagatggttttggcgccacaccagagatgagcaaacgaaacttgatctgggttgtcagcaaaattcagcttcttgttgagcaatacccctcatggggagatactgttcaagtggacacatgggtagctgctgctgggaaaaatggcatgcgtcgagattggcatgttcgtgacgaanactctggacgcacaatcttgagagctacaagtgtttgggtgatgatgaantagaacactagaanggctttcgaaaatgccggacgaagttaggg

SEQ ID NO: 51398 - DNA, 396 bp, Zea mays
  Clone ID: LIB3067-028-Q1-K1-E9
aatgtactaccctcctggatggtcttactccatcgcgaaacgctagtcttcctctaaagaaatctttagcaactaccgacaactccgaactaatcttaaaaaccatggcttcaaaaaagcttcttcttgccgctctttgccttgtggccgctgcgcttctctcccttccgtctgaatcccacagccttgaagacttctcaagcaacgaccccactccagagattcaaaccttcttcaatccccaagcccctgctctccctgaagcccttgacccgttcttcattcccgtctacaccattgccgctaaacctgatgccacgtcaatccccaccaccaacacctgcaccacacctgctgctgccgctggcaccttaccctctgcaagcactacttctt

SEQ ID NO: 51399 - DNA, 243 bp, Zea mays
  Clone ID: LIB3067-014-Q1-K1-H2
ggcagaatacccccctgcctcttattcggcccccgcccgcccctgcagtgccatccgctgctcttctccgttcgcccgcccgcccgcccctcccctctctctgtctcgccgcccggggagaaagagggctccgccgctcccggggaagagcgcgccattgccgccgccgcgctgactggggaagatggttgtccaggagttcacagttgatctcaacaagccccctgttttccaggtttgcca

SEQ ID NO: 51400 - DNA, 355 bp, Zea mays
  Clone ID: LIB3067-014-Q1-K1-H4
cccacgcgtccggaaccatgcgttttttttggcagctatcggatgtcggcgtggtcagccacgacgtgaggctcgccagcaccgactccttccaaggtctctctatcctctcccccaccccccacaggttcgcgatctgcgccggccgcgctcacctatctacttgctgcgttgttcgctcgcctgctgtgcctgcgcatgcagaccgtgtcgagcatagtcgggctggcctggcgttccagtacggcgtgcttgtgctgtagctgttgacggggcatttcccgggcgccgactgctagctcgtgcgctgggctcaagaccccggctcctgcgtctttctgcacccggatggtgg

SEQ ID NO: 51401 - DNA, 397 bp, Zea mays
  Clone ID: LIB3067-014-Q1-K1-H5
gggcgaggacggtgagtacatcgtgctcatggcgtctgacgtgatggctgttctttcctgatccccaaaccatacagcgccaggtgcgcgataggaagttttgatgttgaggccgaaccttatcttttatttgctcttgtttggaattggtggaggcttttgaactgtaatctggtgcgaattataaggaaaataagccgagttgtgtagacttgagacaggactgtgctgtgctgtttggctggtatgtgagctaaccagtgttcagctggtgggtgagctgaccagcactttcgtttcggctgttctttctgatgtcagcgttgtacgcctaggttggccatcggtatttatattactaatagcatctatgctacccgttgaggttttcatggat

SEQ ID NO: 51402 - DNA, 58 bp, Zea mays
  Clone ID: LIB3067-014-Q1-K1-H6
gcgccacacacacgccgacgcgaaccaactaaccagctgggagtaggttcgccgtgct

SEQ ID NO: 51403 - DNA, 231 bp, Zea mays
  Clone ID: LIB3067-014-Q1-K1-H7
gccgagtggttggggccaaggacatggaaggtagaggcgatgccaacgttcgtacttgtcaaggatgggaaggaggtaagccgagtggttggggccaagaaggacgagcttgagaggaagatccggatgttcacgtcatcttcctcatcgtaaactcctgtggttcgcctgggacggagttgctgaagtgaaatggttcccttctctgaatgctgtatataaatatttaat

SEQ ID NO: 51404 - DNA, 192 bp, Zea mays
  Clone ID: LIB3067-014-Q1-K1-H8
gcttctcagcaaacgccctctcgaagttcacaagctgattggcgccaccatcatgatgacgcctgaccgcgtcaccatgcgccgcatctgtgctatcatcatccgctgggatgacattgactgatacctcagcgtcttgagtgctgataacgtgattaggccgtttgctgagaagcactacgccgatctggt

SEQ ID NO: 51405 - DNA, 401 bp, Zea mays
  Clone ID: LIB3067-016-Q1-K1-A11
tcgcccacgcgttcgcccacgcgttcgcttgtgctcccccgctggtatattaccactctggaggacttcggattaatccaaacttgtataacaatgggaaagtgtgtcttagcctgttgggtacctgggatggtagaggttgtgagaagtggaatccagctcaatcgacaatgctgcaagttcttgtctccattcaagctctgattttgaatgacaagccatattacaacgagccaggatatgagtcctatgccaacactccgaatggagagcggttggctttggactataatgacaacacctttctgcactcatgcaagactatgttatactcacttcggaagccttcatagcaccttgcagatcttgttgctggccactttcgggtgcatgggcacacg

SEQ ID NO: 51406 - DNA, 97 bp, Zea mays
  Clone ID: LIB3067-016-Q1-K1-A12
tgtcgacggcgtgctacgtcttagcactttttatagcgtcacctaagtgtaactcactggccttcgtttaacaacgtgtagacggggagaaccgtgg

SEQ ID NO: 51407 - DNA, 275 bp, Zea mays
  Clone ID: LIB3067-016-Q1-K1-A3
ccggaacgacccactcgtccgacgcgtccgaccacacgatcgacgtctagcatgcgccgcgctacctatctacagatgagctgggtacgaggcatatcaacattgaccagctcagacgccacttctaatgcccctcaacatggtacttttcacattatgcaacgcatgcgactgaaagttcgcttcatcctagactattctacacttcatacactcactcctattcatgatcatgtagtcaacaatctcaaagccggttactagagagaattttt

SEQ ID NO: 51408 - DNA, 435 bp, Zea mays
  Clone ID: LIB3067-016-Q1-K1-A5
cccacgcgtccgaaaggattctggcaatgttctgaggtgcaaagatcctatatctgctcatgaaatgacccatatggaagttcagattcgcaacaacacaaaggaaatcatccggatgaaccttagcatttcatgcaaagatgttgctggagagaattgcttcgatgaaaatagtgctactgtcctctgggctggtgttcttagcgatatacacctggaagttccaccgttgcaagaggtggtacatcctttctccatgtatttccttgtaccgggtgactactcgctccaagctgcttctgttataatcgatgccacagacgttcttcgtgctcgtgcaaagggctgaatcaccagatgaacctatactgggttccggattcccattccatatccgggtagtcggttcagcattagcagttcttttagttactc

SEQ ID NO: 51409 - DNA, 224 bp, Zea mays
  Clone ID: LIB3067-016-Q1-K1-A6
cccacgcgttcggtcgttgtgcgtcttctacccctctccctcgaggcctttgccggctaagagcgcccagtcgcccaccaggatgaagtttgttgctgcctacctgcttgctgtcctcgctgggaactccagcccctctgccgaggacttgacagccattctggagtcagttggctgttaagttgacaatgattagatggaaactccttctttcccaacttgat

SEQ ID NO: 51410 - DNA, 243 bp, Zea mays
  Clone ID: LIB3067-016-Q1-K1-A7
gttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagctgtgggggtgggag

SEQ ID NO: 51411 - DNA, 327 bp, Zea mays
  Clone ID: LIB3067-016-Q1-K1-A8
cggacgcgtgggcggacgcgagtgctctgtcgtcgccgccgctatcgtcgtctgcgccgttgcgatgccgtcgcacaagacctttcggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcttgtgtttctgtaagctagcaaacagtttcagaaa

SEQ ID NO: 51412 - DNA, 136 bp, Zea mays
  Clone ID: LIB3067-016-Q1-K1-A9
tcggcgcggcggatgcgattgcgagcggatgtaagggactcaacgcgactggggagttcttacggcggagggactagtggaggaggcaccctattgcggggaaccagcttcgccacgccacacccgggctcggcat

SEQ ID NO: 51413 - DNA, 376 bp, Zea mays
  Clone ID: LIB3067-016-Q1-K1-B1
ccactcgtcccgctccacgcaccacaccagagagtctgcatgtacgctagctagctatctgatgttttactgcgatcagggcttggttccatggcgcaaaaagtggccactcgaggctgctttgaccttctcttgtgagccttcgccgactcatgcggctgcaggtgcggcggatcctgcgctatcccagctgcggcctacactatctactagagctgaagcaatccttaagtgtatcaacgggtcatctgttacatatttgagtctttgctattgatggtttatctgccaagttatttttatttggcttttttgtggttactaggatttcttttttaaatgtattttattttgatttctttaatattttttttcc

SEQ ID NO: 51414 - DNA, 230 bp, Zea mays
  Clone ID: LIB3067-016-Q1-K1-B10
cggacgcgtgggctgacgcgtgtgctgactcgtgggcggacgcgtgggctcttcttccgattgttggtggtgtagctttggcatcccttactgaggcctcctttaactgggctggattttggagtgcaatggcttcaaatgtaaccttccagtcaaggtatgtgctaatctagaaacttatggtgaataaagttgaatctctcgacaacattatcctattctcgatcatt

SEQ ID NO: 51415 - DNA, 159 bp, Zea mays
  Clone ID: LIB3067-016-Q1-K1-B11
atattttatttaattatgtcaaataaatggtagatctccgttaaaaaacaaataaataccgggggaaaaaaaaagaaaatgagagtgaataaaaaaaccaacaagaaagctaaaaaccgatatgaaaagagagcgaagatgatacaaaaaaaggggggg

SEQ ID NO: 51416 - DNA, 228 bp, Zea mays
  Clone ID: LIB3067-016-Q1-K1-B12
cggacgcgtgggtgaggtggagctggcgtacttcaaccatggaggcattcttccttatgtcatccgcaacttggcagcggcgcataactgaggcaagatcacacaccgtttgacccacaatggcagtggcaggctccatgttcccagggctagcgacctggttctcaatgtagtgacatttgtgatggatctaggggtctctttgtcgagtcatcccataaattaagt

SEQ ID NO: 51417 - DNA, 191 bp, Zea mays
  Clone ID: LIB3067-016-Q1-K1-B2
cccacgcgacgacgagcgggcgacgcgagcaggacacgcttatggcagcgacaagccagcagcagcaaggggagcggggagcggcaaaaaaaggcaacccacggaaccgagagacgcacgagcagcacaacaaaaaagcagagagacagacaacacgcagaaacaacaggcaaacagaaacaacgagagcg

SEQ ID NO: 51418 - DNA, 387 bp, Zea mays
  Clone ID: LIB3067-016-Q1-K1-B3
agatgatgcggggactgtgcagctttattgtgagaaagacagccttacggaggaccaatttgagcaactaaaggcgtttattgatattggtgatatattaggtgcaagtggatccattaaaaagacagagaaaggggagctatctgtttatgtgaaaaatttcgaaattctcacaaaatcattactcccactaccagataagtatcatggattaactgatgtggacaaacgttatcgtcaaaggtatgttgacatgattgcaaaccctaaggtcgctgatgtattccgaactagggcaaaagtggtttctgaaattcgcaagacaatgggaatcatttgggtttattgaaatcgaaacttcagttctacagggagcaacaagtttgt

SEQ ID NO: 51419 - DNA, 320 bp, Zea mays
  Clone ID: LIB3067-016-Q1-K1-B4
cccacgcgtccgcgacaaattcaactctttttttgtcgagaaggaggaggagtacatcatgcgtcagaaggagctgcaggaccgggtggctagggcggccgggcgggagtccaaggaggagctcatgctggtgcgcaaggagatcgtcgacttccacggcgagatggtgctgctcgagaactacagcgcccttaactacacaggattggttaagattctcaagaaatatgacaagagaactggagccctgatccggctgcctttcattcaaaaagttctttagtagcctttctttaccactgatcttctgtattagcttg

SEQ ID NO: 51420 - DNA, 388 bp, Zea mays
  Clone ID: LIB3067-014-Q1-K1-H11
atcaagggcaagacaccagaagagattctcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgctttgctaatgtctcgtgtaagacttatttggtcaatggtcggttattaacttattaccatgaaagcactttttctgctgccctaataggtttagtctcatttgcatttttactaatttaatttttgttgattttttttgtgattccattgttaaatctcatggtttaatttttttat

SEQ ID NO: 51421 - DNA, 435 bp, Zea mays
  Clone ID: LIB3067-016-Q1-K1-B5
cctgaggtcacagttgacgagacatggttttctgatccacaaatttgtgaaacaaatcagcaatggtatattttgtccaagacgctggcagaggaggctgcttggaagttctcaagggataatggacttgaaatcgctactataaacccagcgatggttattggtcccctgctgcagcctacactaaataccagtgctgaagcaatcctgaagttaatcaatgggtcatcgtctacatatcccaatttttgctttggatgggttaatgtcaaaggattttgcccttgcccatatccttgcatacgaggttccctcatcaaatggaaggtactgcatggtggaaagagtttgtcactacttataactggtgaacatttttctcaacatgtatcctaccttttcttttttgactagtgtgtatatttattttctttt

SEQ ID NO: 51422 - DNA, 343 bp, Zea mays
  Clone ID: LIB3067-014-Q1-K1-F2
gcccgccgtccccgctgccggcgccgtcgcggttgcctgccccatgtgccgtggcgcggtgaccggcaccgtgcaagtgttcttctcctagcaagctttaggaaaggggaaaatgctaaaagaaaaagcaagacaaaatcgttgctcctgccaaaaggaatgatccgtgaaaatggggaattgttcatgatagtccgttctctgcttctttttttttttctcttcctctctcagttgtttattataatccttctattagtatataagtcgatctcttctagtactgctaggaataggattagtgtcctgctttattttcccttggtttcttctggaaagcata

SEQ ID NO: 51423 - DNA, 412 bp, Zea mays
  Clone ID: LIB3067-014-Q1-K1-F3
ctcctcctcgcctcctctccctagcctccacgactcaagggagggtgacggaaagcgacgcggcgcgagcgaggagggccaaggcgaagaggggaagcaccgcaccaggacccttgttcgccgtcgccgccgcctctgatctccgcgaggttgtcaggattcaatatgtcgaccagcacattcgctacttcctgcacgctgttgggcaatgttagaacaacgcaggccttccagacagcggtgaagagcccttcgtctctaagcttctttagccaagttacgaaggttccaagcctgaagacctccaagaaactggatgtcttcgccatggctgtatacaaggtgaagcttgtctggcctgaatgtgaagagcacgagtttgatgctccagatgactcctacattcttgacg

SEQ ID NO: 51424 - DNA, 231 bp, Zea mays
  Clone ID: LIB3067-014-Q1-K1-F5
atttgaattttttttctttctccttctccctcctccctgtcccttctcattcttttttctggtagttttgtccagaaatcgaatggtgtgtttatttgatttagttttcttaattaccgtgccccgtggtaattaattatgtacttacttatatatatatatacattactccgaagaggatggagcactttgtataatagaggaatggtgatcgtacttacgggtgtgggc

SEQ ID NO: 51425 - DNA, 297 bp, Zea mays
  Clone ID: LIB3067-014-Q1-K1-F6
caaatccacggtttaataacgaaccgtgtgtacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatctgtttttttagatttttgcaaaggtttcatttacgcctaattcatatcgagttgaccctgacgttgtgagaaaactgtaattcatgagttg

SEQ ID NO: 51426 - DNA, 341 bp, Zea mays
  Clone ID: LIB3067-014-Q1-K1-F7
gattaaagcttaatcttcttcctgtttcttatttccttaggagaatgcaatctctaacctgaatacagacgcacccatcgtggatagagcctgtcttgcacaagtttctttgtccccggtgccagtctataaaacaataagagaaactaagtgttaagtcatggtgtgtgtgctgtggaaaagaacaacccacatacacttaaggtaaatatatatttgtttagaagtacatttgtaattgtatcagaaccaaacaactatgcagttctgtttgaatggattccaggacaaaaaggaaaatttaaatttcaggaccaaacagccaacaattttaggacata

SEQ ID NO: 51427 - DNA, 409 bp, Zea mays
  Clone ID: LIB3067-014-Q1-K1-F8
ccggcgccgctgttcgagcccggggagctctagtcctggtccttctaccgcgcgggcatcgccgagttcgtcgccaccttcctcttcctctacatcaccatcctcaccgtcatgggcgtctccaagtccacctccaagtgcgctaccgtcggtatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacattatcatgcaatgcctgtgtgccatctgtggagctggagtggtgaagggctttcagcatggactttacatgggcaactgtttgttgcccaatgttgtcgcacctggct

SEQ ID NO: 51428 - DNA, 84 bp, Zea mays
  Clone ID: LIB3067-014-Q1-K1-F9
gcggcggtatgagttcaagaagacggccaggtaatgcgtcctcacgtcctatgaaatgccgtaaaggaggaacacggatgagtt

SEQ ID NO: 51429 - DNA, 407 bp, Zea mays
  Clone ID: LIB3067-014-Q1-K1-G1
tcgagacattgtattcgtcctccagcagaaggatcactccaaattcaaaagaaagggtgaagatctcttctatgagcacaccttgtctctgaccgaagcactatgtgggttccaatttgtgcttacacatctggacaacaggcagcttttcatcaaatcagaccctggtgaagttgttaaacctgaccaattcaaggcgatttacgatgaggggatgccaatttaccagaggcctttcatgaaggggaagctgtacattcatttcacggtggagttccccgactcgctggcaccagagcagtgcaaggctttcgagacagtactttcaccaaggcctttattcaagctgacagacatggaaattgatgaatgcgaggagactactatgcatgatgtgaacaacattt

SEQ ID NO: 51430 - DNA, 359 bp, Zea mays
  Clone ID: LIB3067-014-Q1-K1-G10
gcgacatgtgaaaactcatctagttcaatatggccttctatgctgcgtcggacctgtgatggccgactctaaccctctagtatgacgcacgctgttactgctgctctcctagatgaatgtatacgagaagacactcatggtatctagctcccagatcgaaatgtagccgaccgacaaggttgatggtgtaacaatggttatagataatgtgcttgagcaggctctgtattgagcttaccaacatgtccttatacatggacgaaaggtattcagcgatgtctccacattagacgaggatttagggactgacaataatgtcgttgttataatgctcagacagaacaagggatcatcaagtg

SEQ ID NO: 51431 - DNA, 268 bp, Zea mays
  Clone ID: LIB3067-014-Q1-K1-G11
cggacgcgtgggcggacgcgtgggggaagaatagaaacccacagtagatcagcataatcttcactgttacacttgcacataattccgtttgcaccttggatttagagtgtataataattgcataatcaacattgtataaattctcacagacgaaacgagaaccacacacgtgaaattttccgatgggagttgtgggttcttgtatcgaggggcaggtccaggatttaaaggatgggcattcggaaaaaatattttatatatttttttt

SEQ ID NO: 51432 - DNA, 370 bp, Zea mays
  Clone ID: LIB3067-014-Q1-K1-G2
cccacgcgtccgggcaccgacccaccgcccctttgctcgttcctttcgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggcgatgatgcgcccagagcagtgttccctagtatagtcggccgcccttggcacacgggtgtgattggtggaatgggccagaaagacgcctatgtttgtgacgaggcacagtcaaaaagaggtatcttgacctttaagttctccattgagcacggtttcgtgaacaac

SEQ ID NO: 51433 - DNA, 62 bp, Zea mays
  Clone ID: LIB3067-014-Q1-K1-G3
tcgagcatcggctgctataactttaaacatatttattacacaaacactgattcactataatg

SEQ ID NO: 51434 - DNA, 342 bp, Zea mays
  Clone ID: LIB3067-014-Q1-K1-G4
gcaaggagtgtgtggatcttcttttgaagcactgtgctgctgtaactctccaaaacctggacgggaagacacctatcgatgtcgccaagctgaataaccaggacgaggttctgaagttgctcgagaaggacgccgttctttgaataccatgcctttcgtatacactttggactctggtggcatggtttttttttatactcggtgtttttgtctggatagccacttgtattggtccttaaaatttggtttgcctaaatgcttttatcatgtgggtttatttaactggcctgttaatggttaccgttctgtgacttgtgtctttcccactttatatctgatact

SEQ ID NO: 51435 - DNA, 332 bp, Zea mays
  Clone ID: LIB3067-014-Q1-K1-G5
cccacgcgtccgcccacgcgtccggaaggcttcaaggccaaccacgccaagtctggtggctgcggctctggctgcggtggtggctgcggcaccctgttcagctccagcgctgcggccggccaaggccagtccagatccggcggctgcggctctggctgcggtggaggctgcggcagtggcagcatggtcgctgaaggctccaacggcgggcacgccaagtccggcggctgtggctgcagttgcggtggccgaagtggctgctgccgctgatgctgttgcagtggttgcagcaccttgtccaacgcatgatctgtgttgagtggttgcatttg

SEQ ID NO: 51436 - DNA, 264 bp, Zea mays
  Clone ID: LIB3067-014-Q1-K1-G6
cccacgcgtccgactagaggcacttgatgatgaagatgcatatttagctcaaagtgttttggatcatatgcaactaaatgacattgaggctgccgaaactgctaagctctggtgtccagtatgcaagcaaggatatctacgagaaacacgtaatctcatatactgtactctgtgtaatctacggcttgaccttggagaagataagatgactctggagttcttactagaacggttggccaatgcacatattgatcactttgacag

SEQ ID NO: 51437 - DNA, 231 bp, Zea mays
  Clone ID: LIB3067-014-Q1-K1-G7
cccacgcgttcgtccacgcgtccgcccacgctttcgcccacgcgtccgtccacgcgtccgggtctagatcgccgtcgtcgccttctactgagagaagggagatctgcactggcccgtgctgtaatttatttgttatccgtgttgagccgttgattcctttcttttgttcttcttcttttcaccatttgtttttctttcatccgatatccatattccattcggctttctatt

SEQ ID NO: 51438 - DNA, 339 bp, Zea mays
  Clone ID: LIB3067-014-Q1-K1-G8
cccacgcgtccgcccacgcgtccggttcagtttaaaactctggtgaaggtccttgaggtgaggtatgttatgacttatgagtagaagattacaaatatgctctttccctatgatggaagagtatattctgtaacagacaagcctggaaaccccactcaggtgaaatgtgccagagtaaattgaaaggggatcatttatgatgtgttctgatgcaatcctaatgtggtgaatggggaaaatcctttctgtggctcttcaactggggtcttaactctcatctcgtgctgacttcctgacctttcagtttaacatggagctgggctgtctttacgtcaacct

SEQ ID NO: 51439 - DNA, 192 bp, Zea mays
  Clone ID: LIB3067-014-Q1-K1-F11
aagacacatccagggacagaccgagcaacacatgaagctcttgctgtgacattggatgtgagattctataccccttgcgattactcacgcatttacgtagactttcacattagtactcaccggtattgcaacggttatgacacagtttgagccactgtgtctcgtactgttaactcgaaacctatcttctag

SEQ ID NO: 51440 - DNA, 257 bp, Zea mays
  Clone ID: LIB3067-014-Q1-K1-G9
cccacgcgtccgtccacgcgtccgtccacgcgtccgagaatacaacactcggcaaagccttggattccggtagtgcatattacaaccatttgtgtgtaaattgcttatttgagaccctaaacgaattctaataaaaaagttgtcaactacaaagattaataacttttgaagttctacaacttttattttgacacttttttcatcatccgatgtaatttgcaaatatttgaattttaaatttgacatacttattttca

SEQ ID NO: 51441 - DNA, 281 bp, Zea mays
  Clone ID: LIB3067-014-Q1-K1-H1
attctacagccaatggagaaaggatgcctgctctgagccatatgtgaaccgctatcaccaggtccgtgagtcatgaggcgactaggagaaccatttctgcagccaagggagccctagaagcccgagcggtagcagccggaggagggcttgatgatcatcttgctccgtctgatgcgttgatgaactgtccgttgtggcttaaccagatgcttcctgaaaacccagatatttgacggacgaagtgcccaaaccacagacacttggacctgtacatacccatt

SEQ ID NO: 51442 - DNA, 300 bp, Zea mays
  Clone ID: LIB3067-014-Q1-K1-H10
acgcgattgaaccgtgaccgtcagttggctggagaagtgtatgttaacatgtccagctcgctggtgtgtggtttcccttggcagtagtctaacaatcaacctgacaaaagatggggtgaccgcttgcccgtcgtgaaccaagccgggttttgttaatggtggttcgagtttaaacccatggtgtggtcggatcggtgtatgagactagtcgagaaatatgaagggggaaaaaacttgtacagcaatcttgtgcttgcgtggttggatgggagcccagcatgctgcatgcatctgtggcac

SEQ ID NO: 51443 - DNA, 412 bp, Zea mays
  Clone ID: LIB3067-014-Q1-K1-D10
agcacggagctgctgatccggaagttgctcttccagcgcctggtccgtgagatcgctcaggacttcaagacggatctgcggttccagagccacgccgtcctggccctccaggaagccgtcgaggcctacctcgtctgcctgttcgaggacaccaatcctttgtccatccactcctagcgcgtcaccattatgcccaaagacattcagcttgctcgtcgcatccgttgcgagcgctcgttttgcttttttgcgccctgcctctttttgctcttgaggattgtggttgtctttttttattctttatcttgttgtttcttttagtcttttgttaattatctattttttttccggttttatatttttttgttctttttttctttttgttttttctttttttttgttcttttgtttt

SEQ ID NO: 51444 - DNA, 226 bp, Zea mays
  Clone ID: LIB3067-014-Q1-K1-D11
aagagctcgaaggttgggattgctgtggccctcaagccctgattggttatcaagaccattttttccccttctaagttcctagcatgactgtttgggtcagatcagatcagctggggaaaacaaaactgttggggttcctggcatctttggtcgtagcagtcagttgatttaatgaactccgaaaaatgtctcatggaggaaaatttttggtcgcctgtgtagcgct

SEQ ID NO: 51445 - DNA, 132 bp, Zea mays
  Clone ID: LIB3067-014-Q1-K1-D2
tcggttgtaaaaaaaaaatactatatatagatattttaaaaaaaataataagaacaaataataaatgtttatataaaatataataattataaaaaaaaaaattaaattaaataaaaaataaatttaattata

SEQ ID NO: 51446 - DNA, 470 bp, Zea mays
  Clone ID: LIB3067-014-Q1-K1-D3
gtttttctttttagccgcctgatcaactttttctcttatgttcatcttcacaagaaatggagcagcaacatttggacgatccacaacctgttgcatccctacctgcaagcctgcacctgttgtctctctagctattgtggtatttaccattgtgccttgtgatgctctgctttatgtccatcgtcatgttcgtttgtttatgttttattatctttttatttttctttgttttttcttttttatttttgtttttgtttatttttttcttatttttattttattttatttatcttttcttatttttttttttattatttttttatttttttttattttttttttttttatttttatatttctttttctttattatatttattttttaatttcttattttattctttttattatttttttttattatttttttttttattatttttatattttattgtttctttattattatt

SEQ ID NO: 51447 - DNA, 376 bp, Zea mays
  Clone ID: LIB3067-014-Q1-K1-D4
gccgaccaccgtccgcacggtgctctcgctggcccttgctcgctcctggccaggtcaccagctcgatttcaagaacgccttcctgcacggcgccctcaccgagaccgtctactgctgtcagccggtggggttcgtggactcctctcgccctgacatggtctgccgactcaacaggtccctctacggcctcaagcaggccctttgggcgtggcactcctgacttgctacgttcctggtgaccctgggcttcgtggaggcctagtcagacatgtctttgttctgttcccattatggaacagagactgtctacttgctttcttacgtggatgacattgtccttactgtcttcatgtatgtctttttttttcgtcttgtt

SEQ ID NO: 51448 - DNA, 246 bp, Zea mays
  Clone ID: LIB3067-014-Q1-K1-D5
cccacgcgtccgcccacgcgtccgctcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgctcacaggcggagaagatcgtctaggacta

SEQ ID NO: 51449 - DNA, 176 bp, Zea mays
  Clone ID: LIB3067-014-Q1-K1-D7
cgcagatcagagagaccgaggcgcccgcggttctgctttccttccttgccccgttcacgagagaattttctggagtcttcgactcgagcagggttccgatggcgctgcaatggatgatcctggcgtgcgtggtggcggtggaagctgctgtggctgcgctggtcacgcttccggtg

SEQ ID NO: 51450 - DNA, 251 bp, Zea mays
  Clone ID: LIB3067-014-Q1-K1-D8
agttcgttttttttggtaacatctgtatggctcgatccgttttgtggactagtgacaacagtgtcttctgtcatttgtgacatggcaatggaaattttgtgatgttcctgttttgttttgagcaattgtacgacattgcctgctgactattaatatttattttattttattattatatttttttttttttatattatttttttttttttttttttattttatattttttttatttttttttttttatattt

SEQ ID NO: 51451 - DNA, 269 bp, Zea mays
  Clone ID: LIB3067-014-Q1-K1-D9
attcgaggacgcgcgttgctgctctgcggctgggaggatctagccggagagagttattatctgtcacaatggcctccagagatcacactggcttgacccgacaacttcttgattttcaacatgatacaatagatgaggtaggcgcaggacatgatccattcatggatttgaaagcgagattcatggactttaaacagagaaactatgtggaaaaattttcaaattaccaaaccctggctgagcagcaaacaccaaagttcatggtggtt

SEQ ID NO: 51452 - DNA, 358 bp, Zea mays
  Clone ID: LIB3067-014-Q1-K1-E10
agcttctcccgctcgatctccgccccaagaagacccgcgccattcgcaggcgcctgaccaagtaccagctctccttgaagactgatagggaaaagaagcgtgagatgtattttcccatgcggaagtacgctatcaaggcctatgattagtgaaagaacagcttttatcctatcaagtttctgtccataagtttcttgtgtttgatttacctttcatctatctgttattctatggtatgtttaaatctaatatgttttattttttcacttttatatatttttttttttttagtttttttttttatttattttattttttattttattttttttttttgttttttttatttttatttttt

SEQ ID NO: 51453 - DNA, 325 bp, Zea mays
  Clone ID: LIB3067-014-Q1-K1-E3
ctgcgaatgcttgaggatgtgcctcgcatatttgaggctgatttccagtgcactctcgagatgagtactaagaactttgaagattattctgagcaccgtctcaaatttttttctctgctccgtgcaaatggcacccattgctttcgatcattaattcagcttttatgcttgcttctgttttattgtgtttttttgagtttttgtgcgattgtgcttttcttgtgtgtttattatagactgttcttagtttattttcgtgaatttttaattactttttggctcttgtgattctaatatattttttctttttcttttttttttcttt

SEQ ID NO: 51454 - DNA, 318 bp, Zea mays
  Clone ID: LIB3067-014-Q1-K1-E4
cccacgcgttcgcggacgcgtgggcaactacgaggagttcgtcaaggtcatgatggccaagtgagtaaagcctgcggtaacggtatagtaccccgcgggaattgaaggaggaaaccaaaccgtgcatcgcatattagaaaggcaatgcatgtcttgtttccttcgttttccccatgaagaaaccgtactagctgtagctgctgaatcgttgagtccccctgctgccactcttatcttcatttgtgtcattgaaactccgtgctttctctgctgtgtgaaatctgacggctttgcgtgttttggacactgattgcagtt

SEQ ID NO: 51455 - DNA, 389 bp, Zea mays
  Clone ID: LIB3067-014-Q1-K1-E5
tggaaatgcttgaggatgtgccctcgctatttgtcgctgttgttccagcgcacgtctcgatatgatgtactgagaactttgaagattattctgagcaccggctcaaatttttttctctgctccgagcaattgtcacccattgctttcaagcattaattcagctttcaagccagcaattgaagcttgtgatcgattcgatgaattgggcgtttagacataccgtgagaaatatctctgagactggccttagtctatagttggaaattttgaagaactttgttgctttaggaattcataattcattattactatattctctttttgacattttatctagatatttttgctgtttttgatcagctcatttttataaattttgtgttttagtt

SEQ ID NO: 51456 - DNA, 450 bp, Zea mays
  unsure at all n locations
  Clone ID: LIB3067-014-Q1-K1-E6
aggtgaacctggagttgtcatccgaggaaagaaggtgatggcctcacgggtgctcctgctttctggcgatttgtgtccttacctgtgagtacctcatgttaaattattttaccanttgtcttaaatgattgctattgtacttaaagttatactgataagtcgtacgctctgtacttgaatgagatcttttggttgcgatcattatgtatgttcaaagtaatagatggactccatcttggttattttagtgttcgctagcagccttaatacctaatcaaattaggttcatattcgctttttagtttatcatgctcattcaaaattagctaccaccttttggaatgctattattcttttaactaattgatatgatttctggtttttgtgtgttactgtatgttttttgctatagttttatcctaacttttctattaatctattttattttta

SEQ ID NO: 51457 - DNA, 141 bp, Zea mays
  Clone ID: LIB3067-014-Q1-K1-E8
gctgatgttccaccgcttcaggctcaacacattcctgacggtcgaggcaatgctgaacgcgctctaaggcatggacggcaaggacctggaccgtctcatcatgatggtctacaaggctcaatcgcgcctatgactttttag

SEQ ID NO: 51458 - DNA, 287 bp, Zea mays
  Clone ID: LIB3067-014-Q1-K1-E9
cccacgcgtccgcccacgcgtccgcccacgcgtccgcggacgcgtgggttttggccaatgatgaatggaaggaggatattcttccagagatactggatggtcacaatgtttgccgtttttctggatccagatattcctgtaaggtgtgattagtttgattggttgtaagggctttttcttgtttaacatgctgcatatatttctttctattatttatggttattatcttttttattaccttaaggagattttttctcaaatttttatgttttaggcattattttttt

SEQ ID NO: 51459 - DNA, 325 bp, Zea mays
  Clone ID: LIB3067-014-Q1-K1-F1
tcggaacgactttacccaagaggaggaggatgagattcgcatggagaaccagtgggccttcgagtgattgttgtcttcctttccctggtgatagtggtggttcttttacaagaacacattgatgtctgcactgcactctacaatgctagtctatctacttaccaaattattgtgaaatagtagtatatatggtcgtgatggttgtatctctttttggattggatgtatgtcaagctggtgggtgctagttcgtctgtctggacttgttactagttaatatctcataatacatatataaaagtggatcttaaaaaaaataattttt

SEQ ID NO: 51460 - DNA, 406 bp, Zea mays
  Clone ID: LIB3067-014-Q1-K1-D1
atttttgccttcacagacgaggagagagttaggcaacgattggctttgtaccaaggtgtatgtccggttcaaatggaattttctgatgatgctgagaagacatttggcaatgctttgtcttatttgctgaaacatggtatggttaaggacggtaaggaggttgcacttgttcaaagtggtaaacattccatctggagatcacaatcaacacacaacattcaggtgaggaagatctgatgcggaacgcacatagtattctgattgttggaggacatcgtttcttctagcaaaccgcaaggtcttgttacaatgaaacttcactggtagtaagtactggtattggtgagatagttggtgctgagctagtgttgtgattcttttttttacctgtgcactagtgctgttt

SEQ ID NO: 51461 - DNA, 337 bp, Zea mays
  Clone ID: LIB3067-014-Q1-K1-F10
cccacgcgtccgccgagactacaattgagatcaaaatcaagacattggattcccagacatacaatttgcgtgtgaataaatgtgtgccagttcctctgttgaaagagaaaattgctactgtaactggaatattgtctgaacagcaacgcttgatttgtcgtgggagagtcttgaaggatgatgaactcttgtctgcttatcatgtcgaagatgggcatacattacatcttgttgttagacatccaggccagtcagctacatttggaaatgcagcaaccgaagcttacacatctaattctggccgtcgtcatgggcccacagtggcaagaagtgtatt

SEQ ID NO: 51462 - DNA, 467 bp, Zea mays
  unsure at all n locations
  Clone ID: LIB3067-026-Q1-K1-E9
gctgttctcctcaccgctcgtgctctctctctctctctcggcgccgactcggctaccgccgccggcttacggaagcttcccaggtcttcgtcaggcttttctccggcaacgagcaccctgcacagatcgtgaacctccacacctcaacgatagatggcggggttcagaagccttgcacccaagaccaggaacctggtggtggccgggggactgtctgccttcgtgctcggggtctactactacaccatgagagcggtgggaggcacggacgagctacaggtggcgatcgacaagtttgaggagacgaagaagcaggatgctgctagaaactccagctccagcgcaggaggatcataattcataagcacgcggacacgcnctggatctgctgcaagctgagtggctgacatggtacgacgacagtcacgtcgctcagtaggccatgaccatgcgttctgcttgtactg

SEQ ID NO: 51463 - DNA, 361 bp, Zea mays
  Clone ID: LIB3067-026-Q1-K1-F1
ctgatgcgcacaccgtgtttttcctagcaggcttgtactttggagctatttatctgtgcccggacagggatgatgcttccattatacagtagagtagtgttggtaatatgtacacattgttgagaacgttgtacttgaggcctgttgttattatacggcaatagtagattgtttgcggcaagcctcgttttttgtgcgtctaattctctgacttgcagaattgcggtggcaaatacccattgccctccaagttgtgcgttagcgtatttatccgtagttgacagcaatgaacatattactactgctttctgtattttctattaacgcatgcacatagtttattgggtttccatattttcaa

SEQ ID NO: 51464 - DNA, 445 bp, Zea mays
  Clone ID: LIB3067-026-Q1-K1-F10
cggaggcccggccgcagttccgccatcagccatcgaattcgatggcggccaacttcgggaacaagatccgcaacgccaagctggttcttcttggagatgtaggcgctggcaaatctagcttggttcttcggtttgtcaagggacagtttgttgaattccaggaatcaacaatcggagcagctttcttttcccagaccttagcggtaaatgatgagactgttaagtttgaaatctgggatactgctgggcaagagaggtatcatagcttggcccccatgtattataggggtgcagccgccgccattggtgtctatgacatcacaaatccggccttcttcacccgtgccaagaaatgggttcaagaacttcaagctcaaggggaatccgatacaatagtggctcttgcttgtaacaaggttgatatgctagatgcgaggcacgttgc

SEQ ID NO: 51465 - DNA, 461 bp, Zea mays
  Clone ID: LIB3067-026-Q1-K1-F11
cagagcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctgga

SEQ ID NO: 51466 - DNA, 383 bp, Zea mays
  Clone ID: LIB3067-026-Q1-K1-F12
cccacgcgtccgcccacgcgtccgatcctcgatcgggagacgcagaggtcccgcgggttcgggttcgtcaccttctccacggaggaggcgatgcggaacgccatcgagggcatgaacggcaaggagctggacggccgcaacatcaccgtcaacgaggcccagtcccgcggcggccgtggaagcggcagcggcggctacggtggtggccgtggaagcggcggctactgcggtggcgggcgccgtgatggcggcagcagctacggcggtggcggcggcggctacggtggctgcagtggctacggtggtggtggtggcggctacggcggtggcaaccgtggcggcggctacggcaacttcgacgggaactggaggaactgagcggt

SEQ ID NO: 51467 - DNA, 373 bp, Zea mays
  Clone ID: LIB3067-026-Q1-K1-F2
gcagatatacatacacgtacaagggctagacacttttttttttgcatgggcctctgctctgcgccacaccttttggacgggacggggcttgcttgtgtgtttaattttgtacctaggctgggaacatgtgtttggagggatggtgctgcttataaacattctttataccttgtattgtacacgtacatctacaagatgcgagtcaacccgttgggttgaagaactctccgagtgttttcttacattgtgtaagttttttttttttctttcagtttctgcaaaaagttctgagctctgtacatacattttggctaagaagtcaacctagttatggggatattgtgagcaattataagtcggttcatcgagaaaa

SEQ ID NO: 51468 - DNA, 460 bp, Zea mays
  Clone ID: LIB3067-026-Q1-K1-F3
gccgacaactctctaccgtccgagaccccaagcaccagcgcggcggcggcggcggcggcgacgcatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaagtttgcctagctgatcttcagggcgacgaggatcaagcttacaggaaaatcaggctccgtgctgaagatgtgcagggcaggaatgtgctcacaaacttttggggtatgaattttaccactgataaaatgaggtccctagtgaagaaatggcagacattaatcgaagcccatgttgatgtcaagacaaccgacaac

SEQ ID NO: 51469 - DNA, 358 bp, Zea mays
  Clone ID: LIB3067-026-Q1-K1-F5
tcgggaaaccctagtccgtcatatctcacgatccactctagcaccaatcctagggaaggtgaggagcgatggctctcggcgtggtgtcggcgaagggcggctcggtcgcgggcatgaagaaggggtcggtttctttaaggatggtcttcttatagccagttaaggacttgttcacggaagtcgtctctttttgtacgtttaagtatgtgactttcagaattgccgcgtcaaatacccattgccctgcaagttgtgcattatcgtatttatgcgtgattgactgcaatgaacatattactactgctttatgtatttgctattgacgcatgcgcatagtttattgggtttccatattttc

SEQ ID NO: 51470 - DNA, 455 bp, Zea mays
  Clone ID: LIB3067-026-Q1-K1-F6
ggttcatcgaagcgaagggaacttgcggcaagagcacctcttgttgtctcaaccctgcaagctatcagcggactaggtgactcagctttcgagaagaaccttcgccagttctttcctcttctcgctgggctcataagctgcgagcatggttctagtgaagtacaggtggccctgagtgatatgttcagcacttgggttggcccactcgttctccagtcctgctgatgctgaacatcatgttatacatagtagtatacatcccattgtgttcctcctttcctccattatgttatgctaatcttttagtcgctgggagttcatattgttgtgctgaactgatcatgcagatcaaattttcgttgacgttattttcttgttcgtatcgggaggagtgtatgtcactatagagaactgaattatgtacggtagtttagctaaaattgtgcccattctgt

SEQ ID NO: 51471 - DNA, 141 bp, Zea mays
  Clone ID: LIB3067-026-Q1-K1-F7
tcttccttccactcttctctcccactcttcctaaaaaaaaaaaaaaaaaaaaaaaaaaaaaaaaagaaaaaataaaaaaaaaaaaaaaaaaaaaataaaaaaaaaataaaaaaaactaaaaaaaacactaatatctcaaaa

SEQ ID NO: 51472 - DNA, 397 bp, Zea mays
  Clone ID: LIB3067-026-Q1-K1-F8
cggactcgtgggctgggcccttccatgatacagcagatgcagcagccttgcaatgagtgcaaggggactggagagagcatcaatgagaaggaccgctgcccagggtgcaagggtgagaaggtcgttcaagagaagaaggttcttgaggttcatgttgagaaggggatgcaacacaaccagaagatcaccttccctggtgaagctgatgaagcgcctgatactgtcactggagacattgtattcgtccttcagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtg

SEQ ID NO: 51473 - DNA, 74 bp, Zea mays
  Clone ID: LIB3067-026-Q1-K1-F9
aaaaaaaaaaaaaaataaaaaaaaaaaaagaattaactaaaaaaaaaaaaaaaataaaaaaagagtagacatac

SEQ ID NO: 51474 - DNA, 313 bp, Zea mays
  Clone ID: LIB3067-026-Q1-K1-G1
acgcgggagtccttgtctatcttgagcatcgaatccttgctgtagtgtttatcagtctgcgactcagcatggcgtgctgttgatatctgacaatagcaatgtgtggatgtgttgtgttgtgttgtgagactcagatgtaagctttgtggagttcatttccacgtgtgtgggaaaagtgtttggtttgaatcgaacaataatagtgcatataataatataacttgcagaatatgaaaagggaaatacccattgacctccaagatgagcgttagcgtctttattcgtatgtgacagcaatgaacatatttgtact

SEQ ID NO: 51475 - DNA, 434 bp, Zea mays
  unsure at all n locations
  Clone ID: LIB3067-026-Q1-K1-G11
gatgccgccggtaagaccaccatcctctacaagctcaagctcggcgagatcgtcaccaccatgcgcaccattggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgaggatgagctgcgtgatgccgtgctgcttgtatttgcaaacaaacaagatcttcccaatgctatgaatgctgctgaaattactgacaagcttggtctgcattctcttcgccagcggcactggtacatncagagcacttgtgctacatctggtgaaaggttgtatgaagggct

SEQ ID NO: 51476 - DNA, 371 bp, Zea mays
  unsure at all n locations
  Clone ID: LIB3067-026-Q1-K1-G12
gccacgcgtncggcctgtgattcaaaagatcgggctgtgggggtcgatcaaggctcttgcccggggctaccagatcctaatggggcttctcctgttcacgcccattgctttccttgcctggttcccgttcgtgtccgagttccaaaccaggatgctgttcaaccaggccttcagcagaagtctgcagatcttccgtatcctgggaggacacaagaaagaccgaaggacgcggatcaaggagtagtagggctgctgattgaaggtccgtctatcgggagttatgtcgtcctggagcggtctatcaggttcagagaatattanggtccgtatgtatgtatgtgtgtgtcgcacctagcaccagtagtatgtat

SEQ ID NO: 51477 - DNA, 459 bp, Zea mays
  unsure at all n locations
  Clone ID: LIB3067-026-Q1-K1-D11
aattgttaacaatctaatgaaagctccagaattggctaccaagatgccagaatttaaccaaggaatgacccaaggaagtgttaatggaaaaattgtgaaccaaggcagtgaatcaactttggaactcttagggacatggaggaggaaatcgaagaggaggttgacaaggttcttgcttcagtagcaggggagactgccttccagctaccagatgctgccagaacacagaagatacatgaggcttcaacaagcagggttccagaagagcgacaagctgttgcagagggtgctgatgacgacgaggaagacctagaagagatcagggcacggcttgctaaagtgaggtcgtaaatcatatacatatctgagctttctaacctggtgagcccatggctcaacaaatatggtgccaaaacccgtgtattgtgaactgagtcgatgacaatgcannatttttta

SEQ ID NO: 51478 - DNA, 317 bp, Zea mays
  Clone ID: LIB3067-026-Q1-K1-D2
agatattctctgcaaaaagagggcacttgaagttcgccattcaatctcaagagttctttaggactctgcaacggtactacagtaatgcctatatggatgcttacaaacaagcagcgataaacttatttctaggatacttccaaccgcaggtgggaaaacctgcactttgggagccagaatctggtgacgagcatgtacttgatgacgagacaaggtaagctagcaatatatacctatgcttgaacttacagggttaagtatgctcctaataaaagaacaatatacgctttttaatcgacaacatttgaataatatgt

SEQ ID NO: 51479 - DNA, 382 bp, Zea mays
  Clone ID: LIB3067-026-Q1-K1-D3
cccacgcgtacgcggacgcgtgggcggacgcgtgggctagaaggccagcgagtgagtgccgtgcgcacgcagctgcggcggccagtgcccagtggatcggcgtgcgcgcgtggcggggtagtcgctcgcgcgcgtacatggcagtatgacacgggattttgctgttcagtacactacggttactggcgtctctctctgtgtgtgtgtgtcgtacgtagcccggtacgtatctagcagtgactgtcgcgtggacttgtacggtgcggtctgcgagtgacgtgggctaaataaagtgtgcgtcgggtggtaatggtggtggggcccggtgtcagtggcgcagtgccccatgcctgccgcggatgcagcttgttgtgtcttgtgt

SEQ ID NO: 51480 - DNA, 199 bp, Zea mays
  Clone ID: LIB3067-026-Q1-K1-D4
cccactcgttcgcccactcgttcggtccaagtagccctaatcctcatgcataatgacactggcaattgagaaggattgcatgagccatccctataattatgtcattcatgctgtgatcgtattagatgatgaaacaaaattcgaaccttccgctggtctgttgttgcaacagttcatatgcaataggtttttaatgggt

SEQ ID NO: 51481 - DNA, 451 bp, Zea mays
  unsure at all n locations
  Clone ID: LIB3067-026-Q1-K1-D6
agcaaccgcagccgcgagggccaagcaggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcactngtccttggtgcggttggaatatactttgctttcaaaaatcacaatgagagtgggattgccaatctttacagcctgcactcttgga

SEQ ID NO: 51482 - DNA, 452 bp, Zea mays
  Clone ID: LIB3067-026-Q1-K1-D7
aagaagggagagagaggcggcggcgacggctagggttacgcccgccgaagttgcccacgcgggaggctcttcaagcttatgttctataacatggaggaatccagtttcagcaaaccaactgtcaaaagacttttggaggacgagctacgaaagctaaaacagctgaagcttccaaatgatgaggttgagagaatattagctgacctgggacatggtgcctgcctggacaaaagttcaacccataacagcaaagcgaagaagggagaccaaaatcacatcagaggtatcaccaccacggctgctccatctggatctttggatcccactgcttccaactgcatgaaagaagcagaagacaatgagcttgaatttgccttggcagtattcttaggacggattcatagaaattgcaccaataatggggagttatgtacggagatgaaagccctaat

SEQ ID NO: 51483 - DNA, 276 bp, Zea mays
  Clone ID: LIB3067-026-Q1-K1-D9
aaaaaaaaaaaataatatacaaacaatacattatcataaaaataataaaaaaaaaaaaccctggtggagaaccaaaaaaaacttaataactaaaaccctcttaaaataaaaatccaacctttcaaaagccaataatcgggattatcattcacacattcaaattcctaaattacctaacttatccgaccatgctcaccttcttctaccacaaatcaatgatccttccccaattttataaatttactgacatgctaatattcacactttcccaaatta

SEQ ID NO: 51484 - DNA, 442 bp, Zea mays
  Clone ID: LIB3067-026-Q1-K1-E1
caaatgggcctgtcacaggaagggctggtgatgtgcttgctgctgccaacacagcagcagaagtcgcaatgcggcttgtgagacctgggaagaaaaataaggatgttactgaagcaattcagaaagttgctgctgcttatgattgcaaaattgtggaaggtgttcttagccatcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaaagggccgtagacaagaaatatcacttgaagatgaaagcgtcaaggtttattttcagtgagatcagccagaagttcccatcatgcctttact

SEQ ID NO: 51485 - DNA, 464 bp, Zea mays
  Clone ID: LIB3067-026-Q1-K1-E10
aagagaccaggccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaactggttaccagtgttatccatctatctatctatct

SEQ ID NO: 51486 - DNA, 193 bp, Zea mays
  Clone ID: LIB3067-026-Q1-K1-E11
cggacgcgtgggttcagggaaaatgagtcaccttatggagtgacgtttagttgccttgtaaatgcctcaatctgagcccttttttgggtttatttctctgcaaatgtatgtttctaaggtagtgtgttgttaatgttaatgattctacacctttctgtgacagttttgcgaataagaggagcacctcatcctt

SEQ ID NO: 51487 - DNA, 261 bp, Zea mays
  Clone ID: LIB3067-026-Q1-K1-E12
cggacgcgtgggcggacgcgtgggggcgaattcttagacttggttaataagtaatttgtgagtggcgtattcacaaaggattttgtcgtatactaacaatgcccatgcatgtttactccgtaagtgcattcctaatcatgaagattatccaggatactacgagcataacaggattcatagggcaaaccacatgccgattctacaacgggcttaaaatccccgacattatcaacgatcaacctttaccccaacctgctctga

SEQ ID NO: 51488 - DNA, 90 bp, Zea mays
  Clone ID: LIB3067-026-Q1-K1-E2
cgacgcacattgtatcggcccctttagcgcggctgacgtggtgattacacgcaacacatacgttgctcttgacatgggcctaacacacga

SEQ ID NO: 51489 - DNA, 281 bp, Zea mays
  Clone ID: LIB3067-026-Q1-K1-E3
ggcattgtccatatgatgttgtgccgtgttataatggggaacgtagaaatagttcaccctggatctgagcagcaccaacctagtagtgactattttgatagtggagtagatgaccttaaaaacccacaacattacattgtgtgggatatgaatctgaataggcacatctatcctgagtttgtagtctccgttaaattgcctcctaaatctgatgattacttcgtatggcaagacgactgtcagaattcatgtgatctgtcactggttttgatatccagttc

SEQ ID NO: 51490 - DNA, 420 bp, Zea mays
  Clone ID: LIB3067-026-Q1-K1-E4
acggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacagtggtggccgtggaggcggcggctacggcggtggcgggcgccgt

SEQ ID NO: 51491 - DNA, 270 bp, Zea mays
  Clone ID: LIB3067-026-Q1-K1-E5
tcaatcatcgttctcttaatattagctaagcctcgggctcggccgctacatcatcagccggcatctactactacagatccacatgacttctttaaacccttcatcgtaacgagatcagatatattattatatgtcaagagagccccaaaatggttctatgtatgtctgaaatctacctacttgaactgatgaaaatatattgtatgaatatttttgcaccatatgcttgttaaataaagactaatatgactaaatcgatcaaaaatttat

SEQ ID NO: 51492 - DNA, 384 bp, Zea mays
  unsure at all n locations
  Clone ID: LIB3067-026-Q1-K1-D1
cccacgcgtccgtgaagaagtacgggagaggggactggaggaacatctcgcgcaagtacgtgactacccggacgccgacgcaggtggctagccacgcgcagaagtacttcatccgcctcaactccggcggcaaggacaagcgccggtccagcatccacgacatcaccaccgtcaacctccccgacgaagaccgcggcaacgcgccaccgtccgcggtcaccaccactaccaacccctccgtcgccctcccggacatgaagcccttcattgcgccgctccaagacgcgctcggcgtgtcgcacccctacggcaacgtgaagctggagcctaagagctcgctggtggccggcctgggcttcaacgactccgtcctnctgatgcact

SEQ ID NO: 51493 - DNA, 120 bp, Zea mays
  Clone ID: LIB3067-026-Q1-K1-E6
ctctagtagaactgtagaagatgtagttatcagtatctcttttgtattattggcccacgtttacttctcaatcgaatatttatgcgagggatgtttgtcaacgccttaggcttcatcttg

SEQ ID NO: 51494 - DNA, 415 bp, Zea mays
  Clone ID: LIB3067-026-Q1-K1-E7
cccacgcgtccgcagtcggctaggtaatctggtggtacgacgacatggcggccaccagcagcgaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggtctcgccacgccgtccgactgctagcagtgtgctagccaagccaagc

SEQ ID NO: 51495 - DNA, 417 bp, Zea mays
  Clone ID: LIB3067-026-Q1-K1-B5
cgtgcatgtgctcaagagagcatcgcttattgtcttcatcctctcctctgttatcttcgtcagtgctcttacgatgggtgtcgttggaacccagaagagcatttcgatgatcaacaatcacgaatatatggggttcctcaacttctgcgagtaactcaaacaccatcagactgtcgatccatccgggagaatccaggccaatgcctaattgacctcatctccctcaaaatctagaagaataaagtcgccgagtatgtgcacaagttagctcctcgccaacatgtgcgcatttagaccgacagagtcgctgtagtgaattcagctcgtgttagctcctggctaacgagctgaccatacggctttagttttgtgaagtgggcgcgatttcgtcatgtcatgcatgtgttagctcctggc

SEQ ID NO: 51496 - DNA, 454 bp, Zea mays
  Clone ID: LIB3067-026-Q1-K1-B6
cccacgcgtccggtgcatggcatcctgctagggtctcctatacagttgcccgtgctggtcagaacgggtaccaccaccgcaccgagatgaacaagaaagtttacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagagggtggtgaccctccgccagtccctcctgaagcagacttcccggctggcgctggaggagatcaagctcaagttcatcgacacatcgtccaaatttgggcatggtcgcttccagactaccgatgagaagcagaggttctttggtaagctcaagggcgtaggtgctgcggtgcatcgacaagtcccatttgtcaaaat

SEQ ID NO: 51497 - DNA, 450 bp, Zea mays
  Clone ID: LIB3067-026-Q1-K1-B7
cccacgcgtccggcagctcgtccccttccccccacttcttcctcagataaggagaggccccaggccagagaaaaaagcatcgaatttccccccccgttaattggcctgagccctcagccgtctaccagcagcagctagaggcagacaagctaggttttactgcttcattgagcacaaagatccgctgacctcttggtaaaaatccaaccttttttgtattgttttcttctgggaaaacctccttgtggtgcataaactgcgtagtacactctacaatttctggagaggaagctgagaactactatccatatctggcacgacccttgtcaagaaccatggctgttcacttgccatgaagctgcttgaactggaggcacctaaatgctgtggattgttcctatgcagatgatcggatcagtggtttcaggctccggggggttcgatcagatg

SEQ ID NO: 51498 - DNA, 289 bp, Zea mays
  Clone ID: LIB3067-026-Q1-K1-B8
actcttacttagactctcgcttctgtggcatcatcagcttcacgtcaggacagtcttctgctgcggcatgagcgttttttaccctggctgcgataaccacttctgttcatgtcaagccgaaaggcgtcttccccatctgctccagtctctgccgtcctatgatgggctgctcgccgtcatctcatgctttcatgatgatgatgcctccgaacatgatgggcgtctctatctgtttacccagcatgggccagatggtccgtcacccccacatggttggctgctgcattcc

SEQ ID NO: 51499 - DNA, 461 bp, Zea mays
  unsure at all n locations
  Clone ID: LIB3067-026-Q1-K1-B9
gcacagtccattattgccgtctcccttttgcgtgagcaaagaaagagagcgagaagagcagtcgccatgtctggcatcatccacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgacggcggccacagtagcagcagcagcgacagcgactgagatctggtgtcgcagatgtcgatgctggcttataatgcagcacaggtgcaacacangtatgctngctggatggaggattcata

SEQ ID NO: 51500 - DNA, 291 bp, Zea mays
  Clone ID: LIB3067-026-Q1-K1-C1
ctttcagtctgaatgtaacggtaacataaccattctttactagaacatttattttttccgtgattgacaaagcaccccacatggtctgtatcatcaggaaacatatacatcgtataaaaaacatcagaaaaaggaaagatttgcagttcaaaaaaaaaaacattaaaaaaaaaagaataaccaaaaagaaaacaaaaaaaaaagcctagccatcaagacatacaaaaataacaaaccctatgtctaaaattccagacatgtaatcgcttattgcacgccatacaagacacg

SEQ ID NO: 51501 - DNA, 470 bp, Zea mays
  unsure at all n locations
  Clone ID: LIB3067-026-Q1-K1-C10
tcgcccacgcgtccggatgatgttaagcgcaagagcagaagcaagagtagaagcaagagcaggagcaggagtagaagccgctcataccacagttcttcacctgcccggcgcagtgctagccctcccaagagcccaccgccacagaggagccccactcctgaaaagcatgccaatggaaaagattcacctctgtcacgcagtgtatctccatcaccgaagcgtgcaagctcccgcagcccaggcagcgatagcaaggaataaagcttgttgatctggtgatgcttaaagagcagtcttcccatgggattgcagaacgttgagaaggctgtttgaatatgatggcagtaccaatctgcaatcaaccgctatccaaggttgctagttcttttaatgacttctagaattgtgttttccagttgtcaaaatatgctgntggtttgtatttcgacctctattgtctttttataccc

SEQ ID NO: 51502 - DNA, 459 bp, Zea mays
  unsure at all n locations
  Clone ID: LIB3067-026-Q1-K1-C11
agctgctgcaggcgctgtccaaggaggaggaggccgtgcgggcgcgccttcgccgncggggccgcgccttccgccagtccgcgcacaacgtcctcgccctcgccgccgcgctcgagattgttgccgttggatacgccatcatgaccacgagatcgccggacatcagctggcagatgagggcagtcagggtgctacccatgttcttggttcctgctctagctgctctcatctactcgaccattacaaacctcacgaaaatgcttgacaacagagaccaacaaactcttgaaaagctacgaactgaaaggcaagccaagattgacgaattgaaggagagaacaaattactacactactcagcaacttatacagagatatgatcttgacccagctgcaaaggcggcagcggcaacagttttggcatcaaagttgggtgcggattctggactgagagtctttt

SEQ ID NO: 51503 - DNA, 422 bp, Zea mays
  Clone ID: LIB3067-026-Q1-K1-C12
gtttatgacgtgcgctttttttatggcaaaattggatctgttaacatgtggagatggaaattacccggaaacatgagcttagcgtggattttaccattttgaggtgttagaaaagcgtgctgcctattttagactagatatacagactaaaacatatggagccccacatttcgggtattgtcaagttgtgcgtttcactttcaaaatagtgtaagggccttgtgttttttttcttcttctgaatttgttgtaaaatagtctagcatcccttgcaaagagggggtaatgttgttgtcacatgatggtgtgtaccaaagtgtagtaaagcatcccttgcaaagagggggtggtagtgtcctgtatgtttttttaagcaaatgtgacaaactatataagaaatgaatatttcatgtgagttatgt

SEQ ID NO: 51504 - DNA, 213 bp, Zea mays
  Clone ID: LIB3067-026-Q1-K1-C2
acgcccactcgtccgcttatgaacaatcttcactatatggttacgtctgttagcaaatcagaatggaaaagtatactcggtggtgagtggattcagagacaccgtaagatcgtgcagcaaaacgcttatcagtacatgagggtatcatgggcaaagattttccagacactctttattcaatgtttatagtggcattatttcttcattaccatt

SEQ ID NO: 51505 - DNA, 393 bp, Zea mays
  Clone ID: LIB3067-026-Q1-K1-C3
ggattacagggatcatcctgcttgtttcaactctcataggggtttgcttgcttatgaacatgccacttaccagggacaccctcctgtactcgaatgtcaagatcgattagtttgaaggggtgttcgcggcagccactcttggggttcaactttggccttgtgtatttatgggatggatttcagatggtagagacgtatgcttgtgctgttcacaaaaccagtgtacaatgtgatactaggtgctacgtgcctttctttttttaatctgtgctgcactcttgcctgtatgggctgttttgttgttgggttccggtaaataatccagaacagtggcacaaacgattagttgttgcatgctactgccttttctgaataaatctgtcattgtaatcg

SEQ ID NO: 51506 - DNA, 444 bp, Zea mays
  Clone ID: LIB3067-026-Q1-K1-C5
ccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataataaatggccgtgtgggtactcaccacgatgctcactgctgcgttctcataca

SEQ ID NO: 51507 - DNA, 304 bp, Zea mays
  Clone ID: LIB3067-026-Q1-K1-C7
aaaaaaaaaaaaaaaaaaaaaaaaaataaaattaaaaaaaaaaaaaaaaatgaacatgcggaaggaaaacatacacactagctgaactaaaatttcaaaaatctattaatttcaattgttcttcctaagttcacactattgcccttcaacttttcaacttgcatattactagaatccttcccatataatacctacgtatccttccgctgttcaccttttcagcgtacaacgtgatactatgtgctaccttcctttctttccttaatctgtgctgctctcttacatgctttgactgttctatccc

SEQ ID NO: 51508 - DNA, 277 bp, Zea mays
  Clone ID: LIB3067-026-Q1-K1-C8
cccactcgttcgcccactcgttcgaaaaaaaaaaaaaaaaaaaaaaaaaaaaaaaaaaaaaaggaaaaaaaaaaaaaaaaaaaaaaatataaaaaaaaaaaaataaaaaaaaataaaataatatatagagactccttaattcatccaaatttccataccttttacatcgtaagccactggtataacactggggttcccaattttaatcagtctggccgcatattcaaaattataccatctggtataactctcaaagtttcccaattcatatcgcttt

SEQ ID NO: 51509 - DNA, 342 bp, Zea mays
  Clone ID: LIB3067-026-Q1-K1-C9
cggacgcgtgggaaaaaaaaaaaaaaaaaaataaaaaaaaaaaaaaaaaaaaaaaaaaaaaagaaagaaaaaaaaaaaaaaaaaaaaaaaaaaaaaaaaaaaaaaaaaaaaaaaaaaaaaaaaaaaaaaaaaaaaaaaaaaaaaataaaaaaaaaaaagggcgccccttttaaaaaatcaaatttttcttaccgttactttaaattttaaaatttttttaaagggcccccaaaattaaatttattgccccttttttaaaaacttttaatttggaaaaaccttggttttcccaaattaaatccctttaaaaaaaaacccttttttccaaattggcttattacc

SEQ ID NO: 51510 - DNA, 456 bp, Zea mays
  Clone ID: LIB3067-026-Q1-K1-B4
cccacgcgtccgagaacgggggcggcaaaagcggggccaagaacggcaagggcggcggcggcggcggcggcgtcgttgccccgggcggcgggaaccaggctgggcagggcaagccgaaaggcggcttccccggcggcgccggtctcggcgggccgatgatgggcggcgcgccgccgccgcatgcgggcatgatgatgaggccgccgaacatgatgggcggcgcgggcggtttccccggcatgggccagatgggcggccacccccacatgggtggcggcggcatgccgcatgcaggcgggggcgccgcgcacggcatgccggctggtggcagcatcagcatggccgctggcggaatgcctggggccgggttctttccgcgcggcgttggcggcggcatgccggccggcgcggagatgctgggcatgtcgcagctgcctccgcagcaacagcagcaca

SEQ ID NO: 51511 - DNA, 328 bp, Zea mays
  Clone ID: LIB3067-008-Q1-K1-B7
cccacgcgtccgcccacgcgtccgcccacgcgtccggcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgacgtgaacgtggtggccaaccttcagcagcagaacgtgcgggtcgtcgtcgacgtcgccggctcgcgcgtcggtttcgcgagggagccctgcaactgagcccctgaattcgtccgtgccctatgcac

SEQ ID NO: 51512 - DNA, 377 bp, Zea mays
  Clone ID: LIB3067-008-Q1-K1-B8
gcagatcgtcctgagctctacaaacagaaactacaggccaataatagcttaatttttagagtacaaaaatctgttatttgcctgatagtttatctggagcagtttcattttacatatgactgtaatttgtgagaatgtacatcttacgatttttgttgaccagtattcataggtttttagttagcaatgtgttgttggcccgttgctagtccttgtaatacaagcccacctgtttttttttgcgcatggcaagacttaacctggaaacattttgtagtacattttattttgtatcacctgctctatacacgagttttcttggaacatcggaaataataatgccctccagtatcttgcgaccaaaaaaaaattaaagg

SEQ ID NO: 51513 - DNA, 413 bp, Zea mays
  Clone ID: LIB3067-008-Q1-K1-B9
gagagaagaatggaaagagaaagggagaaggaaagagtacgaatcggaaaagaacttcttgaagccaaaagaattgaggaacaaaatgaaaggaaacgcatgatagaattgcgaagacttgagaaagaggaggagaaaagagctagagaaaaaatccgccagaaattagaagaagataaggctgaaaggagaaggaaactaggattgccaccagaagacccagcagctgccaaaccaagtgcaccacctcctgttgaagagaagaagagtgcattacctgtcaggccagccacaaaggcagagaggatgagggactgtctaagaaatctcatgcaacagaataaggatgatgatgccaaagtgaagagggcatttcaaacactgcttacttacattggaaacgttgctaaaaa

SEQ ID NO: 51514 - DNA, 351 bp, Zea mays
  Clone ID: LIB3067-008-Q1-K1-C1
caggaaaatattttgtctctgtttttttcagaatagttatgttccacctgactggctcattcttctacaagtggttctgaaaagaataagtactggagatgaaaatgagtctgctcttctgttcaagcttctgggcacaatagttgagggtggacaggaaaaagttctgtctcatattcctaaaattgtatccaacattgccagtactgtaatggagctcctgtcccctgtcccagatccttggcctcaggtagtagtgcatctttcttctgtgtggtcaatattttggtactttatcatgatgaccggctggaggaacaccgggcgtgtatgagtgatcaagaacaggga

SEQ ID NO: 51515 - DNA, 250 bp, Zea mays
  Clone ID: LIB3067-008-Q1-K1-C10
aggccaggctcaccgaggggtgctccttccgtcgcaagggcgattaggtcctgcttctcttaacgtgagaagagataaatttggtgttttgcaactttctcaggatatgtactcggtgaggatttagttaattattatggctgttagcgtagcctgactatgcttgtgtaaacctgaactccgtgtgagcgtagtgccagctaatatggtgctgcttgtcttttgctgagggtgtgactttgcatttgat

SEQ ID NO: 51516 - DNA, 438 bp, Zea mays
  Clone ID: LIB3067-008-Q1-K1-C12
cggacgcgtgggctacaacaagagagtattattccaagcttgtgaaggctgatgttcatggcaaagaccaagaaatatactgcattaaattgcctgggaaccccaagcttggtgaaggcaaacctgagaaccaaaaccatgccataatcttcactcgaggagatgcagttcagacgatcgatatgaatcaggataactacttggaggaagcaatgaaaatgagaaatttacttgaagaatttcataatgctcatggaaaacatggcatacggaagcccacaatcctaggtgtgagggagcatgtattcacggtgagtgactcttcgctggcgtcatttatgtccaaacaggagactagttttgttactttggggcaacgtgttcttgcttacctcaaattcgaatgcactatggacattctgatgtttttgatcggat

SEQ ID NO: 51517 - DNA, 211 bp, Zea mays
  Clone ID: LIB3067-008-Q1-K1-C2
ccaataattaagtgcactcctatggctcggactctatgaaaaaggacctgactactcattgggtcatatataatttatataaagaaaacctaaaacattaactaaaacatatataaattaactaaaaacctcaaatacatataataaaaaatattacgaccacaacatatatagtttcagattgttactaagtttcaatcatagttataac

SEQ ID NO: 51518 - DNA, 366 bp, Zea mays
  Clone ID: LIB3067-008-Q1-K1-C4
cgccgtcgtcttctgcggttctgccgtctactttccaatttggcctctctcccttgcaagtgtaagcttcatcttcagccatgggtaaggagaagtcccacatcaacattgtggtcattggccacgtcgactctggcaagtctaccaccaccggccacctgatctacaagcttggaggcattgacaagcgtgtaatagagaggtttgagaaggatgctgcttttatgaactagcttgcctttaagtttgcttgttttgctttcttagtttattgttgtttgttatatgtttatttttcttttgttttttgttcttgttgttttttatttttctgtttcattttcttttttttttttttttcttttt

SEQ ID NO: 51519 - DNA, 334 bp, Zea mays
  Clone ID: LIB3067-008-Q1-K1-C5
cccacgcgtccggaggtggaagtgtggcttcagacaataagtccaggtcaaaggacgccaatgcacaggcattcctgtgaagaagttttcactgtcctcaaagggaagggtacgctcttgatgggatcaagctcactaaagtacccagggcagccacaggaaattcctttctttcagaataccacattttcaatccctgtaaatgatccacaccaggtttggaattctgacgagcacgaagatttgcaagttcttgtgatcatatcgagaccgcctgctaagaatattttatatgatgattggagcatgcctcatacagccgcggtactgaaat

SEQ ID NO: 51520 - DNA, 145 bp, Zea mays
  Clone ID: LIB3067-008-Q1-K1-C6
cgacaagccaatcgaagccgagatacggccatggactccaccggcaccggagcagggggtaaggggaagaagggagcggccggtcgcaaggtcggctggccaaggaagaagtcggtgtctaggtccttgaatgccgtgctccagt

SEQ ID NO: 51521 - DNA, 197 bp, Zea mays
  Clone ID: LIB3067-008-Q1-K1-C7
cctcctcaacctccagcccaaccttcagcccgtaatcgagagcaatggcgctcgccaaggccaaggagatcgttgcctccgctcccctcgtcgtcttcagcaaaacttcctgccctttctggctcccggtgaaaccattggttcaagaacctcgaaccaggctacaaggccattgatttgaataaggaaggtgttgg

SEQ ID NO: 51522 - DNA, 197 bp, Zea mays
  Clone ID: LIB3067-008-Q1-K1-C8
gaacaacaagcacaccccaccagcgtcacagcatgacgaccaagctgctgtcagctcgttgcagccttagcttggaatgtgttgcatgggttgttatatttatgatgaggaataaatttaattaactttgcataatttccaatgtatttgagtgagccgagataaacgtatgagacttgtggatacaaatggctaat

SEQ ID NO: 51523 - DNA, 431 bp, Zea mays
  Clone ID: LIB3067-008-Q1-K1-C9
caaagagactgggagattcagatccacacacatccgcatccctctctcctcggtttcctctcccaccaccaacccccagatcgcagcgatctccgccgccgccctctcagggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtgtggaagga

SEQ ID NO: 51524 - DNA, 317 bp, Zea mays
  Clone ID: LIB3067-008-Q1-K1-D1
cccacgcgtccgcctctctgttttccaaaggtttcaagaacacgagcagccagatcacggcggcctacacctcggacgggcggtacgccgtgtgcgcgagcgaggactcgcacgtctacctgtggcggaccacccgggtgccgtctgccgcggccatcggcatcggcatgaagcccaaggcgtggtgcaccatccgctcctacgagaacttctactgcaaggacgtgtccgccgcggtcccctggacgcagtcgccgtccccgccgggcgccagcgacggcagccccactggcagcagcccggcgtcggctgacaag

SEQ ID NO: 51525 - DNA, 411 bp, Zea mays
  Clone ID: LIB3067-008-Q1-K1-D10
gggattcggaagagtatagaagcacgtacgaaacagttgctgcctttatatacccagattgcaatacggtttgctgaattgcatgatacttccctaagaatggcagctaaaggtgtgattaagaaagttgtagactgggaagaatcacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggtgcatatccaaaagcttatggctcaaaaagtgtctcattcgctctctgat

SEQ ID NO: 51526 - DNA, 421 bp, Zea mays
  Clone ID: LIB3067-008-Q1-K1-B5
cccacgcgtccgcccacgcgtccgcccacgcgtccgacctggtacaaagaaggtcggtgggatgccagacaacttatagcttctggcgggatgccatcatcccactcagctacagtgacagcactttcagtggctgtgggaatccaagaaggctttcgtagtgcaacatttgcaactgcactagtctttgcatgtgtggttatgcatgatgcttttggagttcggttacatgccggaaagcaggcagaggtgctgaatcaaattgtctatgagctgccagaggaacacccattatcagagacaaagccactgcgtgaaatccttggacatactgttcctcaggttgtggccggttgcatccctggaatacctatggctgtcgttatgcttttgtcttttgggaggtcttagtcaagtgttg

SEQ ID NO: 51527 - DNA, 299 bp, Zea mays
  Clone ID: LIB3067-008-Q1-K1-D11
cggacgcgtgggcggacgcgtgggtgctaccgcaaaacaacaacatggatcttattggctgccacgatatacaaaaaaaaaaaaaaaaaaaaaaaaaaaaaaaaaaaagaaaaaaaaaaaaaaaaaaaaaaaaaaaaagaaacgcatataaaaaataataaaaaataatgtagaggggcatataagtacaaaacattacgaaagtttaaaaaaaaatgaatagcgaaaaaataatggcaacacaaatcaatatagaagagcatcatataaaacctttcaaaatggcaaaacatagaaaa

SEQ ID NO: 51528 - DNA, 164 bp, Zea mays
  Clone ID: LIB3067-008-Q1-K1-D12
tgattttgttaagaataaactatttttttacttaaaaataacaacaaaaaaaaaagagattgtgattatatacaataaaaaaaataattacatattataaataaaatattaaatttgaatttattttttaatttaattacttaaatttaatctattatttatat

SEQ ID NO: 51529 - DNA, 188 bp, Zea mays
  Clone ID: LIB3067-008-Q1-K1-D2
cccacgcgtccgcggacgcgtgggcgtacgcttaacttgccctgtgacccatgctatatctgctgtgggatttagtctagcaatgcactttgtgctcgagcgaatacttataaattatcaatgatgaaaaccaggctgtcgctttataggatccagcattactatacgccatgattcgccgggcatgc

SEQ ID NO: 51530 - DNA, 375 bp, Zea mays
  Clone ID: LIB3067-007-Q1-K1-H6
cccacgcgtccgccttcgttcgcgccgccgtttccgccgccgctacgctccgcacctcgctggatttcgtgtcgccaagatgacgaagcgcactaagaaggcaggaattgttggcaaatatggaaccaggtatggtgctagcttgcgtaagcaaatcaagaagatggaggtatctcatcattccaagtacttttgctagttctgtgggaagtttgctgtgaagaggaaagcagttggaatttgggggtgcaaggactgtgggaaggtgaaggctggtggtgcttacaccatgtacactgctagtgcggtcaccgtctggagcacgatccgttttctgatggagcattctgaatcatgattttatctttttatatt

SEQ ID NO: 51531 - DNA, 103 bp, Zea mays
  Clone ID: LIB3067-007-Q1-K1-H7
cacacgcgtgcgtatgacgcctggtctactccttgcacatccccttcatcacctacgggtaggtacctctgtccaagatgattctcgatctggccacgaacag

SEQ ID NO: 51532 - DNA, 406 bp, Zea mays
  Clone ID: LIB3067-007-Q1-K1-H8
cccacgcgtccgcccacgcgtccggtgaaatccagcatagtggcacctgagtgttccaagtaccatgacgtgcctgctgtgatctttgctctgactggatacactggaaatctattccatgacttcaccgacgtgcttgtcccccttttcacgactgcaagcgagttcaatggtgaagttcagttcctaatcacagacatggctatttggtggacaaggaagtatgctgtggtgtttgagaagctaaccaagtaccccttgattgatttcaacaaagacaacgaagtgcattgcttcaagcatgccattgtcggccttcatgcttacatggagttcacaatcgacccgttaaaggctccacacaattactcaatggtggacttcaaccggttcatgcgcatgacct

SEQ ID NO: 51533 - DNA, 420 bp, Zea mays
  Clone ID: LIB3067-007-Q1-K1-H9
gtccagcgtctgctcaacgagtttatggatctcctatcagagtatgaagctgctaagagcaaagttgacccaatggatatcacaccggcgctaccacaacaagcaccagaagccaatgccaacgtggtcacctcgtagctgcaccagttccgttgatagttccgttgctggcgacttactgacctctcggtaagtatgataggatagcaatcttggtaagtccttatatgaaccaatcaattagttgtgcttgtaactggtagattgtttagcgagggaggcgacctcaggcaaacattgatattgaacccgttagctgtaacgctgtgtaacagtagaagaaagaagctgaagtcgccaggtaatttattgttaaactgtatgatgccgggtaaactcatgcccttcttgttcaagcta

SEQ ID NO: 51534 - DNA, 273 bp, Zea mays
  unsure at all n locations
  Clone ID: LIB3067-008-Q1-K1-A1
cccacgcgtccggcaagaatatactctntgtcatctccaaaccagatgtgttcaagagtccgaattccgacacgtatgtcatattcggcgaggctaagatcgaggacctcagctcccagctgcagacccaggcagcagagcagttcaaggctcctgacttgagccagatgatctcgaatccagagacgtctggcccgggacaggaggacaatgatgaggaggacgacgaaacttgtgttgaggccaaggacattgagttggtgatgacccagg

SEQ ID NO: 51535 - DNA, 136 bp, Zea mays
  Clone ID: LIB3067-008-Q1-K1-A10
cacgccaagcgcgtcaccatcatgtttaaggtcatgcagctcgcgcgccttataggatgcgggctcgcctaagcagtacggttgatgcgcatgcttgctactcaatttggtgcttaatttatcatattatggatga

SEQ ID NO: 51536 - DNA, 410 bp, Zea mays
  Clone ID: LIB3067-008-Q1-K1-A11
gcccacgcgtcggagaagagctgcgccccgtcatgctcgctcgcgtggcactccgggggacgttcgacgtgtctctaggaccggcggtccattctcacgatgaagcatcagtcggaattggctcacggcgctaacgcgggctggacatcgcggtgcggctgtcgagcccatcaaggaggagttccaatcctctgtacgccgatttctaccagctcgcgggagttgtggccgtggaggtcaccggtgggcctgagattcccttccaccccggtagggaggacaagcctcaaccttcacctgagggccgacttcctgacgccactaagggttctgaccacctgaggcaagtttttggcaagcagatgggcttgagcgatcaggacattgttgccctatgtggtggccacacc

SEQ ID NO: 51537 - DNA, 308 bp, Zea mays
  Clone ID: LIB3067-008-Q1-K1-A12
gtcacgcgtacagcgaggcgaagtagatgagcgagatcacgagagtagcagtgaaacccaaacattagcaagtacacagagaccgaatgcgtagagaaagtacagtttattacaacagctcaagggcaaggacgcgaacgccaagatgtggaacatactggcctacacatttaccacgtatcgaatcaaaaagataatgctagcacatgaagattttggaaagattgcactagaactcgctgtatgagattccagatctcatgaatcgtgttgacaagatcatattgaccttacttatgaagaacctc

SEQ ID NO: 51538 - DNA, 353 bp, Zea mays
  Clone ID: LIB3067-008-Q1-K1-A2
cttatatttgccgttccgtcacggctttgctcgccaaactgactgattgtctgattgtgattgcggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgcttcatgttctttcatgcctggtagtggcgttgcttctggtcaaacaagctcttatgtgctcacagaggttccatctacagatttacctcttgaaagtg

SEQ ID NO: 51539 - DNA, 298 bp, Zea mays
  Clone ID: LIB3067-008-Q1-K1-A3
cggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggctgcagctgcggctacggtggtggccgtggaagcggccgctacggctgttgcgggcgccgtgatggctgctgcggcta

SEQ ID NO: 51540 - DNA, 130 bp, Zea mays
  Clone ID: LIB3067-008-Q1-K1-A4
cccacgcgtccgcccacgcgtccgggattttccgttttctattaggaatggctatatttgtgaacataaaaattagtaatctggagagggatttacaatattggaccattttaacctagacgagccaaac

SEQ ID NO: 51541 - DNA, 150 bp, Zea mays
  Clone ID: LIB3067-008-Q1-K1-A5
atcacgcgtacggagaagagttgttcaagggttatgctacgagttgcgtggcggtccgcaggggcattctacgagtggtcaaggaccggttgtacattgtatacgagaaagcattagtcataattagctcactgcactaactcatagctt

SEQ ID NO: 51542 - DNA, 336 bp, Zea mays
  Clone ID: LIB3067-008-Q1-K1-A7
cgcctcggcttgtccccaccaacccgcagctcgctcccaccaaacccacacccgaacaatggcgtcggcgtccaaggaggaggtgatcgggaagctcaacatccgcgtggtgcggggcaacaacctggccatcgccgacccgctcacccacaccagcgacccctacgtcgtcctccagtacggcgctcagaaggtgaagactagtgtccagaagaagaaccccaatccagtgtggaacgaagtactgcagctctcagtaaccaatcctactaagccagtgcaccttggagtttttgatgaagacaagttcacagcagactactgcatgggtgttgc

SEQ ID NO: 51543 - DNA, 401 bp, Zea mays; identical to SEQ ID NO: 44401
  Clone ID: LIB3067-008-Q1-K1-A9

SEQ ID NO: 51544 - DNA, 427 bp, Zea mays
  Clone ID: LIB3067-008-Q1-K1-B10
ggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaagttgtggtcgctgattgtcgcctttaaatgtttggaactgtcgtgatcgtgatgtcgaatatccatatgatctgttgaagtaagc

SEQ ID NO: 51545 - DNA, 161 bp, Zea mays
  Clone ID: LIB3067-007-Q1-K1-H5
ctttacattgaaatgctgtcgtttgtacatgttttttctgagttctacacctgcttgtcttgcttaaaaaaaaaaaaaaaaaaaaaaaaaaaaaaaaaaaaaaaaaaaaaaaaaaaaaaaaaaaaaaaaaaaaaaaaaaataaaaaattaaaaaaaaataa

SEQ ID NO: 51546 - DNA, 425 bp, Zea mays
  Clone ID: LIB3067-008-Q1-K1-B11
caaaaacatttttggaatgttatgttcaagggaacattgaaccaagtgaagcagaatctatcgtagaagaaatcgaaaacactatatttactacgcccaattctttgttcaaatccatgtctccatcagaatatcttattaaaagggtcatcatgcttgaaaatgacttgaaatgctactaccaaactgagggattaaaccagaagaatgagaattcatcagttatccaatatattcaggtgcatcaagatgacgccattttgaatatcaaacttgagctgttctctctaatagcaaatcagccagccttcaaccagctacgaactgttgaacaacttgggtatataacaagtctttctctgagatccgactatggagtcctggcactccaggttgttatccagtccacagtaaaggatccttca

SEQ ID NO: 51547 - DNA, 428 bp, Zea mays
  Clone ID: LIB3067-008-Q1-K1-B12
cccacgcgtccggctactctgtgaatctggaggagataacttggcagctaacttcagcagagaattagcagactacataatctacattatcgatgtctctggtggggacaagataccaagaaaaggtggccctgggataacccaggccgatctgttggtaataaacaagacagacctagcacctgctgttggagctgatctgtctgtaatggagcgagacgcacttcgcatgcgcgaaggagggccctttgtgtttgcacaggtgaaacatggagtgggcgtggaggggatcgtgaaccatattctgcaggcgtgggagatcgcgactggtaataagcggcgataagatctcacgacttgtggccatatgttggatgcagatttgaatcagtcggcacttccacatgcatgtgtcatctgttcgttct

SEQ ID NO: 51548 - DNA, 144 bp, Zea mays
  Clone ID: LIB3067-008-Q1-K1-B2
cggacgcgtgggcgagcggatgctgttcgacattcagaagttctacaacgtgttgattgaggagctgcctgccaacgtcgctgaccttctgtgatcattttgaagaaaaacagaactaaaagaaaggtggtgggggtgatctgg

SEQ ID NO: 51549 - DNA, 342 bp, Zea mays
  Clone ID: LIB3067-008-Q1-K1-B3
ctctttctctcttgtgttcttgccttctgcctactacgagtgatggccagcctcactgacctcgtcaacctcgacctgagtgactgcacagacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggtaacaacatccttgtgatgtgtgactgctacacgccacaaggcgag

SEQ ID NO: 51550 - DNA, 403 bp, Zea mays
  Clone ID: LIB3067-008-Q1-K1-B4
gaagtatcagcgtacaggaatgtgagacattcaccatcatggagctttcggtgggacaatcgcacacatatagaagacataatggaaatccctactctgttctccaaccatagtagtggaagcattcggcctgatacaaagagtggttccattgccccaactgaagggttttctaatggaaatagccttggaactagcccttccaatgtgtctcacggaacaaagtggcacaaatctgacaaaaaaatggaagcatctaaggttacaaaggctgatccttgaggcaaagctttccaggaaatcgctggacatgtcaagtgttgcttcagatttgaagacattatggtctgttcccttaaaaccacccttagtatccagagcagattcatcattcctcaggggc

SEQ ID NO: 51551 - DNA, 329 bp, Zea mays
  Clone ID: LIB3067-007-Q1-K1-F4
cccacgcgaccgcccacctaccagcgggcagtaacacgccacgatcacgacacccccgccggggcgcgcgacccggacagaacgcgcccacccagcgccgcggccaaggataaccagatcacccacgacaacaagcagcagagggcaagcacggctcgcgcagaccacggagaggagagcgccctaccgacgcacagggacacgcagccggctaacgccgacgaaggaagacagagcacaggtaaaacaaccgagaaggagagcgaggccgggaaggacacccgaccgaggggaccaggcaaaaaaaccacaacacacgccagagcaag

SEQ ID NO: 51552 - DNA, 420 bp, Zea mays
  Clone ID: LIB3067-007-Q1-K1-F5
ggaaggtttatctcctattaattcctatacaggggatacaaaaatgataaagctatactcaggagcaggcgcaagaccaagaactgcaccgcttcctattaggagtggcctgatatatagggaacctttaccagtaggaggcacccatcttttatttgccaaaacagtttgtttaacagcatcaacgaattgctcaacagttggagcaggcatacacatcctctctgcaccgcttagcatccttatagcattctcctctggacgaaatagaaggatggacccatcagttttcctatatgcttttaggccttcaaacaatccctgcccataatttaagactccagcttaaggactcagtgctatatgaccaaatggtatgactttacctttggaaaagattccatcagttccacaatttgc

SEQ ID NO: 51553 - DNA, 312 bp, Zea mays
  Clone ID: LIB3067-007-Q1-K1-F6
gccacgcgtacgttgtatgaatagattgcagtctatacagagatcataaagctatactcaggtgcaagcgcatgaccaagaactgcactgcttactattatgagtggcctgatatataaggaacctttaccagtttgaggcacccaacttttatttgccaaaacagtttgtttaacagcatcaactaattgctcaacagttgtagcaggcatacacatctatctctgcaccgttttagtatacttatagcattctttttatgacttaatataaggatggacccatcattttttctatatgcttttaggcctt

SEQ ID NO: 51554 - DNA, 194 bp, Zea mays
  Clone ID: LIB3067-007-Q1-K1-F8
aaaaaaaaaaaataataataaaaatataatatataaaaaaaaaaaaaaaaaaaataatggaagggttgccattttaaaggatccaatgctacttacacatgcatgcttcttcatagctctattatagtgttaccaaaatttaatttactggcctttgtttaacaacttcttgactggtaaaaccttgtctttac

SEQ ID NO: 51555 - DNA, 397 bp, Zea mays
  Clone ID: LIB3067-007-Q1-K1-G1
cccacgcgtccggcacagtcctttccaaacattcagagccattatccatctgaagaacattggcggatggcatctggtaacttcagtccagatgaccagcataattggatagcaagtggcagatcattaccttgctcagaagggccatttgtgcatgatggatattcaagatcaaacattgacagatcttcaatgaatcctatgaatcatcaacatactgttctgaatcatttgccatctggagcaccactaccaggccatatttctcagatgctaccagccaggtctgatatgcacactcttaattgctggaggccctcttgatagagttgtaaactgaacttcttgtttgtgaatttgacttgtaaagctcatgtcattggatgctttttgaatt

SEQ ID NO: 51556 - DNA, 54 bp, Zea mays
  Clone ID: LIB3067-007-Q1-K1-G10
aaaaatcaaaaacaaacttttaaaataaatttttaaaattcaagacaaaataac

SEQ ID NO: 51557 - DNA, 87 bp, Zea mays
  Clone ID: LIB3067-007-Q1-K1-G11
cccacgcgtccgaaaaattaaaaacaaaaatttaaaaaaacaaacaaatcaaaaaacataagggaaaaattaaaaattaaaaagggc

SEQ ID NO: 51558 - DNA, 223 bp, Zea mays
  Clone ID: LIB3067-007-Q1-K1-G12
cccacgcgtccggcttgtcaacatgaactttatgaggaacatctatatcatcggactctcgtagggccgtggcatctcggtccctcactactataacggatacacttgttcagctggcggccacggacctgcccggacaaatgctggatggttcaacgacattatagacaccgtgtccgctgccgggccgactgtagcactaattgttggttatgtcctggac

SEQ ID NO: 51559 - DNA, 253 bp, Zea mays
  Clone ID: LIB3067-007-Q1-K1-G2
cccacgcgtccgcccacgcgtccgcatcggttatctactccagtctcccactcacctatctggcagcgcccgagcaatcgccacgcccacgccccaatggaagacagcgccaccaatggccatggggttgtgacggctgtcccggcctcgtggaacttcgagccaaacgagaccctcctgggtctttcggcgctctcggttcgtggcgtgctgaccagagtcatggccgggatgttgcccgacggtgggctgt

SEQ ID NO: 51560 - DNA, 235 bp, Zea mays
  Clone ID: LIB3067-007-Q1-K1-G3
cccacgcgtccgcccacgcgtccggcagattactcatctagccgaaacccaataactgtacctagggaatgtattgggatgctggagagaagcattgtatactttggttcatctatacactcgatcacaaaaggtcaaacaaggcaagatatacaggaatgcttgaaggaaggatatatctgtgtacggtcgttccaacggaagaccagaataccactacgcctatgttgcacac

SEQ ID NO: 51561 - DNA, 374 bp, Zea mays
  Clone ID: LIB3067-007-Q1-K1-G5
agctgagaaggattattgggacacaatccgcagtattcaaggaaagtacaaggatagtagaagctacaagggaagggcttcaaataaccagagaggaggaaagcgtttcaacgcgaagcgagatagaaacccagactcggagaagaattctaacaaggctcggaaggttgaagctatcgcatgaggttaatttaggtaccttagctcgactaaagaagtaacatgttatgccagcatgatcgacttcagtactctccaagtgtctagaatcgacttgtcttttagctatcgttttcattttggtcgttttgccactttattcgatgttagtcccttagctataatcctttttgaatgtctttactgagatgcta

SEQ ID NO: 51562 - DNA, 423 bp, Zea mays
  Clone ID: LIB3067-007-Q1-K1-G6
cttctggtcgcaaagatccagataaacaagagaaagcgacggaggttactaagggcctgaaggatacagagggattcactgtcgtttcaaaacgccgaaggcgtccccagccgttcatgaaccccataaatggcctatattctcagccgtctatttgcacctctgtcagttaaggtcattgcgttatcgaagacctgcaatattttgggagatggacctttgcctttgcctttgcttagaggattggtatttggtagcagagattttctctatccaagtgagttgtgagcagcgagcatttagtcaaactgtacaaaagttttccgggataccctttttgtaataaaagaaactgatgtattccgcagtagctgtagcgctggatataatgttcccttgtatgttatatatgacagaatcata

SEQ ID NO: 51563 - DNA, 405 bp, Zea mays
  Clone ID: LIB3067-007-Q1-K1-G7
gcagcagctcgtgcatatatctagctaagccaattgcgcaccaccgcgcgcgccaccccaagatccccgtgccttttcagagcatctctccgtcgccgtgacaatgaagcagcagcgaggcgaccttgcgacctccgttcctctgcgctccggctgagttgctgatttgggataatcatgttctctctgagtgaatgaacatgtctgggaatgatgataagccacatgctgctgcaaacagaataaaggcagccacgttatcagtgactaagggattgagcagggctcaagctgaatgggctgcgactgctgctacccgcaatgtgaatgcctatgggcagaatgaagagggacgaagccgtttgcaagagaggaagaaagccaagagtcagatgtatctgatga

SEQ ID NO: 51564 - DNA, 304 bp, Zea mays
  Clone ID: LIB3067-007-Q1-K1-G8
gccgccgccgccgcgcgcgtacgtacgtggcgtgaggcgtacctgtgtcggtagcagcgtggcccactggacagggacagagtgtggcgttgctcttttctgtttccgtacgtacgtacttggatcgcgcatgcccgtgtatgcgtgttccgttgtggtgttgctgtactcgatctgctgcctgtgtgtatctaccgagctcttcggacagatacgcgtgcgtatgaataattgatgtaataacgacgtgtgcatccgctatatatatgcatatctaaaataaaaagatatcatatcttatatt

SEQ ID NO: 51565 - DNA, 337 bp, Zea mays
  Clone ID: LIB3067-007-Q1-K1-G9
cggacgcgtgggcggacgcgtgggccgccaccggcacctacgcaacaccaggcgctccagcagaacagcactcggagctcgcctgcccgacggcccaccatgatcatccccaagaagaaccgcaatgagatctgcaagtacctcttcaaggagggcgtgctgtatgccaagaaggactacaacctggcgaagcacccacagattgatgtgcccaaccttcaggtgatcaagctcatgcagagcttcaagtccaaggagtatgtcagagagaccttctcctggcagtactactactgggaccttaccaacgatggcattgagcccctactcaactacc

SEQ ID NO: 51566 - DNA, 341 bp, Zea mays
  Clone ID: LIB3067-007-Q1-K1-F2
ctttgaatctttggtatccttcaaatcttcattggattaggtatccttcaaatcttcagtatgcttcgagtcttcggtacgcttcgaatccttatggggtaataacttccaagtttcaaaatttaagtgaagagacttattttttccagaagaatagattcatagtttaagaacggaatacccatatatgaaaataagagcttccgtgcgtaaaatgcgtacacaatgtcgactgattcgcaggcgtgggcgaattagagtcattcgttccaatccgaagcataaacaaagactggggtaatctttcgaaaaagaagcttttctgtctaatagcttttctt

SEQ ID NO: 51567 - DNA, 184 bp, Zea mays
  Clone ID: LIB3067-007-Q1-K1-H10
gtccagcgtcggctcaattagtggatcgaatgcttagcagagtatgaatctgctaagagcgaatgtgggcgaatggatataacaccgtcgcttccacaacatgcaccagaagccaatgctaacgaggtcacctagtaactgcaccagttgcgttgattgttttgtttcaggcttatttactgac

SEQ ID NO: 51568 - DNA, 445 bp, Zea mays
  Clone ID: LIB3067-007-Q1-K1-H11
cccacgcgtccggccaccgccacctacgcaacaccaggcgctccagcagaacagcactcggagctcgcctgcccgactgcccaccatgatcatccccaagaagaaccgcaatgagatctgcaagtacctcttcaaggagggcgtgctgtatgccaagaaggactacaacctggcgaagcacccacagattgatgtgcccaaccttcaggtgatcaagctcatgcagagcttcaagtccaaggagtatgtcagagagaccttctcctggcagtactactactggtacctcaccaacgatggcattgagcacctacgcaactacctgaaccttccgtctgagattgtgcctgccacgctcaagaagtctgccaggccactgggccgtccatttggctctggcccttctggtgaaccgccaaggggccctggtcgttttgaagacaga

SEQ ID NO: 51569 - DNA, 404 bp, Zea mays
  Clone ID: LIB3067-007-Q1-K1-H2
cccacgcgtccggttggatccagaattcttctaacaaatccagacgcacatgaggtgcattgctcaagggaaaggagccgtgcagcttgggaagctattgatgagtatttgatgcccttcgtggaaaaagaaaaatatgaactcccaagcaaatgtagacttcgtcctgataatgacatgtttcgggagcaagagcaacataagattcattttgatattaatgagtggcactgtggcttttgcaagaaagctttccgagcagagaagttcattgatcagcattttgaaaatcgccacaagaatcttgtggataatagtgaaggaagatgcatggcagatctatgcggcgcactacattgtgatctgatgatgcagttcatataaccaaaatgtaaatgcaatgc

SEQ ID NO: 51570 - DNA, 371 bp, Zea mays
  Clone ID: LIB3067-007-Q1-K1-H3
cccacgcgtccgcccacgcgtccgcccacgcgtccgggaaagcgaagcgaaccctcgccgcgcgagttagcgatggccggagaggacgccgccgccgcgaggaggcccccgaaggaggaggaggaggaggaagatgacgacgatttggacaacgttccgctggcactttccagggccaagaaaccgggtaatgcgagcgcctccaaggtcaagaaagaagaagaggacgattacgacgacttggacaacgttccgttcgcactttccagggctaagaagggaaacgagaagcataaaggcaacaatagcaatatgaaggctttttcgaaagtcaagaaagaagtcagttctgatgatgattttgtcatgcc

SEQ ID NO: 51571 - DNA, 283 bp, Zea mays
  Clone ID: LIB3067-007-Q1-K1-H4
ccaattcctcattgctcgccgtgtattaaacatactcgtactccagctccccatttctctcgtgccctggccttccctaatcatgtcagcgaatccaatcgaggcgatggaccagcagggtgcgggcggggacgcggaggtgccggcggggctgggtctgacggcggcggagtacgagcagctgcggtcgacggtggacgcgcaccaccgttacgccgtgggggagggtcaatgctcctcgctgctggcgcagcgcattcacgcgccgtcggaggccgtctgg

SEQ ID NO: 51572 - DNA, 262 bp, Zea mays
  Clone ID: LIB3067-016-Q1-K1-H7
ggccatgtttgctggtccctgtggttatctcaaacgcacgcatgctctattatagctagtcatcactatatatatacttgggtttgtgtattgttagctctagttctgcaggcgtatacggcgtttaattcgacctatgttatcgagcgcgcgatatatgtgccgatacatccagtatatcttgaggagggactagtgggtatgtgtagtactggactaaataccctgcatatgcatgttttgccagctcgctatgaatgtc

SEQ ID NO: 51573 - DNA, 198 bp, Zea mays
  Clone ID: LIB3067-016-Q1-K1-H8
cccacgcgtccgcccacgcgtccgaaagcgtcgcgtccttaacctgcgtgttggtaggcggtgttaggtgtgtggagaccggccggcactatagagaactaaatcgaatgatggtgtactcagtacgtactgacgtgtatgagtttgtgttgatgtggacaacaataaaggcatgtgtacgcgtttgttaaaaaatat

SEQ ID NO: 51574 - DNA, 146 bp, Zea mays
  Clone ID: LIB3067-016-Q1-K1-H9
cccacgcgtccgggtcccctgttctgatcgttctgttcctcacagcagcatccatatgctggggagcctttgaagcaagctgcccctcgtgcacaggagactgccgtgcacatcgagtacgttgaccgtcccgtggacgccgaccc

SEQ ID NO: 51575 - DNA, 443 bp, Zea mays
  Clone ID: LIB3067-017-Q1-K1-A10
cggacgcgtgggcggacgcgtgggtccaagcctgcgacacctaagccgaccccgcctacggacactccaagccctaagccaccggctaccaagcctcccacgcccaagccgaccccgccaacgtacaccccttcgccaaagcctccgacacccaagccgaccccgccgacgtacaccccttctcccaagccttcgacgcccaagccgaccccgccgacgtacactccaagccccaagccttccacacacccgacgcccaagccgaccccaccgacgtacaccccttccccaaagccttcgacgcccaagccgacctcaccgacgtacacctcttccccaaagcctgcgacacccaagccgaccgcaccgactgacactcccacaccgaagccgtcggtcaccaagccgcccacctacactccgacgccgtcggtgtcttacac

SEQ ID NO: 51576 - DNA, 477 bp, Zea mays
  Clone ID: LIB3067-017-Q1-K1-A11
gtcaaatactgtgatacttgcatgctgtaccgaccacctcgatgctcacactgttccattggcaataactgtgtggaacggtttgatcatcactgtccatgggtcggccagtgcataggactgcgtaattatcggttcttctatatgtttgtattctcgacgacattgctctgcctctatgtatttgccttctgttgggtgtatgtgatcaagattagagctgctgagcaatcgtcagtttggaaggccttgctgaagacaccagcatcagttgctctgattatctactgatttctctgtgtatggtttgtgggtggtttatctgtcttccatttatacctgatgagcactaaccagacaacatatgagaatttcagatatcgctatgatcggcgcgataacccatataacaaaggtgttctgaacagatttctagagatattctgcactggtatccccccttcgaagaaaattttc

SEQ ID NO: 51577 - DNA, 413 bp, Zea mays
  Clone ID: LIB3067-017-Q1-K1-A2
cggacgcgtgggttgccaacttgttctcggtgcaggggccatgcaggtgtctggacttaagtgaattacatctaagcatttagctctggcgagtcaaatcattagttttatacattctttaattccagatatcagacgagtgcttttcctgaaaatacctgaagcacgcaaacagttgctaatgtctgagctggatagagtggctcaggactacaagatccatcgcgatgagattcacagtaaacttgtccagatcatgagagagaggctgcttgcaaatcttagaaaattaccccaaattgtggaaggctggaatgccccacaagataatgatgtgcagccgagtcaatttgctaaagctgttacaaaggaagttacctatttgcaccgtatcctttctcaaacactgcttg

SEQ ID NO: 51578 - DNA, 397 bp, Zea mays
  Clone ID: LIB3067-017-Q1-K1-A3
tcgcccacgcgttcggcggagaatccgcagctgtttgggaacgggatgccggtgccgttctacggcgagatggtcgtcctcgtccgcgacggcgtcgagttccacgtcgacaagatcccgtcagctcctggaggtcatgtgaaaacaaaaggcacaatttacctgtccaatttaaggatggggtttgtggccagcaagcctgttggcaacttctttgctttggttttgccactgtggtttgtgcatggtgagaagttcaatcagcccatatttcactgccacaacatctctggattcgttgaaccagtcgttccagaccatcagaacagggccctgtactcaacttacacctttcagatcctgttcaaagaatgccgctgtggaactttcggttctt

SEQ ID NO: 51579 - DNA, 88 bp, Zea mays
  Clone ID: LIB3067-017-Q1-K1-A5
tcccactcgtccgcccactcgttcgcccactcgtcctaaaaaaaaaaatttaaggaaatatgtggaatactaaaaaaaaacaaagtac

SEQ ID NO: 51580 - DNA, 446 bp, Zea mays
  Clone ID: LIB3067-017-Q1-K1-A8
gttctagatcgcgagcggccaccccttcccgtctccaccccgacgccgaccgcactccgctggccgtccaccatcccagcgtgatggctgggaggaccgcgcctgccccctcccctccttctctctcacgccctactccctcgccgccccttcatcccagatcccgtcgctgattctggcgagagcaggggaagagtatgatgatgactattcgtgacagtgaattcctgggaggtgggggagaaaaggattgcgttctgtggaggttgttgtgcttgtgagaaggatttgttctctctcttttttctttcttgtttctttggccgtgtttcagtgacactgttgatggatcccagtgctttgcccgtttgatgcatcatggtggtggtggtgatgatggatgacatagtggtagggggtgtgtgctagttggtaatggggtattt

SEQ ID NO: 51581 - DNA, 430 bp, Zea mays
  Clone ID: LIB3067-017-Q1-K1-B1
ccggaaaactaacccctaacgatgtctggagccggcgaggaggacaagaagcccgcggagggcggctcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgatgccatgcttcaccagaccggaagcagcgttcctagcaccacctaaaagcatcagtcgcggagctttgttttgctctccgccctgcgtagtagttaacaaaatggaaaaagtctttttaaggaacttgtgatgctctggcttcttgtgccattgc

SEQ ID NO: 51582 - DNA, 193 bp, Zea mays
  Clone ID: LIB3067-017-Q1-K1-B10
aggcgtacgggtacgcgtccgggagacgtcacgtcatgcatgatcatgagcctgatgcagtaacagcaaaccaagatggaaaaagctctatgaaggcttaaaagagagcacgtctcatcatgaatggcctattcattttattttgtgtatgtttcacttgccatgctttctgatgcatgttattccaaaattg

SEQ ID NO: 51583 - DNA, 434 bp, Zea mays
  Clone ID: LIB3067-017-Q1-K1-B11
aattagtgtgctcccgcgtcctatttctgctgcactgccggcagtcgaaaaaaaacccagggaaaaaagattgtctttgagagtgagtgagagagcaagcaggttgctagtagctgctggtagagagagctagctgttacagccgaccaggtagctagatagctagccatggagccggggtcgacgcccccgaacgggtcggcgccggcgacgcccggcacgccggcgccgctgttctccagcggcgggccgcgggtggactcgctgtcgtacgagcgcaagtcgatgccgcggtgcaagtgcctgccgctgccggcggtggaggggtggggcgtggcgacgcacacctgcgtcgtcgagatccccgcgccggacgtctcgctcacccgcaagctgggcgctgagttcgtgggcacgttcattctcatcttctt

SEQ ID NO: 51584 - DNA, 200 bp, Zea mays
  Clone ID: LIB3067-016-Q1-K1-H5
cccacgcgtccgatgagttaatagccctaaaaaaataataaaaaaaaaaaaaaaaaaaaaaggaaaaaaaaaaataaaaaaataataaaataaaaaaaaataaaaaatttaaaaataataataaaaaatataaaaatataaaaataaaaaaatgggctacccctttaaatttcccatgtttacattcccatattttcaac

SEQ ID NO: 51585 - DNA, 65 bp, Zea mays
  Clone ID: LIB3067-017-Q1-K1-B2
ttcccggtcgaccacgcgttcgccacgcgttcgccacgcgttcgccacgcgttcggacccacgcg

SEQ ID NO: 51586 - DNA, 52 bp, Zea mays
  Clone ID: LIB3067-017-Q1-K1-B3
aaaaaaaaaaaaaaaaaaaaaaaaaaaaaaaaataaaaaaaaaaaaaaaaaa

SEQ ID NO: 51587 - DNA, 412 bp, Zea mays
  Clone ID: LIB3067-017-Q1-K1-B5
atccttgacaacgtcactagcccctccgtgccccgctttgtccaccacgacagcatcgctggagcgcccaacctcccaatcgctgcccgcctcgccgacgcactccgccccctgctgtcaggcagcaattccaagagggatactgttccgcttatcgaggggcccaccccaaggcagaccaacggctatgactgcggtgtctatgtcatggccatcgccagggctttgtgcgcctggtggaagaatggccaggaccaacggggaggcgattggttccaggcggtgaggagcggggtggacgcccacagcgtcgaggccatgaggaccgacttgctgcagctaatcaacactctcatccaagaaaaggccaatgccaaattcgacacccatgggcgacactgacccagggtca

SEQ ID NO: 51588 - DNA, 303 bp, Zea mays
  Clone ID: LIB3067-017-Q1-K1-B6
gacaagctcccctgctactcatcagtactcctcactcgtagcccaagggtttttcatttttgcatgggaaattagttcatttttccttgggaaattgaaaatcccatagaaaaatgtggttgacaaactagcctttatgtgtgtatggctagtttcttcaattcgtgagtgcgtggtagtaccaataagcaataagacgcagagggatcgatcaaaaaaaaaaataaaaaaaaaaaataaaaaaaaaataaaaaacaaaataaaatataataaaattaaaaaatttttaaaaatatataatct

SEQ ID NO: 51589 - DNA, 377 bp, Zea mays
  Clone ID: LIB3067-016-Q1-K1-F1
cccacgcgtccgcccacgcgtccgggttgctcttggagaggatgtcaagacgctgcaaaagaaagacaacgatgcgagccagtggaaagaggaaaacaaggaactgttcatgccactgaatgaacaggtcaaagatcctaaggagccaggctcggctggagatgccctggaggagaaggaagacctgttttggcgtcaagggttgttaatcattcagaccatatatcatggtgccgtggaagctcttccgtcaagcttaaccttgcggaagaaattcttggagatactaaacagtgttgacttggcacattctgatgagttaaaactagaagtcctggatgaccttaagagagatttctcttatagcgaggactact

SEQ ID NO: 51590 - DNA, 366 bp, Zea mays
  unsure at all n locations
  Clone ID: LIB3067-016-Q1-K1-F11
ccaccacatccgtcctcttccgccgccgccgatggcccgccttctcacacaaaccctcaccctagcccgtcccgccgcctcctcctcccccaccgccgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctggaggaggccatccacggcgtcatggtgcgccgcgccgctcccgattggctgcccttcgtgcctggagggtcctactgggtgcccccgctgcgcctnccgcacgaggtcaccgcgtttgtcggccggatcgc

SEQ ID NO: 51591 - DNA, 337 bp, Zea mays
  Clone ID: LIB3067-016-Q1-K1-F3
cccacgcgtccggcccggcctccgcctgcagcttgaacgcgagttttccagactggtcatcgccggagttggggcactgcaagagcagcaaggagaaggagcctgcccctgcctacctcaccttgagcgcgcagcctgcgccacgcgggaagcagcctcctcctgcgctcccctcgatcaaactcccggagttgggtcactggggcgtcatgcagcctcctcagcacgggagcgcttcggcgtcgtcgtccgcgtcggcgtctcggcccgtctacagcttcatgccggctggtccggttcgcattgacagaccccggatcgggatcaaggccgacga

SEQ ID NO: 51592 - DNA, 232 bp, Zea mays
  Clone ID: LIB3067-016-Q1-K1-F4
ctcacgcgtcctcccacgcgtccggccacgcgtccgtccacgcgttcgaccacgcgttcggccacgcttccgacactgcagtctccaaacgtccagcactcacagtgcatacaattggtccgtgcttctttcgtgtgccacatctgaaggaggatgaaaccccaccctaaggaggaactcctggatgggcagcaatttcaagtgctcgaattggaccttggcttcggttgtt

SEQ ID NO: 51593 - DNA, 436 bp, Zea mays
  Clone ID: LIB3067-016-Q1-K1-F6
caaaatagatgttcctctgatgttcattggagaggatgcctcgcctggtctcaggaaaggagcttacttcaacaccataaaacgaacagccaagtatctgtgccctgctgacatagtaccaccatacattgaagtggatctaagtgagttggatgtaggacagaaattgctgatgcgtgatctgaaagttcatcctgcgttgaagctgcttcattcgccagatcagcccatttgtaacgttaccggatcaaggtcttcagaatagaataagggaaaataacctgcttctttgtatgagctgttttgagcacaataaggttatggtttcttacttgagtgaattatgtgcttacttgttctactgttaggatgaattggttccagagacacctattttaacttatggatgggatcttttgaacctgtatattcttct

SEQ ID NO: 51594 - DNA, 332 bp, Zea mays
  Clone ID: LIB3067-016-Q1-K1-F7
cggacgcgtgggcacctgcaaccatgcagaatcttagccagtcactgtacgaagatgttatcaaagccgagagccaattcaacatagagggcctctgtgcagcctggtctcaaaatctgcagccacagcaacatctgcaggtatcagatttgtatgacaaggatttgcaaaggatgtccttgtcttttgagaatatctagacagcatgtttcagcatgcatggaacagagaaatagcagaaagccgagtcaatgaagcctaaataaatacaatatttcttcacagattcatttgaaggctatgttgatgtgtgttttacgtaagtacattct

SEQ ID NO: 51595 - DNA, 363 bp, Zea mays
  Clone ID: LIB3067-016-Q1-K1-F8
cctccctgtatatacagaacagagagggagagagaggaggaccagcctgcagcggaaaaaagcactcttgagattccccaccccactggtgtgatgattctttggacagagatgtgaaagatcaatcgccacgccggcggccggtcgatcgcaccacccccgccgcctgttgttagccgcaagatcgccggctaccaaacgcggtgcattgcattcccccggtatattctcagatcagacctgaattcgtcttcctctcaagcgagagggggaaaaaaagacctgtaatatcatttggatcgccattatatttgtagctgattatatataaatatataaaatatcattcctcgtattcctgtc

SEQ ID NO: 51596 - DNA, 249 bp, Zea mays
  Clone ID: LIB3067-016-Q1-K1-F9
tcgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgtttttttctttccatcgtggagaatttaagttattatccgtttgctgcaaaaaaaaaaaataatatttatttatt

SEQ ID NO: 51597 - DNA, 426 bp, Zea mays
  Clone ID: LIB3067-016-Q1-K1-G1
ggaaatggcaaccgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaagttagtgacaactactacaggcctgatctgaccaagccagcttctgctaggctaaactcggtgtaccgcagtcttcaagttgccaagtccggtgtcaaagagaagaacag

SEQ ID NO: 51598 - DNA, 157 bp, Zea mays
  Clone ID: LIB3067-016-Q1-K1-G11
aggaaggtgaaggtgttactcttgatgggaatggagccgagacaggacagataattgtgacggcaataggaggtcataatgggaagccaaagcagaaggtctcatacatggcggaacgggttgttggtactggttcgtttggtatagttttccaggc

SEQ ID NO: 51599 - DNA, 168 bp, Zea mays
  Clone ID: LIB3067-016-Q1-K1-G12
cacagttccacgcagcagatcatagagtctgtatgtgcgctagcgatctagctgccgctgggctgcttacagtacgtagtaccatggctaagaaagtggccactctgctggcccataaccttcttttcttcgactacgtcgactcatgcagctgcaggtgcagcggat

SEQ ID NO: 51600 - DNA, 277 bp, Zea mays
  Clone ID: LIB3067-016-Q1-K1-G2
gggggtcgacatcgcggcgtacgggtcgtccaaggtggtgtccacccaggcgcccgttcagctgggctcccttcgcgccgccgactgcaaggagggcctataaactacgacccagggctggggctgtcttcgtccatcacagctggcgtaccatggcaggatatactgtttgcggtagaatatcacagtagcagctaaactagtacttctggaggttcaaacctgacggtcgtcttctattctaattttccattcatcggttcatttatttatgatg

SEQ ID NO: 51601 - DNA, 404 bp, Zea mays
  Clone ID: LIB3067-016-Q1-K1-G3
cccacgcgtccggggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgatgacgatgatgaccttgatccttttggggatgaaact

SEQ ID NO: 51602 - DNA, 343 bp, Zea mays
  Clone ID: LIB3067-016-Q1-K1-G8
ctcgccttcttccccgcagccagcacgagcttgtcgagatttcagctcgtttctccgccagaggtcgagcaggccagcttcccaggaccgaagctctgcccggttcgccagtccaggaactctgctctcccggggccagagatccaaacaaatctctgcgttggggttctccggggttccttgcgctggagggaggtttcgttctcgccggccatggtttggctgagaagaaacagcagcatattgatgcgaaatctctgagctttatgaagatcgccactcacctgcgccggttctggtttcttcactccttcttggtcgttttcctctactggggttatgt

SEQ ID NO: 51603 - DNA, 232 bp, Zea mays
  Clone ID: LIB3067-016-Q1-K1-E9
gctcctgcatacgagctgacccctgtcatctgttgtagcgaaccgtccgctgtcgccccatcggcctctgaagaagccacagttcagcgctactttctctatctcgcaccggatcttcagtgtcgcgctgggagttgccatcatatccgtcccactcgacaccaagttcagcctgatgtttggcgtttgagagcgatttgctgcgatcttatgaggatctgcatttccccgt

SEQ ID NO: 51604 - DNA, 93 bp, Zea mays
  Clone ID: LIB3067-016-Q1-K1-H10
ataatgccaccaagaaagacatacctgctgctgagccgataattgttccaattgtactgaggatgtctgattttgatcacaaagcattgctag

SEQ ID NO: 51605 - DNA, 418 bp, Zea mays
  unsure at all n locations
  Clone ID: LIB3067-016-Q1-K1-H11
ctgaacctccctctacatcccattctacctctcccggagacctcctcctggcagatcttttgggtcctcttgcgatagaaggccctcctgctgtagagcaaaatcctgcccaaggattgaatgctaatcaaagtccagctggtgacttggcacttgctacccttgatgatcagtccaactcagttcagccaattgtcaacgtcgaggagaagtttcatattttgtgcacaaaagatagtggggtgctgtacgaggatccttacatccagattggcttgaaagcngagtggcgtgcccatcatgggcgacttgttcttttcttgggtacaaaaatacttcagcccttacgtcagtgcgggcgctgatttggcttctagtcatttgaaatggaaccttctgcagtcctgatactattcct

SEQ ID NO: 51606 - DNA, 181 bp, Zea mays
  Clone ID: LIB3067-016-Q1-K1-H2
cgtcggttcacttctccaggtaaggaaagggttcgtactcatggcgccgtcgcagccaaagtcgggcctcttcgttggcatcaacaagggtcatgtcgtcaccaagcgcgagctgtcttctcgcccgtgccaccgtatggggaaatcaacgaatagggtgtctatggtcttgtgcctgatc

SEQ ID NO: 51607 - DNA, 342 bp, Zea mays
  Clone ID: LIB3067-016-Q1-K1-H3
cggacgcgtgggggagaactatgtcgagggtgaaaatgcttccaatggatccacacctgaatctaaacaaaagcaaattctcaaggttgttgtcacggaagttcttggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgtttacaaactcctggaacagagctatgattgttaatggacctcgttctgttgaatctccggacgacaagtttgaagtattctatattg

SEQ ID NO: 51608 - DNA, 205 bp, Zea mays
  Clone ID: LIB3067-016-Q1-K1-B9
ctgaaaccgtcaaataataatcgttgtatacgtgtaaataataataataataaggtaataataataataataataataataataataataataataataataataataataataataataataaactttgcagggaacaagaccctggccggtagctgcatctgctgcattagggacacgcatgagatgatcaacgtggcggcca

SEQ ID NO: 51609 - DNA, 143 bp, Zea mays
  Clone ID: LIB3067-016-Q1-K1-C1
ctcgcatcttcctgcgtcatccaagttctagcagcgcatcgctcggtttcggcaatgtcggggcgcggcaagggcggcaagggtttgggcaagggcggccccaagcgcaacctaagggtcttcgcgacaacattcaaggcatt

SEQ ID NO: 51610 - DNA, 283 bp, Zea mays
  Clone ID: LIB3067-016-Q1-K1-C10
attgagaagctgcagcttgttgaagctgagaaaaagaagattagacaagagtatgaacgcagagagaagcaggttgaagtacggaagaaaattgagtactctatgcagttgaatgcttctcgcatcaaagttcttcaagctcaggatgatctagtaaacaaaatgaaagacgatgcgatgaaggaactcctccttgtcagccacaaccaccatgaatacaagaaccttttgaaagatctaattattcaaggcttgctccgtttgaaagagccagctgtattgc

SEQ ID NO: 51611 - DNA, 58 bp, Zea mays
  Clone ID: LIB3067-016-Q1-K1-C11
ccttgccaacctcctcgttgaccccgaggacgcccaggagatcatagacaggcaagct

SEQ ID NO: 51612 - DNA, 116 bp, Zea mays
  Clone ID: LIB3067-016-Q1-K1-C12
tcgcagacgcgtgggtatgttgcggtaatgttatctcaaagtgcatcttcaaaatagcaactgccgtgggatacataccctgcgaatataactagaccatgcttgcttccgtctaa

SEQ ID NO: 51613 - DNA, 122 bp, Zea mays
  Clone ID: LIB3067-016-Q1-K1-C2
cacaaaatggagataaaacttcataagttggcataaacaatggatcatctggagagggcgtaaaggcatgaagtggcaccactgattgagcaagcttttcaaatacattttgaggaacagaa

SEQ ID NO: 51614 - DNA, 255 bp, Zea mays
  Clone ID: LIB3067-016-Q1-K1-C4
acgggaagccaacaagctagttttgcaattggctttaattcagattctcctcatgtcaactttgggaagagctacatagtttgaagaaactcatgatcgctggcttacacttgacgagctaggttcacctgatgatacaggagataaagtgtgtgctgttgcatgggcttctaacattggcagaccatatgatattatcgcatttgcgacctgcaaaggaattgcaatctggcatatatgtttgaacgctgattc

SEQ ID NO: 51615 - DNA, 177 bp, Zea mays
  Clone ID: LIB3067-016-Q1-K1-C6
acgaggaagagaagagacgcagccgggatcataggaagctgcacactttattgcttaaggagaaggcgttgattttcgggtcgccacctagtactagtaagacatgcagcttcaattggaggaccagcaactaccatacaaactcaaatagcgctggatgcatgaacttctgtgcca

SEQ ID NO: 51616 - DNA, 195 bp, Zea mays
  Clone ID: LIB3067-016-Q1-K1-C8
acctttagcaattgacctagtggaaaagatgctaacttttgatcctagacagagaataactgttgaaggcgcacttgcacacccttacttggcatcacttcatgacataagtgatgagccagtctgctcaatgcccttcagcttcgacttcgagcagcatgcattatctgaagaacagttgaaggatctgatcta

SEQ ID NO: 51617 - DNA, 161 bp, Zea mays
  Clone ID: LIB3067-016-Q1-K1-C9
gacacacgtccggatgaggtcatattcgaggaggaggaacatgattgacagacaacgagggcgcgcctcgaggacccgttaccgatcactagcagcatgcacagtgtcatggaatcctcattgacttaccgacagatccatatacatctagtactggttga

SEQ ID NO: 51618 - DNA, 130 bp, Zea mays
  Clone ID: LIB3067-016-Q1-K1-D10
gctaaaacaacgcacgttctattcacatggatctcaacactactacgaccacactcgaaccaacggggggatcatgatgtatctatagcagcctatcacacaccaccatgcaacaccgccaccgcgccac

SEQ ID NO: 51619 - DNA, 285 bp, Zea mays
  Clone ID: LIB3067-016-Q1-K1-D12
cccacgcgtccgcccacgcgtccgccctcggctgcctcccgcagccgcccgctgctccggtgcttccgaacgctggcctgttcttccctgcctttggcccattcgtcaggcggcccctccgcaggcgacgcatgcgcgggcacgacggctcgtggccccgactacgtattcagctaaccggtctacgtcttcggcccttctcctgtcgcccgattgagtcgctgctgcaactgctaactttaccttggtctagcttaccacagtctttcggaaaggtgctatcaa

SEQ ID NO: 51620 - DNA, 116 bp, Zea mays
  Clone ID: LIB3067-016-Q1-K1-D2
gccatcttcggcatgggcctctacttctactactccgtcgtcgagagcaggaagaagaccgaggacgctagctcgctgccggtcgccgcgcagatgatcgagaaggacttggcgcc

SEQ ID NO: 51621 - DNA, 432 bp, Zea mays
  Clone ID: LIB3067-016-Q1-K1-D5
gttaatttaagcatatttcaaggaaaatgttgtagttattccataagcatatgacaacatgcgcctaaaagctttaacggataggacactaatttattgtacattgtaactcaaattgttctaactcaaatagtggattttggacaacctattgtcactagttatagatatatttacaggatgtcaaacatctttcacccaatcacactattaaacctcaaaaaaacacccaaagcccttaaccatttcccttgcctcggtcttgaatgtatttgcccttaaaattacagcaaacaatcaatcccaagttttcaaaatgacaggtcatattaattattttcatgaccctgctcttttatctagttgtattggcatcaatcgatgattcagatgcagaattatctgaagttgtgattgatgttgtttcacatg

SEQ ID NO: 51622 - DNA, 59 bp, Zea mays
  Clone ID: LIB3067-016-Q1-K1-D7
cggacgcgtgggcggactcgtggtggggagaagttaatctgcatctgctagagtaggca

SEQ ID NO: 51623 - DNA, 74 bp, Zea mays
  Clone ID: LIB3067-016-Q1-K1-B7
tcgttcgcggtacgcgtgtggagaaaggggtgacggttggaacgatacaactcttaagggtagatcgagcgcca

SEQ ID NO: 51624 - DNA, 223 bp, Zea mays
  Clone ID: LIB3067-016-Q1-K1-D8
cccacgcgtccggcaaccacgttacgcaccatagaacatacccgtgagaagctaagacccggccgttgctcaccacagcatcatcgccgcgccgtgctagctcaaggatggagaacaacaggcagcagcagcaggcgccgtcgccgccaggctacccgacggcggctgcaggcttggagcaagagcagggaggcaggaagggacgacgcccggagaagacgac

SEQ ID NO: 51625 - DNA, 451 bp, Zea mays
  Clone ID: LIB3067-016-Q1-K1-E1
atcaggaggatctggaggacaaagatgaaacagaaaaagaagagaaggaaggacaggaaagaagcaatggccaatgcagaggagatgagtcaaccaaagctagtgaaaagatatggaatgagctcaccccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtccctgcaaatctcaaatgcagactcagtcatcaccatcggttcagaattccttgggaccactgtactttcatcagccactccattccccaagcttgagggtttaaagctcagaaacctgaataaaaccttgaaagtgggctttaactg

SEQ ID NO: 51626 - DNA, 168 bp, Zea mays
  Clone ID: LIB3067-016-Q1-K1-E11
cccacgcgttcgcccacgcgtccgctggcggctggccgacgagcggtcgttgccccgtggacgcgctgaagctgggcgtgtgcgccaacttgctgaacgggctgatcaacgcgaccctggggacgccgcccaggacgccgtgctgcacgctgattcaggggctggcgg

SEQ ID NO: 51627 - DNA, 239 bp, Zea mays
  Clone ID: LIB3067-016-Q1-K1-E12
acgccacgcgtgcgccgacgcgtgggtaaaaaccaataagcttcttgtcaaaaaaataagtatgatttagatgcggggatcctttaataaagcgttatgtttaggaagcaaagtagggtatcgaatagactgcaactcggaatagagaaaccttgctattggtagccatattgcatgacaccaaagtataatacactatcgtgttgtatgaattgctagaatggtatgttgggctagtc

SEQ ID NO: 51628 - DNA, 345 bp, Zea mays
  Clone ID: LIB3067-016-Q1-K1-E2
cacctcctcaacctccagcccaacctccagcccggaatcgagagcaatggcgctcgccaaggccaaggagatcgttgccttcgctcccctcgtcgtcttcagcaaaacttcctgccctttctgcgtccgtgtgaagcagttgttcgagaagctcggagcatgctacaaggccattgagttggataaggaaagtgatggagctgagctccagaatgccctgaaggagtggactggacagaagactgtcccaaatgtcttcatcaatgggaagcctattggctgctgtgatgatactatggcactgaaccattgttgggaaagctggttcctcttgctgactgatgc

SEQ ID NO: 51629 - DNA, 352 bp, Zea mays
  Clone ID: LIB3067-016-Q1-K1-E3
cggacgcgtgggcggctctgccccaactctactggagcggatataaggagcgtctgcacagaagccgggatgtatgccattcgtgcccgcaggaaaacggtgacagagaaggattttctcgatgctgtcaataaggtcatcaagggctaccagaaattcagtgcaacacccaagtatatggtgtacaactagagagtgtcttcatggaatatgttgattttagaactccgggatcttttcggtgattgtgtcatcgtgaggttctatgcaaggattgttgtttgttttgaaatctggatccccatggattgcattctgtaccacatgtttttaagacaaggtttttcccctt

SEQ ID NO: 51630 - DNA, 359 bp, Zea mays
  Clone ID: LIB3067-016-Q1-K1-E4
ggatgaaggaattgaggtgataactgaactgcctcagaaaagacctaaagttaggcctcgcaaagcccaatcagatgtagtaggaaagagaaccaagctgtcaacacatcccactttatgtaataagaggcagcagatcaagcaaggatcaaatccccactgtgcaactactactgctgaagcacatggatcaaaatggaccaagtatttggacacgagccgttttggtgggaggaaatgcttcgatacctctggtctgcactggactgaacatgatgaatctgccactactgaggctactactgacataatggtggatgatgaggttcaccctgatttcatctgatctcatgttggtt

SEQ ID NO: 51631 - DNA, 381 bp, Zea mays
  Clone ID: LIB3067-016-Q1-K1-E5
agactgacgaaatagaagagatgtgattattattattattttcttcttgtttcccccatgcctagtaaaaacgcttgatcctagtagtatattatgtaggagaggtagataggagttgttgttgcgttaaacgatcgacaaatcgatcggtagaatgaattaatgggccagccagcagagtgtgatctcactatctgatgagtgataggatgtactccctctgtccggagatccagtattaaattaaatccacccagtgaaacaataaatacatcaacgagctagcatagacgatccacactacacaagcgaagcgaatctgctgctgatatcgtcggcgacgtgcatcttatctagcagtgttggcctttcccggaactc

SEQ ID NO: 51632 - DNA, 84 bp, Zea mays
  Clone ID: LIB3067-016-Q1-K1-E6
ccacgcctccgctctgttactcgatgactctgttatacgttgttaaatgcctatatctgtgggtcctagaaaaaatctaaaata

SEQ ID NO: 51633 - DNA, 269 bp, Zea mays
  Clone ID: LIB3067-016-Q1-K1-E7
attggagttgaatgttaagcatctgttttcgtacattggcacaaaccctgctgacgatgacaacacgttcatagaagacaactcgttgccatcattctcaaaggctgttaatcagcgcgacgctgaccttgtctacttctggcagaagtaccggaaattggcagacagcttacatgagaaaaatgaagctcggagggagttgcttgaagtgatggcccacaggtctcatgttgacagcagtgttgagctcattggaagccttctctttg

SEQ ID NO: 51634 - DNA, 282 bp, Zea mays
  Clone ID: LIB3067-016-Q1-K1-E8
cctttttcctttccacgccttcccaccactcccagaggacccagacagacccctttcccgggcctcctcgaccactccgacgcccacagcgccttcggcgagctccacctctccaccggcggcagcgaggggcgaggggggctaatactgtaggcggaggaggaaccgagccgatggggcagcagtcgctgatctacgcgttcgtggcgcggggcaccgtggtgctggccgagtacaccgagttcaccggcaactttaccaccattcgcgtccagtgcctgc

SEQ ID NO: 51635 - DNA, 487 bp, Zea mays
  Clone ID: LIB3067-007-Q1-K1-C4
cggactcgtgggcggacgcgtgggcagtttttgacacagactggtctgatgttgattgtcacatttttgtagcacatactcttaatgatcgggccaaaaagtctgttttcttgaatggttccttcctatttagggttgatatgtagtatcactgttgctgttgcacttttgtcacttgtttcatttagtttatggaattgtgccgttttctaatcggtaatggtagattttcatttctttactatttattgatttgtattacttgtttctattattatttttcattgttttattattctttttagtttttcttttttcttctttggtttttatttttgtttttgttttatgttttttttttttttatcttattattttttttgtttttttatttttttattattttttatttatcttatttttatttttttattttttttttttctttttttattattatttatttttttttttatttttaattttt

SEQ ID NO: 51636 - DNA, 373 bp, Zea mays
  Clone ID: LIB3067-007-Q1-K1-C5
gttggcatcccactcaactacaggcacatggagggctttggtgtcaatacctacaccttgatcaacatggatggaaagcctcaccttgtgaaattccattggaagcctacttgtggtgtgaaatgcttgctcgacaatgaagctgtgactgttggaggcacctgccacagccatgctactaaggatctatatgattccatcgcagctgggaattaccctgaatggaagctctacattcagactattgatcttgaccatgaggataagtttgactttgacctgctcgatgtcaccaagacctggcctgaggatatcatcccgctgcatcccgttggactgatggttctgaacaagaacgttgacaacttctttg

SEQ ID NO: 51637 - DNA, 141 bp, Zea mays
  Clone ID: LIB3067-007-Q1-K1-C7
gttatgcttcctctcaactacatgaacaagttcggctcaggtgtcggttcctacgggttgatgaacaaggatggtaagccttaccttgtgaaattccattggaagccttacttgtggtttgaaatgcttgctcgtcattga

SEQ ID NO: 51638 - DNA, 241 bp, Zea mays
  Clone ID: LIB3067-007-Q1-K1-C8
ctcattcttgcaatcaactgcagttgaaggcaagctttcaacaaccaatgctgcaactttatgatcactgacggtgagcgtctgtgctttaatgcctataatatgtatactcgtgacgatacatgctggctcgtgactgaacctaccactgttgatgtcacttgtcattatggttcgtttgttgcatcatatgtttcttttatacgatgtgaattacttattattttgttactttacttat

SEQ ID NO: 51639 - DNA, 368 bp, Zea mays
  Clone ID: LIB3067-007-Q1-K1-D11
gcggaccgtggtctgaaactgaaacagccttcactaccattccccgctgacgctcgctgctcggaacacctgcttgtcgtttctactcccagcatgcttatgagccgtggtcgttccttcttctgtttcttgctttgtctttgttttctaattttttttttattgtttctttattttttttttcttctttttttttattatttttttatttttttttttcttttttatttttttttattctttttattataatttttttttttttttttttttttttttttatctctattttttttattattttcttctttatatattcttctttactgtttttttttttctattcttttttttttatttataatttt

SEQ ID NO: 51640 - DNA, 119 bp, Zea mays
  Clone ID: LIB3067-007-Q1-K1-D2
attgtgcctgatccaaatgaataaggtgtaatgactcgtcttttcaattactgaaactgaacatgtttgaatttatctggtcacttgtatggtaaaatagcagcgttgtcaattgtcat

SEQ ID NO: 51641 - DNA, 117 bp, Zea mays
  Clone ID: LIB3067-007-Q1-K1-D3
acctcgagttctcctcaaccatattgaaagttacagcggctaaactatcggcgatgtctggcctctgcaagggcatgaagggtctgggcaagggcagtaccaatctctaccataagg

SEQ ID NO: 51642 - DNA, 387 bp, Zea mays
  Clone ID: LIB3067-007-Q1-K1-D4
ctaacttttggaaaatcaaaaattcatggatatggtgtctttgccaaggttgcacacaaggccggagatatgatggttgaatacataggggagattgttagaccaccgatatcagacactagagagcggcgaatttacaactcactagtgggtgctgggacatatatgttcaggatagatgatgaacgtgttatagatgccactcgggttggaagtatagcccgtctgatcaatcactcatgcgagcctaattgctattcacgtgccataactattcttggagatgaacacatcatcatttttgcgaaacgggacatagatccattgtaagagcttgcatatgattataggtttttatcaagtgatcaacgtcttttcatgtttttg

SEQ ID NO: 51643 - DNA, 52 bp, Zea mays
  Clone ID: LIB3067-007-Q1-K1-D6
cccacgcgtccgaggacgcttgggcttctgttttatgtaaagactgaaactt

SEQ ID NO: 51644 - DNA, 346 bp, Zea mays
  Clone ID: LIB3067-007-Q1-K1-D7
cccacgcgtccgctagttgctcatttccagaactcaagtttgatgaatgaggataaacgctgccgccctatactcttccactctgatggtccgaatgcaggagatcaagaaccattccctgtgggatcaaatgtccgttctatgtctgtatggtccatgattttgagcttgtaattttactattattactttgtgttttttcattttttttgtttttatttcttttttgttttaaagttatattattttttttttttctatatttactgtattttttttcatttttttttttatttctttttcttattttttttatttttttactatttgcaattcttaatttatt

SEQ ID NO: 51645 - DNA, 417 bp, Zea mays
  Clone ID: LIB3067-007-Q1-K1-D8
aacgtgtctgccgaggacaagacaacggggcagaagaacaagatcacaatcaccaacgacaagggccgtctctccaaggaggagatcgagaagatggttcaggacgctgagaagtacaagtctgaggatgaggagcacatgaagaaggtggaggccaagaactctctggagaactacttttacaacatgcgcattatgattaatgactagatgattgcgttttatcttgttgtctttgtctagattgttatttattatttttttactcagttatatttttgctttattcttattattttttctatttttattttatttatattctttttatttttctttttttgtttatttttttttatttttatatatttttattttttttttttttatgttttttttatttcttttttaattttt

SEQ ID NO: 51646 - DNA, 62 bp, Zea mays
  Clone ID: LIB3067-007-Q1-K1-D9
cggacgcgtgggcacaaccatggggcaccaggcgcatcacggcacggactacaccgaggagc

SEQ ID NO: 51647 - DNA, 72 bp, Zea mays
  Clone ID: LIB3067-007-Q1-K1-E11
cccacgcctaccacttggactaacactagaatgaaacttatatcgtggcatgtatctttcgagaactgcttt

SEQ ID NO: 51648 - DNA, 294 bp, Zea mays
  Clone ID: LIB3067-007-Q1-K1-E3
aggacgccaccccgaacctcaccctccggggcttcggctccgtgcagcgcgtcaaggaccggctggaggaggcgtgcccgggcaccgtctcctgcgccgacgtcctggcgctcatggcgcgcgacgccgtcgtgctggccaacggcccctcctggcccgtcgcgctgggccgccgcgactgccgcgtctccctcgtcaactagaccaaccagctgccctcgtccaccgtcaacttcacccgccttgtcagcatgttcgccgtctagggcctctccgtcagggaccttgtcgtgc

SEQ ID NO: 51649 - DNA, 271 bp, Zea mays
  Clone ID: LIB3067-007-Q1-K1-E4
cccacgcgtccgggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagctcggaggaggagcggtaccgcatcagccccgtg

SEQ ID NO: 51650 - DNA, 456 bp, Zea mays
  Clone ID: LIB3067-007-Q1-K1-C2
cccacgcgtccggggatgaaagtgccatgaacgaaggcacaccctcagccaaagcacagctgtcttgccccgagggtaaaagtatatcttccgtgaagtttgcgagcttgggaaaccccagtggaacctgtagatcataccaaatggggcgctgccaccacccgaactccttatctgttgttgagaaggcctgtctgaacaccaacagctgtacagtctccctgacagacgagagctttgggaaggatttatgccctggagtcaccaaaacacttgccatcgaagcggactgttcttagtgacgtacggagtactaagtatctcggtgtgcatctaggttccaagtatgcccgtcaaaattctaaaattgtagtgcttcttgcacggcaatgctattgtaacctggatttacccgctaatatgtttcctaaaaaaaataaattatttatttttttt

SEQ ID NO: 51651 - DNA, 380 bp, Zea mays
  Clone ID: LIB3067-007-Q1-K1-E5
gcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgtcgaggcctacctcgtggggctctttgaggacactaacctctgcgccatccacgccaagcgcgtcaccatcatgcccaaggtcatccagctcgcgcgccgcatcatgggcgagagggcctgagcgagtcgagctcctcttaccgcatgcggcgtctttgttgctattgtcctgtttgtatgattttgtcatttattggttttttatttggttgtttgtttacttggttccttttttcttgttcttttg

SEQ ID NO: 51652 - DNA, 126 bp, Zea mays
  Clone ID: LIB3067-007-Q1-K1-E7
gccacgcgtccgctccctatatggttgttcagtggatatacagatgcaggcatatgggtttcttgaactagatacagtatcaatacaatctagctttcaactttaacaccatggcatgcttgatac

SEQ ID NO: 51653 - DNA, 290 bp, Zea mays
  Clone ID: LIB3067-007-Q1-K1-E8
gttctagatcgcgagcgccgcccttttttttttttattgttatgaatttaatagcattgcaagagacttgtgatatagaattgaatacaagaaatgtccacatgcatgtttatgcagatacaggtacaaccatccattctatcagataaaacataaacagtaaacaaatacaccttaccccctctgttagaatcagatttgcatctgaacctatagatctatcattggctaatggggatgttaaaacagaagaaactcatttttttcagctttctttaggcatgatcatt

SEQ ID NO: 51654 - DNA, 332 bp, Zea mays
  Clone ID: LIB3067-007-Q1-K1-E9
ctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagcccggacaagtactggagcccccaccccaagaccggcgtgttcggctccggctgcggttgaccccaagct

SEQ ID NO: 51655 - DNA, 62 bp, Zea mays
  Clone ID: LIB3067-007-Q1-K1-F1
cggacgcgtgggtacggcctcgactgctccatgtcgctggcaatagatgcccgtatatcata

SEQ ID NO: 51656 - DNA, 111 bp, Zea mays
  Clone ID: LIB3067-007-Q1-K1-F10
attcagcaacgtgatttgaccgtgtggctttgtggtgcctgcaaggccgtgtagcgaatctcatacgtgttcttgccggtggcttgttgatgctgatgactgttactcact

SEQ ID NO: 51657 - DNA, 389 bp, Zea mays
  Clone ID: LIB3067-007-Q1-K1-F11
ggcatgggggtttaacaatgtcatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctactttgcgctgattcgtgaggaagaagattgagatcgtcccatgtagccgatgtacaatctttgatggcctttgttcccggaacaaatcattttttcatctgttgtctcggatggatcataaaccttagtcccctttgtttagacatgggacgaacagcaccatttttccttgtttagctatgcataggatttttgggtcggttggt

SEQ ID NO: 51658 - DNA, 321 bp, Zea mays
  Clone ID: LIB3067-007-Q1-K1-A11
agcagcagcacccgaggatggtgaagttcctcaagcccggcaaggccgtgatcctcctgcagggccggttcgccggcaggaaggctgtgatcgtgcgcgtgttcgaggagggcacccgcgaccgcccctacggccactgcctcgtcgccggcctggccaagtaccccaagaaggtggtccgcagggactcggccaagaagacggcgaagaagtcgcgcgtcaagtgcttcatcaagctcgtcaacttcacccacctcatgcccactcgcttcaccctttaagtcgacttcaaagacgttgccaacggccggcccgactcgc

SEQ ID NO: 51659 - DNA, 195 bp, Zea mays
  Clone ID: LIB3067-007-Q1-K1-A12
gatggacatcatagatcttgaggatgagactatagatgcagagatattgaactcgatggctgttacaaatgaccatttcaagactgctcttggaacaagcaacccatctgctctccgtgaaactgttgttgaagtcccaaatgtctcttgggaggatattggcggtctgcagattgtcaagagggagctgcatga

SEQ ID NO: 51660 - DNA, 430 bp, Zea mays
  Clone ID: LIB3067-007-Q1-K1-A2
ggagagagagaggagtgggagacccgcgagaggctgccgtgtagggaccaccgtagactcagcgtctcagctactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaaacgcctcgacgacgacaccgagaacctcgcccatgagcgagttccaagtgatctgaaaaagaatctcatgcaagcaaggctcgataagaagctgacacaggcacaacttgctcagatgataaatgagaagccacaagtgatt

SEQ ID NO: 51661 - DNA, 404 bp, Zea mays
  Clone ID: LIB3067-007-Q1-K1-A3
aacactgggtggtttcttttcggcttttatggtgcggagccttttaatctcagtttaagacttttaatattatatatttacatggctctgtgttctgtcttttaatgacctttttttttttctctgtgctgtatattttttttttttctttttttattttttttcattattttttttttttttttcttttcttttttgattttattagttttttttttttttttttcttattatttctttctatatttttttttatctttattttttttatttttttattttatattatgtttttgtatttttgattatttttattgtttttttgtcttatttattttttattttttttattttcttttttgttattttatattttttacttttttatttttatttattttttt

SEQ ID NO: 51662 - DNA, 411 bp, Zea mays
  Clone ID: LIB3067-007-Q1-K1-A4
gcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttggtgtcagtcttgagcgtgctgcagttgctggctggcccagtcgctgccgcgagttatcgtcgtcggtcggtgcggtgtgtccgcttaaactttatttgtggtgggctggtacttttgtggtggttattttttttggacctcgtgatagtcggtcgggtccatgttatcgcggctactggcaaaccttaagtgatac

SEQ ID NO: 51663 - DNA, 410 bp, Zea mays
  Clone ID: LIB3067-007-Q1-K1-A5
agcaagcggagctgcatctggtgctttaacatatccaacgcagcagtatccatctggaagaactcctgctgatttagcatcagaaaatggtcacaaaggcattgctggttttcttgcagagtctgctttgacaagtcacctctcagctcttacattaaaagagtcgccaagtggcaatgtggaagaaatatgtggattaacagcagctgaaggttttgcagcatcaagttcttcccagcttgcttgtgttaattctcaggaagagtccttaaaagattcacttggtgcagttcgtaaatcaactcaagcagcagccagaatatttcaagcttttaggtgggaatcattccacagaaagaatgttattgaatatggagatgatgattgtggattgtctgatgaacgcacac

SEQ ID NO: 51664 - DNA, 470 bp, Zea mays
  Clone ID: LIB3067-007-Q1-K1-A6
gaacctattggcatctcgaaagatgggaaagaggtttacttccgggatgtttggccatcaacagaagagatagccgaggttgtcaagtcaagtgtgcttcctgacatgttcaagagcacatatgagtccatcacccaaggaaatcctatgtggaatgagctgccagtctcaacaagcactctctatccctgggatccatcatctacatacatccatgagcctccttacttcaaggatatgacaatgactcctcctggcccgcgaccggtgaaggatgcatattgccttctgaactttggtgacagtatcacaactgatcacatctcgcctgccggaaacattcacccagacagcgcagctgcaacatatctgaaggagcgtggtgttgaaaggaaggacttcaactcatatggtagccgaagaggaaatgatgagatcattgctaggggaacctttgcaacatttcgctt

SEQ ID NO: 51665 - DNA, 391 bp, Zea mays
  Clone ID: LIB3067-007-Q1-K1-A7
attcgctccactgacctcacggggctcccagcagtaccgtgccctcactgtgccagagctgacccagcagatgtgggactccaagaacatgatgtgtgctgctgaccctcgccacggtcgctacctcacggcatctgctatgttccgtgggaagatgagcaccaaggaagtggatgagcaaatgctgaacgtgcagaacaagaactcttcctactttgtggagtggatccctaacaatgtgaagtcgagtgtgtgcgacatcccacccatcggcctgaagatgtcctccacattcatcggcaactcgacctccatccaggagatgttccgccgcgtcagcgagcagttcactgccatgttcaggaggaaggccttcttgcattggtacacg

SEQ ID NO: 51666 - DNA, 256 bp, Zea mays
  Clone ID: LIB3067-007-Q1-K1-A8
cagtgtaaaaatattagacaccaccctacgctgtgatagtgacttcaatgcatcagagctggggcagcatacatgatactcaacgaactttatgtgcgctagttatattatactaacacactactttacatcatgtgctctatcaatttgtaagatgatcaccaattaaatttatttactaatgcttacctgtcgctataattatattaattatctaaaatatttgtattctatgaatttgtattcaattgttttt

SEQ ID NO: 51667 - DNA, 352 bp, Zea mays
  Clone ID: LIB3067-007-Q1-K1-A9
cccacgcgtccgggggcagggccaccccgtcaagctcgtgccctacaacccggactaccaggacgagtccgtgctctggaccgagagccgcgacgtcggcaacggcttccgctgcgtccgcatggtcaacaacatctacctcaacttcgacgccttccacggcgacaaggcccacggcggcgtccatgacggtaccgagatcgtgctctggaagtggtgcgagggcgacaaccagcgctggaagatccttccttggtgaacgaacgaatgaaactactagctggtaccctaataataattctgctggctgcggcgatcccataaataaagatgcccggtgcgattgcatttt

SEQ ID NO: 51668 - DNA, 178 bp, Zea mays
  Clone ID: LIB3067-007-Q1-K1-B11
atcaacagccccaacgcccgccgcacgctcacctcctgcggcatcgccgtcccgagctgctagggcgctagctcgtgcctcgtggtgtgggtgaataaaaagattcatgtcgatctctgcttactgttatcgtatctgtagtaccttgagtgatatgaacaatatgtattatttacca

SEQ ID NO: 51669 - DNA, 326 bp, Zea mays
  Clone ID: LIB3067-007-Q1-K1-B7
agctctaccggttcgacatggaggcgaaccagtgcaaagaacgtggcacaggcactgtgaagctgcttaagcacaaggagaccgccaaggtccgcctcgtcatgcgtcaggcgaatacgcttaagatctgtgctaaccatctggtggtggcgacgactaagatgcaggagcacgcatggtgcgacaagtcgtgcgtgtggctcgctctggacttcgccgactgtgagctcaaggaggagatgtttgctatcacgatttggatctgtcgagaatagctagaagttcaaggacactgttgaagagatagctgaagagcatggtaagac

SEQ ID NO: 51670 - DNA, 409 bp, Zea mays
  Clone ID: LIB3067-007-Q1-K1-B8
cggacgcgtgggcgtggcaagtcatcatcgaggatgcccctctcctagagaagctggtcctctgccgccgctcggctgctgttgaatctttccagctactagtggtcagcgctccaagaataagggtcctgggatccctgtccttcagcatccccaagttggagattggtggcaccgtctttcaacccaccgtgcgccgtgtcaaccgtgtggggcctgacgatgttatcatggagaagcgcttgctgatgcaggccgtcatgctggcgacgactctgcgaaccgtcaagattttggcgctggaagatgcagattccatcgacatcgtcagcgactacttgaagtgttttccatgcttggaaaagctatacatctcggcatcacaaggatacagaagtgctggaagcta

SEQ ID NO: 51671 - DNA, 146 bp, Zea mays
  Clone ID: LIB3067-007-Q1-K1-A10
gggctcgcaatcaagcactccctcggccagtcccacccggtcaagctcgcgcctttcagcccggaccaggaggacgcgtcggtgctgtggactgagagcaaggacgtgggcaaggggcttcgctggatccgcatggtcaacaacac

SEQ ID NO: 51672 - DNA, 314 bp, Zea mays
  Clone ID: LIB3067-007-Q1-K1-B9
cccacgcgtccgcccacgcgtccggcggccgtagagaggccgacgcgcaccagcagatcccaaactcaccggggaggagggagtgggcgaccggcggcggcgatgggtttcatcatggagttcgcagagaacctgatcctccgtttgatggaggacccggacaagcgcgaccaggttcggcgggagcatgcctacaagatgaaggagcggtgcgagcgcaccaaggcggcgtggagccttcctctgcgctcctacagcttctggaccttcgaccgcttcaactcgcagctcttctgggacctgctgatcagtca

SEQ ID NO: 51673 - DNA, 271 bp, Zea mays
  Clone ID: LIB3067-007-Q1-K1-C1
attcgctccactgacctcacggggctcccagcagtaccgtgccctcactgtgccagagctgacccagcagatgtgggactccaagaacatgatgtgtgctgctgaccctcgccacggtcgctacctcacggcatctgctatgttccgtgggaagatgagcaccaaggaagtggatgagcaaatgctgaacgtgcagaacaagaactcttcctactttgtggagtggatccctaacaatgtgaagtccagtgtgtgcgacattccacccatt

SEQ ID NO: 51674 - DNA, 456 bp, Zea mays
  Clone ID: LIB3067-006-Q1-K1-G12
cacacgcgttcgtacatacaacgaagtaccatcaagctttgcctcgcttatgtgtgttagagtcattccctctgagaatgtttcataaatatatgtcaacttatcgattaagatatgcctataatggccatcttgatcttagatgggtcaggttgtcatatgtcctataaatattatctaacatagaaaaaaaaggaatacaaatataattgtcagccaaaaaatgtttcgatagcctgttaatggtctgtatttcatacgaatgtaacctttcaacagctttgattgatattatgtacctctacagatggcagcagtggaaattctatgtgtgcaactagaaccaagttaccgaccggtgattagcgcctattgagctcaatatgatattacagtttatttgtgctcaaccaccgatggcgtctttattactgtgcattgcatattcttggttag

SEQ ID NO: 51675 - DNA, 296 bp, Zea mays
  Clone ID: LIB3067-006-Q1-K1-G2
aagaaacacgtgaaacaagtcagaccagtctccttccgagccgtcagtagtcgtgaaccgctgagcagatcacagatccttgaagggtaggctgtacaaagtggaatgtttggccatgagatgatggatacagtcgctaactcgctatgctcagccaagctgctgatgcagaaggctgaagctgaactcggcgatggttctcagcgacactagaagataggttgatggtcagttaggactaactgtactgtacggtatcactgcaatgcaagggactcattggatgggagcatgac

SEQ ID NO: 51676 - DNA, 293 bp, Zea mays
  Clone ID: LIB3067-006-Q1-K1-G4
gttctagatcgcgagcggccctttttttttttttttaagaatatgaacggtcattttttttcaggcataaatataaatccgttctcttgccatggtatttagcacgctcaagcatcatttgaataagtcttgcgaattcaacacaggttctacgaaagttgctttggctaaggaacgactgcaatgtcgagaaacgacactaatttctttcagcgcttcccactaccgtcgtccaacttggggcccttggaacccttctggaccgtaccctttgtctgcgtcttctgggactt

SEQ ID NO: 51677 - DNA, 398 bp, Zea mays
  Clone ID: LIB3067-006-Q1-K1-G5
attaactaaagttcctttgctatgtgataatgagagtgcaatcaaaatggcggataatcccgtcgaacatagccgcactaaacacatagccattcggtatcattttcttagggatcaccaacaaaagggagatatcgagatttcttacattaatactaaagatcaattggccgatatctttaccaagcctcttgatgaacaatcttttaacaaacttaggcatgagctaaatattcttgattctaggaatttcttttgttaacttgcactcatagctcatttatataactttgatcatatgctatgactaatgtgttttcaagtctatttcaaaccaagtcataggtatattgaaagggaattggagtcttcggcgaagacaaaggcttccactacgt

SEQ ID NO: 51678 - DNA, 77 bp, Zea mays
  Clone ID: LIB3067-006-Q1-K1-G7
cccacgcgtccgaaaaaaaaaaaaaaataataaaaaaaaaaaaaaaagcaaaaaaaaaaaagaataaataaaaataa

SEQ ID NO: 51679 - DNA, 310 bp, Zea mays
  Clone ID: LIB3067-006-Q1-K1-G8
gtcccccgtcacagtcccaatcgcaacccccgcctgcagcacgcgtcacgccacgccacctctccccagggtccggcgatgtcggcgccctccgacgccgcggtggcagcctgatcgcccgcatccactaccaccgccgccgcctccagcggtgggcttgaccttcaagctccacccgctcgtcatcgtgaacgtcttcgaccaccacacccgcgtcaaggcccaggccgcctgctccggggacagctcttccccctcctcgtccgccccgggggccgggcagccgccgagggtgttcgggtgcgtgatc

SEQ ID NO: 51680 - DNA, 292 bp, Zea mays
  Clone ID: LIB3067-006-Q1-K1-G9
atcactttgttttttatttagctgctacctcatggcggtactgcatttgcagataatgctggagtcattgtgaaccccaagggcgagatgaaaggatctgctatcactggacctattggcaaggagtgtgctgacctttggcccaggattgctagtgcagcaaatgctattgtctgatactactggttgagaatagtttattgtgatccattttaaccttttctgcacttcaacatttgtgggaatttacttgattaatggactaaaggaaaagacgcttatgcgcacaatt

SEQ ID NO: 51681 - DNA, 358 bp, Zea mays
  Clone ID: LIB3067-006-Q1-K1-H1
tcgaccacgcgttcgtccacgcgttcgcccacgcgtccgcccacgcgtccgcagactttggacttgcaaagcttttagaggatgaagaatcacatattactacaatagttgcaagaacattttgttaccttgcaccatagtatatgcaatttggcagagccacctagtgagactgatgtctacagttttggggttatggtactcgaaatactcagtggaaagcggcctactgatgcatccttcattgagaagggactaaacattgttggatggttaaattttctggctagtgagaaccgggagagggaaatttgtctcctgaactgggaaagagtgcagactgagaccttatatgctc

SEQ ID NO: 51682 - DNA, 122 bp, Zea mays
  Clone ID: LIB3067-006-Q1-K1-H10
acgcgattgaaccgtgaccgtcatttggctggagaagtggatgataacatgttgagcgggctggtgtgtggtacccctaggcaagagtctaacaatcaactctgacatatgatggagtgact

SEQ ID NO: 51683 - DNA, 390 bp, Zea mays
  Clone ID: LIB3067-006-Q1-K1-H11
ctttctcaggaacctttccccatgggttcaaacatccgagccaggtctgggagatcccggacttcttcgggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttatgctgctgcagaagttttgtctctggcaggtagctatatgcaagagggtggtaccggttc

SEQ ID NO: 51684 - DNA, 435 bp, Zea mays
  Clone ID: LIB3067-006-Q1-K1-H12
gactgattgcctggagatgcgtgtcggggccatcgagcgatccggcgagcgggtgctggtcatcgacgacctggttgcgaccggagggacactctgtgctgcgatcaggcttctagaacgtgctggagccgatgtggtcgagtgcgcgtgtgtcatcgggctcccgaaattcaaggatttgtacaagttgaatggaaaacctgtatacgtgctggttgagtctcgtgaataatcggagaaatgacaacttatgctcaggtgtcagagtgatcagggatattggctgtttactccttgctactgcgattgaacagtggagggacgacatggacaaggacaagtatattcggtgcatcactaagtcttggtgaggggagagattgtagtgttttaggctgagtagtgaagaacctgtagttctgcacggaacatgat

SEQ ID NO: 51685 - DNA, 313 bp, Zea mays
  Clone ID: LIB3067-006-Q1-K1-H2
cccacgcgtccggagatatgcaggcagttagaaaggccattattgctggttcatttactaatgcatgtcatctggaggaatacagccaaaacggaatgtataaaacaattaggactttgcaagaagtctatattgatccatcttcagttctctttagggttaattctaagtgggttgtctaccagtctctcgtctcaactgacaagcattatatgctgaacgttattgccattgagccatcatggcttacggaagctgcaccacatttttatcagttccgaacattcaatcctgcttcccactaacattactg

SEQ ID NO: 51686 - DNA, 404 bp, Zea mays
  Clone ID: LIB3067-006-Q1-K1-H4
gaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaagtggaagccataaacaagatctccaagtatgtcgcccagctgaggagagtgggcaaggggcacggggtgtggcacttcgatcagatgctgcttgaggaagaggccttaaaagaagaacggacagatgaatgaaggaaacaagtgtgtaatgttgatcaggcggaggaaaaatgggtcaactgacaac

SEQ ID NO: 51687 - DNA, 352 bp, Zea mays
  Clone ID: LIB3067-006-Q1-K1-H5
atcacgcgttcgcccacgcgtccggtcatgtatcttcgaggcgttccagaggatgcagagatagaggacgcagagtgagaagatgcgatcaatgttagattgataaatgtaatgtggttctgacatctatgttcgaatatgccggagacaaggagatctatcagatcgctttgttctcttgagtgatgaaacatgatggcgtcgggccaagggtgaagctgctttcagttatgctatgctgtcattctgctgaatgtatatcagatttcttgaacaatacttcttgtctcattgcctactatcacggaataagttatatcaggggaaattgaccgggtcttttttttcccgt

SEQ ID NO: 51688 - DNA, 416 bp, Zea mays
  Clone ID: LIB3067-006-Q1-K1-H6
cggacgcgtggggtccagaagctcgtgctcaacatctccgtcggcgagagcggtgatcgcctcaccggcgccgccaagtgacacgaccttgacagtcaatatgctctttcaggagatggtcccagttactttacatggttctgttggacacaatgaagccatccatatatgctattaaaaatcctgctagtcattatggctttaaactgtaccatgtctgttctattttcagctaggcagagcatgttctatttacagcaggccagcagacaccaggcagtaatgtgatgtatgagtcaattataaggatggaaatgttttttggcagcttttctcagtggatcagtatcaccggaaaaactttttggacacctagatgtcgagagatgcccattccctgaggaatttcaatggag

SEQ ID NO: 51689 - DNA, 405 bp, Zea mays
  Clone ID: LIB3067-006-Q1-K1-H7
catgatttcccagcctatgctacttgatttgcctccaataattatgtttgatgtataaaaaaacaccattttggaggcgcaggggcaactgagcaacactatgtattgactatcttagagatactacagcatatgctccttgtaaagcaggttgagactatcattctgcagttcttattatataggatgattacgaaggtaacatgtttgggacagtaacatttgcttgaaatgtatatagtctacaacaagaataatgccagcattcttgaaatgtatcgcctaggagaatgctagcacttacgggtgtgacgaacgatctgctgtcggttgagatgaaaaggcgttcgccttctattaaggatgtaaatggtacaaaaggatgtaaaaggtacagatattatc

SEQ ID NO: 51690 - DNA, 370 bp, Zea mays
  Clone ID: LIB3067-006-Q1-K1-H9
gttgatcttttgctaggccaaaccagtttgttattttcttgtctaacaatactgccacgacataacattgggagctctgtacagatcaaagaattccatccttgtgtttgcatggacccagaaaatgcagatttaagaatgatgcgagtgatggaggcctatcaggtaactttgtgtactatagttgtgtgtttctacaagtgcgtatggatgctatcataataaccacgatcaaacatcatcaaacaactacaatttacagtgcaagtttggtgcgcaattggtggtgatattatcttctagacatatatagatttattaatttcccctttttagtagacattgcctatttttttctacaattgagttt

SEQ ID NO: 51691 - DNA, 467 bp, Zea mays
  Clone ID: LIB3067-007-Q1-K1-A1
gcctgctatgctagcgctggatccagtgtgttggggacgcagatctatccgtgctcaactgtgatggtgacaatctggaagggaaaggtgttggtgctccatttgagcaggggaaaggggatgattcatcgccagcggaggtgcattggagcagcatggttcatcagactggtggtggcatcagcatcgtggactagagaggttgcgcttatgtgagagcctagagttcatggaccgatggtatgttgaggtgggatggtaggtggtattattttgtttttttctttttttttgttttttttttatatttttttattttatattctacttttattattatttatttctatttacttttatttacgtaatatatcttcttactttttttattttcttttctttttattattttttttttttttatatttttatttatgttttttatttatttttattttatttatttt

SEQ ID NO: 51692 - DNA, 433 bp, Zea mays
  unsure at all n locations
  Clone ID: LIB3067-006-Q1-K1-G11
cggacgcgtgggcggacgcgtgggcggacgcgtgggcttaaagccacacacaagaaatatctcattgctgcaaaggaagaggaggtcaccgaagggaagaggcttcctctcgaggaggtggaagagaacgcatgcatcagccactgaacagaacaagcaggcgatttttttgtgtggatggcgtctgccacaaaaggattgaatcgaggagtgtgctctggttgtgaagtgataactaggctaccacatgttcattttcaaaagttttcgtgtgtgatcgtgatcaggggtgaaactgtggtttcagccaacaaacttgcaagttctattgcttcttcccacttttttcctttatatatatnttggatcggttacagaacatggtttatccagtggtatgctgatgaaagatgctaagttcgcttaaaataat

SEQ ID NO: 51693 - DNA, 489 bp, Zea mays
  unsure at all n locations
  Clone ID: LIB3067-027-Q1-K1-C1
cccacgcgttcgcccactcgttcgcccacgcgtccgggacgagatggacacatcaagccctgcagcacttgtcaatgcacagatgctgaacatgtttgttgggcgaagagtgcgcacggttgttcaagtccaacacaatgaaggtggagtgcttgtcgggcagtccaccgatgggcaccagttgtgtgtcaaaagtgccatggacgtccccgtatcacattttatggaggtttatggaattgctgaaaacagccagaccatccgtgctgaagtttgcacagattttggtcccaactttgatcccaaggtttttgatgagttgtgcaagctggcgagtggcaggttcaagcacctgttcctgtagagataatcatcgcatggaggatcttcagccaactgaagcttgtttgaaactgaatggttcgccttntaatntaagatttggctacatgtntccttcattgcatggaggaccttcagtaccctgtt

SEQ ID NO: 51694 - DNA, 215 bp, Zea mays
  Clone ID: LIB3067-027-Q1-K1-C10
accatctggaaagcgagggcagttatcatgccttgtgaagatggtttgttgggattgcgatgccctttatgcgtcctgtttttttatttgtcatcttctgctgtatcatcctttctttgaactatattttcatgtggtacatgataccttttgttaccttcgccacagtactgctcacgaatagcattttgagccattttgctatgccttggaat

SEQ ID NO: 51695 - DNA, 454 bp, Zea mays
  unsure at all n locations
  Clone ID: LIB3067-027-Q1-K1-C11
ctcttccttatctccatccccttcatgatcaagaggattatcgatggggagaccctgctgcatgacccccgggtctggatggctggggcgctcttcgtctatttcttcagcgtctcggggggcatgtatgggattatcaggcacacgcccatgttcctcaccgaccgcgcggatcccaacaagctcgtgttcttctaccaggggtcagggatgcagttgggggctgaggggtttactgtcgggttcttgtacacactcgtgggtctcatgatcgctgtggtgacacacttgttggtgaaggtggagagcctgcagacacagcgccttgcgatgctcgctgtcatggtggtcgngtggtgggctgttaggaaggtgatctacttagataactggaagactggctatagcattcatacctttttccgagcagctggaggtgaaattcttgctgggt

SEQ ID NO: 51696 - DNA, 424 bp, Zea mays
  Clone ID: LIB3067-027-Q1-K1-C12
ccattacaagagaagccagtgtgacaagagctacacctgcagccgttgcaacaccaagaagttctctgtcatcgcggacttgaagactcatgagaagcactgtggtcgtgacaagtggctctgttcttgcggaacgaccttctccaggaaggacaagctttttggacatgttgcgcttttccaaggccacacacctgcgctccccgtggaagacggggatgtaccagaaggttcagagcagcctcaggacggcgaaccaacgaatgaaatggcgaggagcatggtgtatagcttcccgtgtagctcgtctgatggtttattgaacctcgacatgaaaatggctgatgacgtgcgtggttatctcttgccgcttagctttgataatgctttggcgcggttgacgactttactcggcctggatttg

SEQ ID NO: 51697 - DNA, 169 bp, Zea mays
  Clone ID: LIB3067-027-Q1-K1-C2
tcttctctcccactcttactcccactcttcctcccactcttactcatactctttttaaaaaaaaacgaagaaaatataaaaatccaactaaaaaataaaaacaaataactaacaaaacattcaaaacacccaaccataaactactaaacaataaaactaaacaacctaa

SEQ ID NO: 51698 - DNA, 468 bp, Zea mays
  Clone ID: LIB3067-027-Q1-K1-C3
agcactgcgctggtagagcgaacgacggcgagcaaggtgctggcggagcgaagcggacgacggcaacggactacctacgggctggtggcgtagcacggtgcgacggctccccttctaggcaagctcgacgggggcaggtccggctctcccccatcgatggcgcgacggtgtttgggcgatgcggccagtggatggcgcgggccccaagcgaactctgggctgagccagcttccctctccccaagtgacagtgcggtggactctccccctgaccctctccctaggtgctcatggtcagcagtgccaccctcatcccactcctggccacctccatttgttgtgtagtggcgccctcatccccctcccagcctcatgttccccaattgatgtatgtgtgtcaatttagtgatgatgtcgcttgcctcatcatctaccggtctcactcggtgttcaacccgaactaggaatg

SEQ ID NO: 51699 - DNA, 432 bp, Zea mays
  Clone ID: LIB3067-027-Q1-K1-C5
ggttgatgctacaggagatgattatggcgatcctgacctgttttctattagtgttattaagggtggaaaagaacttgaagctgttgaatcagcagagattgatgtggaagatgaaattggacacggtgataatgaggatactcaagctcttgaagactctgatgaggaaatggattctgacgaggaacagcagaggtatgatgcccagcttgaagagatgcttgatgaagcttatgagcgctttgtaactaaaaagggtggtgaaataaagcaagaacgcaagcgtgcaaaacgaataaatcctgacgctgatgcagaactgttagagggaggtgaagatgatggtgatgttgaaatggatcaagattttgatgaagatcaagatcaagaggccaacccccttctgtttgccctagatgaagcagagccaac

SEQ ID NO: 51700 - DNA, 455 bp, Zea mays
  unsure at all n locations
  Clone ID: LIB3067-027-Q1-K1-C7
tcgtccacgcgttcgctccttccttccatccattcctccctgtctccgccctcttctgactcccgtaggccgtggtgccgccgtcgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatgggccacatcggcctcatgaacctggatctcaagatgaacgaggctgccgncatgaagctccccttccgtggcatgccgtataacatga

SEQ ID NO: 51701 - DNA, 266 bp, Zea mays
  Clone ID: LIB3067-027-Q1-K1-C8
attcgtccactcgttcgcccacgcgttcgcccacgcgttcgcccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaaaaaaaaataataaaaaactataactatataataaagaaaaattaaatggaactaaatgaacgtcaacacacacgtacatgacaacgaaaaccctatcgttagacaacttatttaaaattgagaaaaa

SEQ ID NO: 51702 - DNA, 399 bp, Zea mays
  Clone ID: LIB3067-027-Q1-K1-C9
aattaaccatgaattaaatatgcctatcctaattttttaaaaacaaactaattttactgagggaaatgaaaaccctttccaaactagctctaaaggtagttaaactaaaccccattttccaaagaatttggaaaatctagttcattctctaaatcaagataatttaatacattcattttatacagccaaattaatttaaggtcattcgactattatcctccgttaccaaattggttgtgacgctggttgcttgcatttcattttatacacaaattatcccgaaccacgttcaactaaagcacaatttgatgcatcgcaaaaacaaaacataaaggcatgataacatcttcaatttccagacaatgggtgaatggtcctttagttgaggcccaactaatt

SEQ ID NO: 51703 - DNA, 283 bp, Zea mays
  Clone ID: LIB3067-027-Q1-K1-D1
tcccactcgttctaaaaaaacaaacaatactttataaataaaaaaaaaaaaaaaataaagaaagccaatattaaacaacaacaactactaaaaactatcctacaccaaaaacccaaaataattcttccaaccattctccatcaactagcaccaccatttgttccacttttacctaactatttacagcctgttacatcttttttactagctcctcattcagccctaggtgctttatgacctacagtgatctctcatgacatccaagctttcttacatcaccatt

SEQ ID NO: 51704 - DNA, 442 bp, Zea mays
  Clone ID: LIB3067-027-Q1-K1-D10
cccacgcgtccggtctctcagggctcattggatgcactaaatgagatactcaaagagcctatgaccaattaaccgcttcagaccaaatattttagtggaggggtgccacccatatgcagaggatatgtggaaatcagtaaagataaacaagttaacgtttcaaggtgtgaagttatgtggccgttgcaaggttcctacaattaaccaagacactggaatacctagccctactgaaccaactgaaactctgcagacatatcggtcgggtgaagtgctgcttcgtagccacaaaaacaaacggcaggtgtactttgggcaaaatgcagtctgcaaggaatctctgtcagcaaatgtggaaagaaggatcggcaaggtgggggatccagtttatgtgacacagtcgttcccttcatctggtgaaagtccattctgagtgaccgaa

SEQ ID NO: 51705 - DNA, 447 bp, Zea mays
  unsure at all n locations
  Clone ID: LIB3067-027-Q1-K1-D11
gccatgctttgtctgataagacttgaaacagatccacaagacaggacccaactgcggctgacagttgcctcgggcgatcaacatttgacattcgagttgaaagagttcgtcaaggaacatttgattgatatcccaaggactcaggctgccccacctatggcaatggtccagccacagttgcttactgcagcacctgccacatacaatgaccctggtgccatgcttgctggattgctatgagaagtaaaaaaacaaaagccatagtgttttgatgtacatgacagatgttgatctaacatctccaaaagcatcttgctgccaagacgaacacgtggagcaacgaaagggctggcggagtagtcttcagctggattctaaaccgagaaaaagctagattcttttgggcgggtttgaggcctncttccccttcatggagcagtccccata

SEQ ID NO: 51706 - DNA, 360 bp, Zea mays
  Clone ID: LIB3067-027-Q1-K1-D2
cccacgcgtccgcccacgcgtccgacggagcggagaagaagctggacatgatcagggaggacgacctgagcagcctgccgtacctaaaggcgtccatgaaggaggcgctgcggctgcacccaccggggcccctgctgctgccgcactactccaccgtcgactgccagatcgacgggtaccacatccccgccaacacgcgcgtcctcgtgaacggctgggccatcggcagagacccggcggtctgggagaagcccgaggagttcatgccggagaggttcatgcgcgacggctgggacaagtccaacagctacagcggccaggacttcaggtacctgccgttcgggtctgggcgccggatct

SEQ ID NO: 51707 - DNA, 65 bp, Zea mays
  Clone ID: LIB3067-027-Q1-K1-D4
aaaaaaaaaaaaaaaaaaaaaaaaaaaaaaaaaaaaaaaaaaaaaaaaaaaaaaaaaagggaggg

SEQ ID NO: 51708 - DNA, 450 bp, Zea mays
  unsure at all n locations
  Clone ID: LIB3067-027-Q1-K1-B9
ggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggccccttcatctgggattcattcgcgcacgtnccaagaaatattgcaaggaatcaaaatggagacgttgcaatggatcaatcccatcgcttcaaggaaaacgtccatctcatgaaaagtttgaactttgatgccta

SEQ ID NO: 51709 - DNA, 308 bp, Zea mays
  Clone ID: LIB3067-027-Q1-K1-A10
aaaaaacaaaaaaaaaaaaaaaataaaaataaattaaataaaataaaaaaaaaaaaaaaaagaagaaatataaaaaaaaaaaaaaaaaataaaaaaaaaataaaaataatataaaaaataaaaaaaaaaaaaaaaaaattaactattcccttttttaataaccaaaattatttcaccattaaattacatttaatatattatttttttatatctattttaacaaatttatttaccattttttaaaaactatttaactaataaaacctttataatccaaacatttatttttttaaaaaaaattctaattt

SEQ ID NO: 51710 - DNA, 247 bp, Zea mays
  Clone ID: LIB3067-027-Q1-K1-A11
cccacgcgttcgcccacacgtccgaccactcttacgtccactcgtccgcacacacgtgcgcgtgttaacatttattcaggttagcctcataatttttctccatgcacaatagtgtgattcacttaaatttcatactttcattttgtcaggaaacatgcttcaccatataactaaccatatcctttattagtgtactttgccatttgccctatatggccttttctatcaagctcaacaatgctaattt

SEQ ID NO: 51711 - DNA, 315 bp, Zea mays
  Clone ID: LIB3067-027-Q1-K1-A12
gtgcgccgcgctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcatcgttttgtgttgtggtcgaataaataatgtgtctgtgtgccgatcccgtgtcgggttagtgggcccactgtcggtgctgatgtggcctgcctttacagcacatcggtggggctgggccgtagagctcctgtgtcgtttaaatatatgtgtactctgtactgtaccaact

SEQ ID NO: 51712 - DNA, 408 bp, Zea mays
  Clone ID: LIB3067-027-Q1-K1-A2
tcatgccaagcttatctatctttacgatggtttgattgaatcggcggcttcgagacaaatcagaattgatggtgctctcaaggttggacagaaacgtggaagattggttgcagatctagaagaagatgaacaacctaaaaagaaggttagattatggagcccatcggctcaatggatttcagtttataatgctaggcggcccatgaagcagaggtaccattacaatgtggctgactcgaggctaatccaacatatagaaaagggcaacgatgatgggctttacattagcagcgtgactttctcagcaaacctttgggcactcatcatggacgcatgaactggtttctgttctcaggtttatgagctctcaccagttttccttcacaaggactgtataatgaagcattt

SEQ ID NO: 51713 - DNA, 284 bp, Zea mays
  Clone ID: LIB3067-027-Q1-K1-A3
gcggtctggttgtgaggaaggatgcatctagctcgtgactctctgaccccaagcgacccaagccagggtggtactggaggtactggctcgtgcctatgcaatccgatggagggcgagatcagggacgagtaccgtgaccgtatgacgctggcattctcagtcatcccctcaccggacgcatctgataccgtggttgagccatacaatgccactctttctgtccaccagttggttgagaatgcagatgagtgcatggttctcgataacgaactcctgtatgacat

SEQ ID NO: 51714 - DNA, 259 bp, Zea mays
  Clone ID: LIB3067-027-Q1-K1-A4
cggacgcgtgggaaaaaaactaatagctaatacacatactaaacaaaactgacaaacgggcggcattgccatgtgacccaccgtgatgatgagcctcgtgggcaaccggcgttgaccctttccagggtctcaagtacggcagcagccttcccgtcgtccgcagagcaccaggagcctcggcaacgtcagcaacggcggaaggatccggtgcatgcatgtgtggccggcctactgctacaagaagttcgagacgctgtca

SEQ ID NO: 51715 - DNA, 304 bp, Zea mays
  Clone ID: LIB3067-027-Q1-K1-A5
gttgtgaggaaggaagctgagaactgtgactgcttgcaaggattccaagtatgccagtccgttggtggtggtactggatctggtatgggtacgctgttgatctcaaagatcagggaggagtaccctgaccgtatgatgctgacattctcagttttcccctcaccgaaagtatctgataccgtggttgagccatacaatgccactctttctgtccaccagttggttgagaatgcagatgagtgcatggttctcgataacgaagccctctatgacatctgcttcaggactcttaagctgaccaccc

SEQ ID NO: 51716 - DNA, 413 bp, Zea mays
  Clone ID: LIB3067-027-Q1-K1-A6
caaggcagtaacaagcttagcatcaagcagagatggacttctacttgtctctggatctgaggatggtaatgttcgggtgtgggataccagatgtcagcaagttacccgaaaattcaaacactcccaaggtccagtaaccaatgttcttattgtaacgccacaacgagtaaatctgccaccgctacaaccattacgcaaagttcggtctgcaaatggggaggctgaacggcaggcagtacttcttcatcggcctgaaaatgatgtcccaattcctggaaataagaccttcatttttatggagcgctacttggatgagcttcagaagcatggtggttcatccaggttatttgattttgggccgaatgctcagaatggcactccaaaccaacaaggtacagaatggagagatagat

SEQ ID NO: 51717 - DNA, 375 bp, Zea mays
  Clone ID: LIB3067-027-Q1-K1-A7
gtctgctcgtctgtcgtctccacctcgtccctcacctctgaccccaagcgacccaagccaaggttgcaccccacccccgcccccgcccctatccaatccgatggagggcggcgactcgtccggcgccggcgccggcggcgccgtggccgcggcggccaagtggcggagcgacgcgtcgcgggcgttccagtactacctggaccgctcgacgcctcacgctacggggcggtggctcggcacgttcgccgtcgcggccatctacgcgctgcgggtctacatggtgcagggcttctacatcgtcacctacgggctcgggatctaccttctcaaccttctcatcggtttcctctaccgcatggtcgaccccgagctcga

SEQ ID NO: 51718 - DNA, 92 bp, Zea mays
  Clone ID: LIB3067-027-Q1-K1-B1
agttgaatgatcttcaatcagaggtatgcgtatacacataattaccagtgcctgtacgtctgaagtcttttgggacagcaaggattgtgact

SEQ ID NO: 51719 - DNA, 448 bp, Zea mays
  Clone ID: LIB3067-027-Q1-K1-B11
atatggatgaggtggagagttcaaaaatttgtattgattctggctcatgttgccttgcacgctactcaaaattgagtccacatcaagttttgacgctttaatcaccaattgcccttccaaaggctgctaagaaccccacagaactggatggattgaggaaggcgcatattcgatatggtgccgctgttgtacagtaccttgcttggctggataatcagatgcacgagaactatcgagcttctggatatttcagtgagataaaacggtcacataaaaatgaacatttagcaaccaaacttactgacgcgtctgtgagtgacaaacttgaaagctatcgtgcaacataagagaactttaaaggtttgagctttcctacaatctcatctgtgggaacaaatgcagcagctattcactataaacctgaatcaagcacatgttcggaaatgga

SEQ ID NO: 51720 - DNA, 302 bp, Zea mays
  Clone ID: LIB3067-027-Q1-K1-B2
ggcggcggctactgcggtggctggcgccgttatggcggctgcggctactgcggtggcggcggctgctactgtggctgcggtggctactgtggtggtggtggcggctactgcggtggcaaccgtggcggcggctactgcaactcctactggaactggaggaactgagcggtggtgcccgctcggccaagttatcctgttcgctaccgtgatgtttaccctagtccagatggtttatcttcgttcgtctcgattgttgttgcccatctgtgtttatgattgcaaggtctctctgtgtcagctgt

SEQ ID NO: 51721 - DNA, 451 bp, Zea mays
  unsure at all n locations
  Clone ID: LIB3067-027-Q1-K1-B3
cccacgcgtccgtgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggctcgtggagcttctcctccatccatcaccatcggtgcttatacctgctctacgaactgttgggaatattgtcactggagatgatttgcaaactcagtgtattattgatcatcaagctcttccccgcctcgtgaatctgttgacgcagaaccacatgaaaagcattaagaaagaggcatgctggactatttcaaatattactgctggaaacanagatcagatacaggctgtcataagttgccgtatcatcgctcctttgt

SEQ ID NO: 51722 - DNA, 312 bp, Zea mays
  Clone ID: LIB3067-027-Q1-K1-B4
ggaacctcgagcgcccgctgtgcatccccaaggaggagctgcttcctcgtccgccgggcggggtgcgcgtggaggacaccctgctgctcgcgcaggttacaaagttcacatgtggtggatttgctgtgggcatttgcttcagtcacttggtgttcgatgggcagggtgctgcacaatttctgaaagcggtgggtgagatggctaggggcctccctgagccatcgatcaagccaatctgggctcgtgatgccatccccaacccacctaagccacccctaggtccgccgccgtcattcaccgcattcaactttg

SEQ ID NO: 51723 - DNA, 401 bp, Zea mays
  Clone ID: LIB3067-027-Q1-K1-B6
gcgagcgcaattccccggcgacaactacgtctcggaagtagacgcgggccgcgacggacaggtggaccggcgtgacttgggcaagatgaagcacgggtgcgagcattaccggcggatgtgcaagatcgtggcaccgtgctgcaaccaggtgttcccctgccgacactgccacaacgaggctacggcttgcggagatcggcatacaatatgtcgtcaggatgttgaaaaagtagtttgcctactctgtgaaacaaaacagtcggtgtcacaagtgtgcataagctgtggagtcaatatgggagagtactattgtgatatatgcaaattgtatgatgatgatacagacacagggcagtaccattgcatcgactgtggatatgcagggttggtggcaaggaaaa

SEQ ID NO: 51724 - DNA, 427 bp, Zea mays
  Clone ID: LIB3067-027-Q1-K1-A1
agcaatctctagcagcagatcctcgtgcgaagcaaagcgctagcccccttcgtactgtccggatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgattcgcaagctgccgttccagcgcctggtgcgtgagatcgcccaggacttcaagaccgaccttcgcttccagagctccgtcgtcgccgcgctgcaggaggcgtccgaggcctacctcgtcgggctcttcgaggacaccaacctctgcgccattcacgccaagcgcgtcaccatcatgcc

SEQ ID NO: 51725 - DNA, 457 bp, Zea mays
  unsure at all n locations
  Clone ID: LIB3067-026-Q1-K1-G3
atgctacgcagggttgagccatatgttgcatatgggtacccaaacttgaagagtgtcagggagttgatctacaagaggggctatggaaagctgaacaagcagaggatccctctgtccaacaaccaagtcatcgaggagggcttgggcaagcacaacatcatctgcattgaggatcttgttcacgagatcatgactgttggcccacacttcaaggaggcgaacaacttcctgtggccattcaagttgaaggcgccgctgggaggcctaaagaagaagaggaaccactatgttgagggcggtgatgctggtaaccgtgagaactacatcaatgagctcatcaaaaggatgaattaggttcacgatcgagctcattgataccctgtgctctaagtgactngtgctantcctattttatattagaaaggtggatcgntgatgaatatgcatgcaagtttga

SEQ ID NO: 51726 - DNA, 400 bp, Zea mays
  Clone ID: LIB3067-026-Q1-K1-G4
cggacgcgtgggggcgccaagactgggcctggtgattttaggcttgatgttgcttggatcaaagcgttgagagctttgtgaactccacaagtcatagttttatttcacatcggccctttccttctttatcaccctgccccagtggcgccgctgaactcatcacccgaccacaaccacaggagtaaccatagcacagattgccaactcctttatgcacttaataatggattttgttttgcttctgaggtttatgaataagtggtagaaaaatggagcatttagttaaggtgccccctttggacagatgttgctttttctctctctctagtatctgatcggccgataaaacgagtgcattccacccggacgataatgcgagagtaggattcagtttaattct

SEQ ID NO: 51727 - DNA, 445 bp, Zea mays
  unsure at all n locations
  Clone ID: LIB3067-026-Q1-K1-G5
cccacgcgtccgcggacgcgtgggctcgccatggcgttcttctctcatcaccatctgcagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggtgttggcgctgtctctggaggaccggcgccacggcggcggcggtgctgggaactcctctggcgattcaccgctgctcctgctgcccatgctggacgatgacatctnacgcgaggtcc

SEQ ID NO: 51728 - DNA, 459 bp, Zea mays
  unsure at all n locations
  Clone ID: LIB3067-026-Q1-K1-G6
cccactcgtccggacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggttttcacttctggggcggacatctacgtcgttggcctcaacatcacaacgcaagtcagcttcacagataaggatctcctggagctaagaaactcgcaagggaagtacgcacagttcctatgtgatgtatgcaagttctacttggactggcacaccgagtcttatggtgctcctgctttgccgcgctagttcgtccggagctgttcacgttcaagaagggcgtggtgagggtggagacgcatggcatctgcgtcgggcatacttncatggacatgttgctgaagaagtggaactca

SEQ ID NO: 51729 - DNA, 443 bp, Zea mays
  Clone ID: LIB3067-026-Q1-K1-G8
cccacgcgtccgctgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtggggcggcaccgacgacagcgacgaggcctccatgccgtccccggcggtgctcttccggaccaccgaccgtcgtcacagccaatgtgtttggggaggtacaggtatcgggaatttctgcaggttcaaggcacatgaaataaaatccttggtcacgaggtcagctcaccgc

SEQ ID NO: 51730 - DNA, 115 bp, Zea mays
  Clone ID: LIB3067-026-Q1-K1-G9
tacgagtatacctacgtgtatcgcggagtgtgggatttgtgtttgtgctgcccaaacagcaggatgctagaaaaaactcaaagatatttaagttaaaaattttaattcttggatc

SEQ ID NO: 51731 - DNA, 444 bp, Zea mays
  unsure at all n locations
  Clone ID: LIB3067-026-Q1-K1-H1
ggttactttcaatcaatcgactctacctggttgggtgatggcagttgcgtggctattgtatgtgatttggctatgggtctcattcaaagaaccgaaccgtgctactgaggtgaatgaagccccacaaaatcctgcttctggacaaacggttgatattggacaagtagagaatggacttgctcagcctctgctcatggattccgtagataaacaaaatgaagatgaagatgaagaagttgatgaaagtgaagaagctgcagatgattcacgcaagcctgcaacatcaattggctcagcatacagactgcttactccatcagtaaaggtccagttgttgatatacttcatgctgaaatacgcaatggagattttgctttcagagtctagtgttatcactaatcactatntcagttggaacacatgcgcattggcaatttttctagc

SEQ ID NO: 51732 - DNA, 267 bp, Zea mays
  unsure at all n locations
  Clone ID: LIB3067-026-Q1-K1-H10
gaagaagatacagcgttaaagacgctgcccattgtgtcaaaagaatggtgcccttgcagtgtgctgcggttttttctagaaatataatgcgttttaattactagttggagggagacctgtcttgttcaatttgttcatggaccanaagcaataatctatctgtgtgtagctggattggtgttatgcgatgtcccctaccgtgtgtcccagaatctacttggtgattttatcccagtgttgttaatcaagcttgtgtgattgttaagt

SEQ ID NO: 51733 - DNA, 463 bp, Zea mays
  Clone ID: LIB3067-026-Q1-K1-H11
cacaaagcgccgtcgtcgccccatcgaacatggctccgaagaaggataaggccccgcccccgtcgtcgaagcccgccaagtccggcggtggcaagcagaagaagaagaagtggagcatgggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggattcccttgtttgccctctctgtaggagctcgtcttctttagaacagttgccatctctgtcaagagtttgctaatgctatgttagatgagtttagtttgg

SEQ ID NO: 51734 - DNA, 232 bp, Zea mays
  Clone ID: LIB3067-026-Q1-K1-H12
gcggccacgccttcgaacttggagcacaagttcagttcgccgtactcttggtagcttggatgaaatggtactagcaaaccactaccaaaggtacacaaaaggctcgtggcaacttcagcttctgcttggtccggttctgtcacgaaagatcatcttcgggtcgagggttgacagaatctggggcattgacataccaccagattctgtcaacccttaaattcagagatacttg

SEQ ID NO: 51735 - DNA, 316 bp, Zea mays
  Clone ID: LIB3067-026-Q1-K1-H2
tcactcgttacgcctacacatatcctctctacctggctcaatcactaaacaccacttacatatatggagggtagggctccatatgcctaacgcgcttgccactacctccttcataacataccaatatcctagcacacctcacgtataactggatccctgacacatgacatcttcgaagatacactcaagtgacacaaacttcacgctcttcagacgacgagaaccgacacttctaataaacacccttaggctccccctgctcataccgactgatatacctatacaccatactcatcatgatcgcgtggaacagcac

SEQ ID NO: 51736 - DNA, 375 bp, Zea mays
  Clone ID: LIB3067-026-Q1-K1-H3
atcgcctctcagaaccgagatcctcaaaacccttctcccccctcccggatcgagtgcttgagctccgaccaaatctcgcagcggctgcaattccgagcccgaagagcggatcaggcgaggacgacgccttcgattctgatctgcggtcggctcgacctatagagaaccggagatgcatcagggcgactgcacggaggctcaggtgacgtgggaggaccagcagaacatcaaccgcttcggtcgcctcaacaaccgccttcacgagctccaggacgagatcaagctcgcgaaggagacgaatgagaaccttgatgatgctgggaatgaactcatcttgtcggatgaagacgttgtacgcttccaaattggggaagt

SEQ ID NO: 51737 - DNA, 440 bp, Zea mays
  unsure at all n locations
  Clone ID: LIB3067-026-Q1-K1-H6
cggacgcgtgggcggacgcgtgggcggacgcgtgggcgaccattccttcttcgctggttcggcgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatncaggtgaaccaagccca

SEQ ID NO: 51738 - DNA, 372 bp, Zea mays
  Clone ID: LIB3067-026-Q1-K1-H7
cccacgcgtccgaggaagtcgaaaggatgaacccaggtgccctgaactcaaggtctgaagatggtctatctgactcgctgggaagaggggttgcttccaaagatccccgaggaggccggtctacttcgggtcttgattcccagaaccggttatttggtcaatccgtgaagccctttgaagtgaatccgaccaaacgcgtgaatcttgccgcgtaaagagtgaatgggacaatgtgtgtatgcctccgggtaagccctgtggtacccagattgtgtcctcgcgccagtttaccctttaagctcagattttgggtgtgccctgtgctctggtctgtgctctagatattgtgtcacagcacgcaatgcatgcgcg

SEQ ID NO: 51739 - DNA, 417 bp, Zea mays
  Clone ID: LIB3067-026-Q1-K1-H8
ctcccctcccggccttcccttcctccccgccctccgaagtccgaaggccagaagcttccgggggccagcccaagccatgaacgccgccagcaccgccgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagatggccccaaaacagtaaactcttcttcaatcaagagcatatgggtttcagcaatgtcaatgac

SEQ ID NO: 51740 - DNA, 467 bp, Zea mays
  Clone ID: LIB3067-026-Q1-K1-H9
cgcagcagtgcccgccgcaggggaccggcgccgccgacccgcccctgcccatggaccccgtggcgcgcaccgccttcgacaccaactactacgccaacctggtcgccaggcgcggcctgctcgcctccgaccaggcgctgctcgccgacccggccaccgccgcgcaggtgctcgcctacaccaacagccccgccaccttccagaccgacttcgtcgccgccatcatcaagatgggtgccatacaggtgctcacaggcacagccggcaccgtccggaccaactgcagggtggctagctagctcatccatgatttacgtctacctgtagactcatgtgcttatataaaatcatacgacgaaactgtacgtacggcgtagagtggtgtggcgaggtccaatgattcagattgtacgtacgtgtccatcgatccaactgtagttgtgtacgcagtacagtacgtgctagct

SEQ ID NO: 51741 - DNA, 355 bp, Zea mays
  Clone ID: LIB3067-026-Q1-K1-G2
aataaaaaataacataaaaataatcaataaaataaaacaaaaaatacaaaataaattaaaaagggtacagagaatctaataaagaagataaaaatagaaaaacaaaatacaaaaagacaaaaaaaactaaaatataaaaatatggggcgcccattttaagttcctccatgtttacgtgcttggacttactcagtatatcatcttttatggtgaacctaattttaattctaatgccctctctttaaaaacttgatacctggtaaaccccttggttcaccccattttttcccctatcagtaaataccttttttataagctgacgttttctctaaaaggccctctcttttggcccttc

SEQ ID NO: 51742 - DNA, 267 bp, Zea mays
  Clone ID: LIB3067-008-Q1-K1-H12
actggattgtgttggtgccaattgcgtggtttttgccgaggaagttgtttactggttaatcttcagctaggatggtgggcgcgcctccgcaaggaccacaatgcctgttctggctacgcgctgatgaacaatgaaaatgaaccactgttacctgcaacagcatcagcagcagcatgtgcaacccaaaaggagccgtattccccagtagaaattttgtactggacaaaagcacgggttcaaaaaggttcggcccttaaaaattgctct

SEQ ID NO: 51743 - DNA, 305 bp, Zea mays
  Clone ID: LIB3067-008-Q1-K1-H2
aattgaacttaaatctgtactagctattaaaacgcacgccaatctctctattgttgcatgtcgcatagcattggagctgtaaatgatgcaagaggtattaatcatggatgttgtgttcataattttgctaacctggtttagcagcatgttggtggacagcgtctggtatagtgcacgcgcgtgctctgaggctgtcttctgtgttccacttaaataatagttattttttatgttctcaaagtctaatgattacaaatgtgtgctgtttttttgttatttatgttgctttatcagttttttatttt

SEQ ID NO: 51744 - DNA, 396 bp, Zea mays
  Clone ID: LIB3067-008-Q1-K1-H4
cccacgcgtccgcccacgcgtccgcggacgcgtgggttcgacttcacctcgcagaacgtcccgcgcgcgctgtggcagcccgtcaagggcacccgcctgtaccgcgtcaggtacggcgccgtggtgcagatcgtgttccaggacacgggcatcttcgccgccgaggagcaccccatgcacattcacggctaccacttctacgtgctggccacggggttcggcaactactacccgcgccgcgacgccgccaggttcaacctggtggacccgcccagccgcaacaccatcggagtgcccgtcggctgctgggccgtcgtgcgctttgtggccgacaacccctgggtgtggctcgtgcactgccacatcgacgcgcactttacgggagggcttgtcatg

SEQ ID NO: 51745 - DNA, 301 bp, Zea mays
  Clone ID: LIB3067-008-Q1-K1-H5
gttgctttgaggcaaattgaacagggatttgtttggcttccaaatggtttgttggtcctaaaatagtcagaatcacatgacatctgtgttatagatatggacctcggtggttttctccacattaggaaagccggaagagccttttgaactcatttttttgctaacagtggtgttattgtgaaacagagttttgtgtgtatgtaccaacaactaaaatgtaaacacgacattatcatagttgagtacaggaataattatctcttaaaaaaaaataatttattaaaataataaaaaatggtct

SEQ ID NO: 51746 - DNA, 312 bp, Zea mays
  Clone ID: LIB3067-008-Q1-K1-H6
gccattaaaccccacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgtctcggatccaccatccagggcggccttcgcgtcgaggaacaggtttcaaggcatcgtacaatcatgaatatttctgaagaaagagccaaggatccatatagatgtgtttgttgctccaagtgcatcattcattggggat

SEQ ID NO: 51747 - DNA, 313 bp, Zea mays
  Clone ID: LIB3067-008-Q1-K1-H7
cccacgcgtccggtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggctgcgagtccatctacggcgagaagttccccgacgagaagttcgtgcgcaagcacaccgtccccggtgtgctct

SEQ ID NO: 51748 - DNA, 446 bp, Zea mays
  Clone ID: LIB3067-008-Q1-K1-H8
cccacgcgtccgctctgcttcatgaaggttcatgtgagccaaggattcaggaagttgaagcagaagttcaggaaccttcagttcatccttggggaggtctttcgacaacaaaggatggcatcctaactcttcttgattgcttcataaatgcaaaatctcttcatgtgatccagaatgtatttgacaatgcacgtgcgagagaacgtgaacgtgagatgctttaccctgatgcatgtggtggcggtggcagaggatggattagcccagtgatacctaactatggcaggggccatggaacacgagatacctgtgccttgcacactgcacacctttcttgtgatactctggtggatttttggtcggctctgggtgaagaaactagatcatctcttttaaggatgaaagaagaggacttcattgaaagacttatgcacagattcgacagc

SEQ ID NO: 51749 - DNA, 380 bp, Zea mays
  Clone ID: LIB3067-008-Q1-K1-H9
gtctgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttctagaagctcgtcgtctaggccgtcaag

SEQ ID NO: 51750 - DNA, 433 bp, Zea mays
  Clone ID: LIB3067-009-Q1-K1-A1
cccacgcgtccgcccacgcgtccgcccacgcgtccggcaaattgcagctgctcgtcgccggcgatcgccgcagggttcgtccgagaggggagaggctctctgtatcggggcatggtgatcctggaccgcactccggccgcggcgcagggggccgcctgtagcccgctcccgaagtcgcctaggttttcgtgggaggtggcctcgccgccctcggaccccatcctcccgtacctcaggtctattagtagggccatggatgagctcggaacagggcctcagtatgacacgacagccttagacaggctcaagcattacttgactgaatgcattgcaaaatatggtgatgactaccaatacttcactgatccatggttgctcaagatttggatcctctatgcagatgcaattgaggacttccccagtgtttacaacc

SEQ ID NO: 51751 - DNA, 212 bp, Zea mays
  Clone ID: LIB3067-009-Q1-K1-A10
ggagcacaagtatttcgaagatgcatccattttgtatgaaaggggcgtgaaaatattcaagtgtgggctcatgttaaggccatgtgggtaacctaccttacaaagtttgtacatagatacaagagaagcacgttataacgagcaagagaacttttacatgaatctgtccaacatgcttctacataggaaaagaagccccattatttacaatg

SEQ ID NO: 51752 - DNA, 226 bp, Zea mays
  Clone ID: LIB3067-009-Q1-K1-A12
aaaaaaaaaaaagaaaatttaaataatcaattttctatacaaaaacataaatcaagatccaacgcgggcattttcaaaaaactaggcagtacacattacgctaggtggcttcagattattcaacttgctacacggttccaattcaattgattaccatacactcattcatcgtggcgcacgccactcaccatacgcagtggacaaacccccacaacttattaccaat

SEQ ID NO: 51753 - DNA, 410 bp, Zea mays
  Clone ID: LIB3067-009-Q1-K1-A2
cccacgcgtccgctctctctctgtctctctctctctcgtccccctctcgctctcagacgaccggtgggccgacgccgccgccctaagccaggtgctgaggctcttgttggtctcttcgccagcgaggagcacccagcaggacaaggcaacaggctgttggaatatggaccaacaaggcatgcatgaccatgaaagggtccacgttgttggatttgaagtcccgccttcaccggattccagctacgacaaccctgttcctgggaatgaagacgaatgccgggagcccccactgatgccacctcatctgcagcacacgctgctgagcttaccaccaagccaagaacagtcgagcccgctgccccagccccagaccgtggttctgaaccaactttacatcgagatagagaaca

SEQ ID NO: 51754 - DNA, 411 bp, Zea mays
  Clone ID: LIB3067-009-Q1-K1-A3
tcgcccacgcgtccgcccacgcgtccgccctctcctagtctcctctccacactcccgctctcctgctactctgctccgtgatctggtctggtgagatcggggatcggaccgtcgactcggcgagacatggcggactggggccccgtggtggtgggcgtggtgctgttcgtgctgctctcgccgggcctgctctgcgagctgccgggcacccaccgccacgtcgacttcggcggcttccacaccaacggcaaggccatcttcgtccacaccctcgtcttcttcgccgccttcaccatcctcacgctcgcgctccacatccacatctacaccggctagctagctagctagtgcggagcacatgccgacggtctggactcgcggaggtctcagatcagaaaggaacgccggccg

SEQ ID NO: 51755 - DNA, 417 bp, Zea mays
  Clone ID: LIB3067-009-Q1-K1-A4
cggacgcgtgggtgcagaaccgaaaccacccacgcgcgctcgctccccgcgcccaattcggagatccacccccccaccgaatccgctcgcctgcgcctgcgcctgctacctgcgatccatctctcatggcgaccaccagcgccaggaggccgagcggcccggtgctctcggccgcgcactaccgctccgcctcgccgacgcgcgtctcgctcgccgggcagcccgtcagcgtcagcgtgtcctcgtcgtcgcggggccggcggacctgcatgtgctcgccgaccaaccacccgggctcgttccgctgcagcctgcacaaggagcgcgtcaagccggctgccgggccccacggccacgggcacgggcacgggcacggcaagccgagctcgccggcgtcggccgtcagcccgctgtgcg

SEQ ID NO: 51756 - DNA, 404 bp, Zea mays
  Clone ID: LIB3067-009-Q1-K1-A5
cggacgcgtgggtccggacgcgtgggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgctctgtacggtctcattgttggaattatcctttcatcccgtgctggtcaatcccgggcagattaagtgcactaccattctgcaattaccgtactgtttattatgctattctaagagaattgaaaccctatgcccttgtctagtttattcttgttaccatgtattaatgaaacaatttgtagctgaaggaaggtgacacttccaaccatgttggttttggc

SEQ ID NO: 51757 - DNA, 410 bp, Zea mays
  Clone ID: LIB3067-009-Q1-K1-A7
cggacgcgtgggcaaccggcggtccatcttgagaggaccaagaaacagagagagcggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcatggcttgaagaaagagtacagctacaacaagatcctcaaggatctcaaaaaagagttctgctgcaatg

SEQ ID NO: 51758 - DNA, 411 bp, Zea mays
  Clone ID: LIB3067-009-Q1-K1-B1
cgctcgcgatctagaactagtctgtctaacaaccaagtcatcgaggagggcttgggcaagcacaacatcatttgcattgaggatcttgttcatgagatcatgactgtcggcccacacttcaaggaggcgaacaacttcctttggccatttaagctgaaggcaccgctgggaggtctgaagaagaagaggaaccactatgtggagggtggtgatgccggtaaccgtgagaattacatcaacgagctcatcaaaaggatgaattaggttcacgatcaagctctattgtgttctaagaaactttctgtgctctcccaattttacattattaggaagcggatgaatatgcatgcagttttgttgtttggaactagatgtgtatggaagaaacatgatcttttttctcggaagttt

SEQ ID NO: 51759 - DNA, 313 bp, Zea mays
  Clone ID: LIB3067-008-Q1-K1-F4
aacttggaaaactttgttgatgtaaagaacattctcgttgaaatgggaacatactttcaagtgcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaattacggaaagtctgatccagcgtgtgttgcaaaggtgaaggacttgtacaaagagcttaaactggatgaggttttccatgagtacgagagggagagttacaacaagc

SEQ ID NO: 51760 - DNA, 333 bp, Zea mays
  Clone ID: LIB3067-008-Q1-K1-F5
cggacgcgtgggcggacgcgtgggcggacgcgtgggcggacgcgtgggcggacgcgtggggggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcattcgtaggatttcatcactaactgtggtatgatcaggttctaactgc

SEQ ID NO: 51761 - DNA, 234 bp, Zea mays
  Clone ID: LIB3067-008-Q1-K1-F6
aacgtgttgattgaggagctgcctgccaacgttgctgaccttctgtgatcattgtgaagaaagacagaactaaaagaaaggtggtgggggtgatctggtaaggcttggttctgccgaaatattgtgggggaggagtgattatgtcggttttgttttcatgtttatatgttttttatttatcttgttatttttttttgatattttcttcttgttgtttattatattttttatttt

SEQ ID NO: 51762 - DNA, 366 bp, Zea mays
  Clone ID: LIB3067-008-Q1-K1-F7
cccacgcgtccgcccacgcgtccgcgaggacccatccaagccgtccgaagaagctactactgaaggtggtgagcctgcacccgaggaagcacaataggattctttgttcacacaagctaggcacatagccgtacgtaccattccgtatgcttagttgccgtattgttgggaactgtttgtgcgtgtatttctgttagacgttccccgctggtttaggctgtgttttatattgctgttttgtctttttgaatgttgagaccatacaactgtcgatcattatctcataattgttgtaaaaatactataattgataatataattttattttcttggtttttttttattttttacttgttttttattttt

SEQ ID NO: 51763 - DNA, 398 bp, Zea mays
  Clone ID: LIB3067-008-Q1-K1-F8
ggtcaattgggatatttgcttcttgtatgttagcatgtttgaaccatagcaattggtggacgtgtgtagagaagattgcaaaactgcagtatgatggattccactattcatcaaccgagatcatggcgcgcttcaatcgtggctactctgatggggaattgatccgttatggctcgtggctgtggagatgtggaactcattggttatagtgtgcttcaatcatgggtcatggcgatgctgatggaactgatttgttaccaaggtttaagttttcgctaccgttggacggcctgactggtactttgccctgttgactgtttgagaacgtactgcctaggtttacttaatacttgctgctttttgacggttctgtacatattgtttgatattttatttct

SEQ ID NO: 51764 - DNA, 338 bp, Zea mays
  Clone ID: LIB3067-008-Q1-K1-F9
acctgcttgagctgctgcttgctgagcacgatcttgacgcgcatcgcgccctcggcggcgacgctctcccccgtggaacgctcgatggccgtggccgtctcggtgtccagctgcagccgcgggcacctgaccagccttcgcccgtccctcctgcacgtagccggcgcggcagcagcctgcagctccatggatcgcccgtctatccttcgatctggtaacgccagtaggcagtagtagctagagaacaacggaggaatattatgtaacatcactgtcacttgtgcgtgtccaagctagggtttttatgtagagagaagcggagcttacgagcgagacag

SEQ ID NO: 51765 - DNA, 154 bp, Zea mays
  Clone ID: LIB3067-008-Q1-K1-G1
cggacgcgtgggcagaagccaagtgttctgatgatatgttttttcaattgtgttttttgtaattggttcagcgagcacatacatgatttatgacattgcatgtgctatctatgataaaaaaaatcggatgatcatgtcgaatttgaatgagtat

SEQ ID NO: 51766 - DNA, 381 bp, Zea mays
  Clone ID: LIB3067-008-Q1-K1-G10
cccacgcgtccggttcttttggacatgcatgtggcgaaagcagttctttttgttcattttgaagctgggtggccttggtttatagtctgaagggattctacttcggggatcttgcagaggtttaccttttctcatgctcccgtgcttagggttttgaattgggcatcgaggccatcttcatactggtgacagaagaaatgttttgtgtatatttctgtccaaactcggctgtagctttcagagtttgtgaatagttgacatgtttatatggtctgtgaagttttgaaatgtttaatgggccttacaggtgtgtaccttttctcatgtactccgcgcaaaattgtacaacaatgtttaatgggccttatacgtggacccttc

SEQ ID NO: 51767 - DNA, 280 bp, Zea mays
  Clone ID: LIB3067-008-Q1-K1-G11
cccacgcgtccggtgactcggggcatgcatgttacgaacgcagactagattagtggattatgaagctgggtggcctaggtttatagtctgagaaggattctacttcggtgatcgttgcataggtgcaccttagatcatgactaccgtgcttacggttttgaatagggcatcgagagtctcttcatactggtgacctatgaaaagttatgtgtatataactgtccaaactgggctgttgctttcatagttggttaatctttgacatgtttatatggtctgt

SEQ ID NO: 51768 - DNA, 415 bp, Zea mays
  Clone ID: LIB3067-008-Q1-K1-G12
gcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaag

SEQ ID NO: 51769 - DNA, 196 bp, Zea mays
  Clone ID: LIB3067-008-Q1-K1-G2
gacacgcattcgcaataccgaagctgtactttttgtcgtcgctgccgacaatagcagaccagggctaaaggagagcaagatgaagcttatctacagtgacctacaggatcaggatgtggcatctcggaagaacatgacgcatttgaatgagtatgcgttcggggtgatgcaattataatcccattatcttatgcca

SEQ ID NO: 51770 - DNA, 295 bp, Zea mays
  Clone ID: LIB3067-008-Q1-K1-G3
ggcgaaaggtactataaccctagtggccgtggccgtggtaggggccgtggggggttccgtggtggttacaacggcggttatcggggaccagctgctgctccagcgatcgaagaccaggctcagttccctgccctggcctaagcacagctcgtgttctcgctcaagattgtgtcacttttgcggagtgcgtcagtcagtcctagtgttgttgctcccaagcttgctttccggattatgtgtatccaactatttctgatattatgtactggtgtgctcgtgattgcaatggtttgct

SEQ ID NO: 51771 - DNA, 312 bp, Zea mays
  Clone ID: LIB3067-008-Q1-K1-G4
cccacgcgtccgcagcaccgcagagcaagagcgcaccagcacgacacagccaagctccactgcaccgacacgctgcgctcgagcccgcccgagccgcccgctagatccatggcgcggctgctaccgacggccgcggcagcggccatcgtggccgccgtcctggtggcgggcctgccgggcgcccgggcggcgtctgcctcgccggcggcggacgacgcgccgtcgtacaggaaccacaccgctggcggctgcgatgggtggttcttcgacgccaacaccaacgccttgtccgggaactactccgactgggcc

SEQ ID NO: 51772 - DNA, 345 bp, Zea mays
  Clone ID: LIB3067-008-Q1-K1-G6
gggccaccgctgcggcgccgcccctcgaccctccgctgctccgcctgcgctggagaccatccatctggaagagatctctgatttacgggatggacggagccaagccagtggcggccgggaagcaggacctggaagaggcgctgctccgtatcgtgcagcagcaccaccaccagtccctctgccaacgacaacaaaccgagcgtgcaaagaaggacgccttgaagagcgcggtgcgggtcggcgatctcctcgtggacacggtcgacggcggggtgcgggagctcttcgtcaacgagaagcgcattgagcttgagggccgcgcgctgctcggtacgatcgcgcggt

SEQ ID NO: 51773 - DNA, 205 bp, Zea mays
  Clone ID: LIB3067-008-Q1-K1-G7
cggacgcgtgggctgcgctcgcggtcgcgggcggctcgagtcgcacgccagatcggaatgcgcgccgccgcgcctctctaggccgcggaacggaagctaggtgcgtcacacgccgtggccggtcgcggtcaccggaccggacgcacaggggcgccgtacgtgcagtcatcggccatgatggtcctcgtcctcgatgtgctggcgc

SEQ ID NO: 51774 - DNA, 333 bp, Zea mays
  Clone ID: LIB3067-008-Q1-K1-G8
agcgactagtcgaaggcggcggcggcggcgatggggagcgacctggagacggagaagaagaagaccccggtggcgctgatgcccatcgcgaagcctctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgacc

SEQ ID NO: 51775 - DNA, 315 bp, Zea mays
  Clone ID: LIB3067-008-Q1-K1-F3
cggacgcgtccgcccacgcgtccggtttctagagccctctctgccactcgtgatcccactagggacaatgcctgccctcgccaagcccgcctcccgcaccgccaagcccgccgcggctccgaagccgaagcctgccgccgccaagccgaaggcggccaccgctggtgccttccacccgccttacttcgagatgatcaaggaggctatcacggcgctcaaggagaggaccggctccagctcgcaagcgatcgccaagtatgtgggggacaagcacggcgcgtctctgccggcccatttcatgaagatgctttccat

SEQ ID NO: 51776 - DNA, 440 bp, Zea mays
  Clone ID: LIB3067-008-Q1-K1-G9
cgtaataaaaccacttgaccgtcacaatcttctacgcccagagactgtggaatcactatttgttttgtatagaatcacagaggattccaagtatagggagtggggttggcagatctttcaggcttttgagaagtacacaaaagttgattctggtggttacacatcattggatgatgtcacaagcctacctccttccacgagagataaaatggaaactttctttcttggagaaacattgaagtatttgtatttactgtttgatgaaaacaatacccttcccctagataagtatgtgttcaatacagaggcccatcctcttccagttatgcggtctgcagaacaggcttcacattctgtgtagtttcccaagtttatagctgttgtaccatggtgagaagtacagatctgtgacaaatatacttgacaacatagttggagga

SEQ ID NO: 51777 - DNA, 245 bp, Zea mays
  Clone ID: LIB3067-008-Q1-K1-H1
cccacgcgtgcgcgcacgcgtccgtgtacgcattcgtggcgtgatctcgtacatgctacggtgggaccagtacgggcacctcctgtgctacatcacgtacggcgtttacaaggacagggccatgtaccatcgcgccttctgcgactgctactgtctggctcgcttgctacaaacacgcgtttagttaattgtacatgtcctgcgctcgcttacgttcatgctctgtggtatgtactccatgatac

SEQ ID NO: 51778 - DNA, 401 bp, Zea mays
  unsure at all n locations
  Clone ID: LIB3067-008-Q1-K1-H10
cggacgcgtgggtctgacgtcgtgtgtcatgacagctgttgggtcatcggcagtgccttaagtgaggaagaagagtcaactattcgcatccacgatacacctcatctagcaggtgtacttcatatatgactcatagtgcattaatatgacctctaattggataaatggctggcatctctctcttcttgatgacttcaaatggagttaacatcatactgatntgagatccttcatccaatgtgcatcggatgacgctcggacttacttgaatactatgtaacagctcacaataaattgcggtcttatatatcatattgtaatcgaacttctgatgatggattctgttgagatgattgccatggatttttataaaccattttgaatgtgtgacaagaataaca

SEQ ID NO: 51779 - DNA, 268 bp, Zea mays
  Clone ID: LIB3067-008-Q1-K1-D4
cccacgcgtccgcccacgcgtccgcaaattttcaggccgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggt

SEQ ID NO: 51780 - DNA, 278 bp, Zea mays
  Clone ID: LIB3067-008-Q1-K1-D5
caaggatctgctgcaggtgcaccccaactcttacgccctggtgatcagcatggagaacatcacactgaactggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgctttggctgcgtgacacatgaggaagatgagtttggcaagattggcgtgt

SEQ ID NO: 51781 - DNA, 303 bp, Zea mays
  Clone ID: LIB3067-008-Q1-K1-D7
cccacgcgtccgcccacgcgtccgctcgcccggaccccttccgccagttgggagtcgtatacgaacctacctacttccaaggaagcaccagtcatccatcaccttgtacatgtttttatgttgcagcactagtggtgtttaattgtcagctgcgatcatgtgagaacctgacctggtacattatgtatataagaagaataagaacctgttaacttatatggtatagtatgtaagttcatggcagaatgttcttgatggttggattcgtgcgcagttgaacagttgctggtgttgtaatgtgat

SEQ ID NO: 51782 - DNA, 410 bp, Zea mays
  Clone ID: LIB3067-008-Q1-K1-D8
cccacgcgtccgcatggaatcaaagagcattttcttgtcaccactgaactgaagttcaattgctttctcctcatgccgattgttgacaaactaccagcacttctaagacaagaccttgagtcagctttcgaagaggaacttgatagcatctttgatgtcactcagctgcgccagtcacttgggcagaagaagcgcttgttttgatctaattttttattttgttttttttttattttttaatattttattttttttgttttttatatttatttttttttatattttttttattttttattttatattttttttatgttttatttattttttttattattttttttattttttatatatttttatttttttgattttttttttttatatatttttttttttttttttatttt

SEQ ID NO: 51783 - DNA, 185 bp, Zea mays
  Clone ID: LIB3067-008-Q1-K1-D9
agggtcttgactggcagggtgcagtcaaggatatccaggcttcagttaaatggctgaagtcaaatggatcacccaaggttggtgttactggctattgcatgggaggtgctttatcaattgcaagtggagtattagtcccagaggttgatgctgttgtagctatctatgggtcacctttttttgag

SEQ ID NO: 51784 - DNA, 350 bp, Zea mays
  Clone ID: LIB3067-008-Q1-K1-E1
cccacgcgtccggtttgctgagattgctctacagctggagattcccagtaccaagactctctgtttagatgttacaacccagtggaacacaacttatttgatgctgttggctgccttggactataagcaggcgttttctacactggagacatgtgatgataattacaatgaatctccttcagcagaggactggaagaaagttgaggctacctgtaattacctgaaactgctatatgactctgcacatagtgtcatggcttcatcaaatcctactgcaaacatctgtttccatgaagcttggaaaattcagcttgagctagccaatggcacagaacatgaaaattccatct

SEQ ID NO: 51785 - DNA, 423 bp, Zea mays
  Clone ID: LIB3067-008-Q1-K1-E12
gtaaaaaaacaacagttagaagggaacttcaagaattccattcagcattggaggaggcaaaagctgatatagttggtctctgggcactgaatttccttattaagaagggattgcttcctaagagcctgtcacaatctatgtatgtctctttcctggctggctgcttccggtcaatccgctttggactggaagaagctcacggaaaaggacaagctctgcagtttaactggttgtatgagaaaggggcttttgtgttgcactctgacggaaaattctcagttgattttacaatggttgaggatgctgtagaaagcctgagcagggagatactgacaatacaagcaaagggcgataagccttctgcccaatctcttctccagtcccgtgcaacattgacacatccattaagaatggcattgtaga

SEQ ID NO: 51786 - DNA, 233 bp, Zea mays
  Clone ID: LIB3067-008-Q1-K1-E2
cccacgcgtccgcccacgcgtccgcccacgcgtgcgagggcttcggatcccacacccaggaaaggagaagagagggtcggaataatggcggccgaggagggtgccgtgatcgcgtgccacaccaaggacgagttcgacgcccgcatggcctatgccaaggagcagggcaagctggtggtcatcgacttcatggccccctggtgcagtgggtgccagatgatggcccccgtgta

SEQ ID NO: 51787 - DNA, 344 bp, Zea mays
  Clone ID: LIB3067-008-Q1-K1-E3
cccagaggtacgcggcgcccacgccacgtccttggaattattcacgcccgcgacagacgtgtacagcttcggggtgctcctgctggagctcctgacgggccggacaccgttccaggacctcatggagctgcatggcgacgacatccccagctgggttcgcgcggtgcgtgaggaggagagggagacggagtctgtgtccgccggtggaggtggagccgaggagaagctcacggcgctgatcaacatcgccgcgacgtgcgtggctgcggacccggccaggcgccctaccacggcggagctgcttccgatggtgagggaggccagggcctaggccatgtcatcgt

SEQ ID NO: 51788 - DNA, 108 bp, Zea mays
  Clone ID: LIB3067-008-Q1-K1-E4
cggacgcgtgcgcggacgcgtggggctgaattgtcgatatgcaagactttgtgctaacttaggtatatgatggtaatttgatggttaatagatgaggtcgtacatgtt

SEQ ID NO: 51789 - DNA, 370 bp, Zea mays
  Clone ID: LIB3067-008-Q1-K1-E6
cggacgcgtggggttaaatcaactagttgcacaggggcggcatcttggtgagtcgagtaacatttccttggataaagtgacgttgctgcagccttccgcaacatctgatctctatttcaagaaaaggaaaaatcagattattttgggtccctctacttctgatgccccgagttcaaaagatacatttcaggctgaaaatataaagtcaggtgagagtaaagttctaatgtcttcatcttccaacaacattatcactgtggcaaatgacaggctgcactaagctcttcagacaacaaatactgtcagaagtttctcttatgtatggacacttaatggacaaaattcctgttagtaaatttatgttggagct

SEQ ID NO: 51790 - DNA, 237 bp, Zea mays
  Clone ID: LIB3067-008-Q1-K1-E7
cccacgcgtccgcggacgcgtgggtgcgcgtgctcgtcactggcgccgcaggacaaattggatatgccctggttcccatgattgctaggggtgttatgcttggtgcagaccagcctgatattctgcacatgcttgacattccgccagcagctgaagcccttaatggtgttaagatggagttggttgatgctggcgtttcttttctgaagggatgttgtgctaccactgattgttgtt

SEQ ID NO: 51791 - DNA, 435 bp, Zea mays
  unsure at all n locations
  Clone ID: LIB3067-008-Q1-K1-E9
cccacgcgtccgctagaacctgtcatggtggtcgtgacagagctactagtggggggttcgttgcgcaagtatttggtcagtctccgacctaggagccttgagcctcgtgtagcagtggggtttgcattggacattgcccgagctatggaatgcttacatgcacatgggatcattcatcgtgatcttaagcctgagaatctgttgctgactgcagaccagagaacagtaaaacttgttgatcttggtttggctagggaagagacactaacggagatgatgactgctgagacaggaacataccgttggatggctccagagttgtacagcacagtaacactgaggcatggagaaaagaagcattacaaccacaaagtagatgtctacagctttgcaattgtgttgtgggaactcctncacaataaactgcccttcgag

SEQ ID NO: 51792 - DNA, 218 bp, Zea mays
  Clone ID: LIB3067-008-Q1-K1-F1
catatcataattatatatatatgcatgctatctactatgatcgatcgctactagaccttcttgcatctatctgcatgcatattataaaataatgtcatattgatgcaacgctccatgcaagtctttccaaggcgtacgtactatatcaaatcattgtaatttccttacatgtatatgtatgtgcttgtgaaagatacgtacctatatatatatgtgct

SEQ ID NO: 51793 - DNA, 437 bp, Zea mays
  Clone ID: LIB3067-008-Q1-K1-F10
ctcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaatttcccctactaccaggattgataacaccatcgattttcgctacagtacctggagcttcttatatgaaag

SEQ ID NO: 51794 - DNA, 394 bp, Zea mays
  Clone ID: LIB3067-008-Q1-K1-F11
ctcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaataccttttctttaggaggaagatggccatattgatgtgtgcaaaagaactgtgggagtatgggactatttttatactactcggcattaagtgcattcttttgggaagtttctgagatatttcccctactactaggattgataac

SEQ ID NO: 51795 - DNA, 346 bp, Zea mays
  Clone ID: LIB3067-008-Q1-K1-D3
cccacgcgtccgcccacgcgttcgcacaaaggcagccaatgtacagcaaccagtcagggattggggtggcgccaacacagatgcaggcaggcttggggaaccagcagttgggttcgacatccatgatgggcatgcctccacagatgtatggcggcggatcgcaggcagccatgatgtacccgcaacaaatgccagtggcggcgcagcagccgatgtatggtggtggtggtcgtctggcagggtacatgcagcatcctgctgtggccgctgcacactactacagcaacctgtggactgctggaatgtatgggtaccccggcgcgaacggggctgtccagaacatgta

SEQ ID NO: 51796 - DNA, 434 bp, Zea mays
  Clone ID: LIB3067-008-Q1-K1-F12
cgttcccgcgcctcgccgagagatctgcgccgtcgtcggcaccaatccgtacacccgtcagtccgtccgtcgtcggcgccggcgaacgagtagagatggaggagacggcggcagcggcaccggctgagaaggcgtcgtcgtacaggtactgggtgcgggaagccaccggcgacgccgcgccgctccccgtcccgcgcaagctcgaccccgccgccaatgggaacgggaacccgccgcccctcgggtccgtctggaatcaggctggaacttgggaggaaaagaacctcaactcatgggctaatagtaggataaaggatttgctgggctctctaggttcattgaagttccctacagggaatgcatccgttgatgaagtgtccaagtgctcatgcgatgcctttcaggtcactgtccgcaacatgaagagagtagga

SEQ ID NO: 51797 - DNA, 180 bp, Zea mays
  Clone ID: LIB3067-008-Q1-K1-F2
agaccatatcctgcatctctatgattactaactactgtgctccatcgacactcatggctgtggcgttcgagcgcatgaatgagatcagctacgttatgctgatgccagtcgccttgctattcctcaaaaggcgtacgggctatcatgactgactggcacttacttacgtctatgtgtatg

SEQ ID NO: 51798 - DNA, 439 bp, Zea mays
  Clone ID: LIB3067-030-Q1-K1-B2
cccacgcgtccgcccactcgtccgcccacgcgtccggaaaattcgaagacgaggagcagctacactgcggacggacttcgggcatggagggccagttccaggttggcaaggaggaggtcatccaagcatggtacatggacgacagtgaagaggaccagaggcttcctcatcatcgcgagcccaaagaattcatccctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgccttgagggtagcggctactttgatgtgag

SEQ ID NO: 51799 - DNA, 442 bp, Zea mays
  Clone ID: LIB3067-030-Q1-K1-B3
cttgctcctctgtccacgccgcaccatcgctcctcgtctcggcgccgcctagtaggcggcgcacaggtacggccgtatgtcttcagggtgttcgccgcggcagggtcgcgtcctgccgcgtgcggtgtagcgccggggccgggcagggcggggtcaaggtccctgcgaagctggcggagctgtggtcggcggcgaagagcgcgccttccctggccgtgctcgcgggtgtggcggcggcggtggcgatatacaaggtcgggtccagtctccttgcgccgcgccatcccccgccccgtcggctggaggcccagacggtcccgtcgtctccagtcccggagccggtgcaggtgggcgagataacggaggaggaactacggcagtacgacgggtccgaccccgagaaaccgctgctgatggccatcaaggggcagatctatgacgt

SEQ ID NO: 51800 - DNA, 433 bp, Zea mays
  Clone ID: LIB3067-030-Q1-K1-B4
cccacgcgtccgcccacgcgtccgggtttctggaaacagtaaaaacatgtgctagtgggtcgaaagcaaaaggaacttgcatcgacaaattgtgcatataagtgaaaaagttaactgtatactgtatatattgctagatagggaatgtatctgagcttttgagtaacttagctattagagcattctgacttattatatgaaagttgacatcactaacaactgcctaactagtaggctaataacatcataattgcttgtaatttgcaggaatataaaatttcttggaattaccatttgaagtataatatggaaactgcttgtttaatttgtttgtatttatgaagaccttttgtacatagttaaatttgatggagaaatgatgcactacagcactagtgtaatagactaatagtagcttactgccaaagcacca

SEQ ID NO: 51801 - DNA, 310 bp, Zea mays
  Clone ID: LIB3067-030-Q1-K1-B5
cccacgcgtccgcccacgcgtccgcgggtcgccgcccacggcgtcgtgctgctcgaacctgcgcgcgcaggagccgtgcttctgccagtacgcgcgcaacccggcgtacagcagctacatcaacagccccaacgcccgccgcacgctcacctcctgcggcatcgccgtcccgagctgctagggcgctagctcgtgcctcgtggtgtgggtgaataaaaagatgcatgtcgatctctgcttactgttatcgtatctgtagtacctcgtgtgatatgaacaatatgtattatttaccaagagcggttgtgtc

SEQ ID NO: 51802 - DNA, 385 bp, Zea mays
  Clone ID: LIB3067-030-Q1-K1-B6
cccacgcgtccgagaaaactgctgcagtggtgagatgtatagcatctgacctggacaggagaagaatatgtagtggtggtcgcaacggactcctgcggctttgggatgcaactacaagcatctaggactgatagatgttcatgtgaaaaggcaattgaccatgatgttgcatgccattttccttttagctaggaatttatgtgctatttagaggatgcgaaaggagccggactttgttctactgtttctttctcatctaaaaaaccctgcccagttgagtatatgtttgacgtcgtgtaaaattttgtttatattttcgggttcagatagccttacgtggctacgattttgtgagaactatgagaaacttgggaagttctgtact

SEQ ID NO: 51803 - DNA, 438 bp, Zea mays
  Clone ID: LIB3067-030-Q1-K1-B7
tcagctcccattctccgcctaataaacccccgaaaagcaggagaggcgagacccggaagtggaaggctagggttagggtcccagctccccgttgcctgggcgagcctagtgatggccgcccctgccccctccggctcatctagtgccgacgcctcaccgtacccgctgatgcagctgccgtcgccgttcgcggagctcgtcaagggcccctacggcctcgagaaggtcgtgcttctcggctctcgcaactgctgagccgagatttatctgtatggaggtcaagtaacatcatggaagaatgacaatggggaagacttgcttttcctcatcagcaaggctattttcaaacctgcaaaagctattcgtggcggtataccaatctgctttccccaatttggatcacatggaaatcttgaacaacatggattcgctaggaac

SEQ ID NO: 51804 - DNA, 437 bp, Zea mays
  unsure at all n locations
  Clone ID: LIB3067-030-Q1-K1-B8
cccacgcgtccgcccacgcgtccgcccacgcgtccgcagtcatccacactaacgaacgaggtcttgctccgatcacgagctagctgaggtcgacgatggcggctgtgctgaacagcaggaagacgccgcaggtggtggccgtgctggtggtggtggcgctgctggcttcgtccgcgtcggcggcgatcacctgcgggcaggtggggtcgtcgctggcgccgtgcatcccttacgcgacggggagggccagcgcgctcccctcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctncgtcggattccccatcagcatg

SEQ ID NO: 51805 - DNA, 379 bp, Zea mays
  Clone ID: LIB3067-030-Q1-K1-B9
cccacgcgtccgattctcatactataaacaattttctgtcgtaagaataatatcttgagggttaggtatcctttaaggtatgttgtaattcctctatgaagaatagactttagaacgtttgattctatttatattgaaccaactatagcttccttctagatttcaggaaaccattatcttgtgccaaacaatacttgactttatataggatagaattgttgtttatgatgatacttaggtaactgctgtacttggtattcagtgtgtaatatttttgttgtgtggattaatgttttaagtgctttatgtctcattagtgttaagcttagctcatcctgcttcgtcgtagtagttatttaacaataaggatctctttaaa

SEQ ID NO: 51806 - DNA, 426 bp, Zea mays
  Clone ID: LIB3067-030-Q1-K1-C1
caggaagctgtccctgactagggccctcttctacattatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcggccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgc

SEQ ID NO: 51807 - DNA, 258 bp, Zea mays
  Clone ID: LIB3067-030-Q1-K1-C10
cccacgcgtccgcccacgcgtccgcccacgcgtccgcccacgcgtccgaaaaaaaaaaagaaaaagtaaaaaaaaaaaaaaaaaaaaaaaaaaaaaaaaaaaaaaaaaaaaaaaaaataaaaaaaaaaaaaaaaaaaaacaaataaaaaaaaaaaaaagaattaaaaaataataaaaaaaaaataataaataataaaaatatatcacactaaattaatttcattaaccttcgtattacaatttaacatattggaaaaa

SEQ ID NO: 51808 - DNA, 388 bp, Zea mays
  Clone ID: LIB3067-030-Q1-K1-C11
cccacgcgtccgcaagcttccaggatgacttggtagccagcacttcgtcttcgactggtaccgggtccaagtatatcaacgtaacaaggtggtttaatcacattgatgcgctcgtgaggctgaacggaattactgcagagggccaaggtgttaatgttgaatcgtcagcagttgcttcagccccaactccagatgagactgaagcacaggccccagttgctgaggaggacgacgacgatgatgttgacctttttggtgaggagaccgaatatgagaagaacgctgctgaagagcgtgctgcaactgccaaagcttttggcatgaagatagaatcttggaagtcatcagttttacttgatgtgaagccatgggacgatgagactgacat

SEQ ID NO: 51809 - DNA, 439 bp, Zea mays
  Clone ID: LIB3067-030-Q1-K1-C3
cagaaacaatgggctggaaatatcctggtattggtgagtttcagtgttatgacaggtacatgcagaagaatctacggcaatcagcattgtcccggggtcatttgttttgggcacgtggacctgataacgctggctattataattcaagaccacatgaaactggctttttttgtgatggaggcgactatgacagctactatggacgttttttccttaactggtactctggagtcctcatggatcatgtggatcaggtgctgtcgcttgctactcttgcatttgacggagcagaaatagttgtgaaggttccatctatctactggtggtacaggactgcgagccacgccgcagagctcacagcggggttctacaacactacgaacagagacggatactctccagttttcagaatgctcaagaagcactctgtgatccttaa

SEQ ID NO: 51810 - DNA, 418 bp, Zea mays
  Clone ID: LIB3067-030-Q1-K1-C4
cccactcgttcgcttcaaatagtaaagccgtgaacaatgcagtggatttgttcaagtattttgggagcatagggagcgtcatccggaaaaggaaggaatggtacctgtatgagcctgttgttgatgtggtagctaatgacgaagacgggaaagaggaggctaataattctagcaggccgaagaaaagagccgacgaagagaaagctgcaagccttcagtccctttgaacacaagctgctgatagttctaaccaaggagggtttctcttgccaatcccagcagatgcctgcctttgacattcgtcgtaggatggcttcatcatagctacatatttgtatgtaagcggtgtgagagcgtgttattcctgatgaaggtcggtgctgccctgtcacctagtctgacgacacccgtccagtac

SEQ ID NO: 51811 - DNA, 364 bp, Zea mays
  unsure at all n locations
  Clone ID: LIB3067-030-Q1-K1-B11
gtcaccgcgatcccgtgcttacttctagcacctgcggatctactctccgaacctgcgggggtaccgcccggtgaaacaagcgctccgacgcctcaaggaatgcggagcgatgaggcggctctcaggcactgacgtcgccggtcagcgcgagctgcgcggagaccgaacctggcatcgcaagcacgtcgaggaccggtcgactcgtgcatccttgcttcctcttgctagtggtcgtacggtagtttgcactttgcagatagctagctagctagtagctaggggatcaggcatgggtgagggcgaggcggtggttaagggcggtgtgctgtanggccgctacaagctcagtcgcgtgctgggtcac

SEQ ID NO: 51812 - DNA, 447 bp, Zea mays
  Clone ID: LIB3067-029-Q1-K1-H6
agagggcgcccccgctccccgctggcgcctcgtcctcctccttcgccaggcccctgcgccgcggcgcggcgcaccacccgcgcctgcgcaccgcgctcgccgtctcctccgacctgctcgctgggaacaaggccgcgcaggccgccgccgcgcatccggcggttacccgggaagaggcactggagctgtatgaggacatggttcttggccgtgtattcgaggacatgtgtgcacaaatgtactaccgtggcaagatgtttggtttcgtccacctttacaatggccaggaggctgtctccactggcttcatcaaacttctgaaccaggctgactgtgttgttagcacataccgtgatcatgtccatgcgctgtccaagggcgtcccggcacgttctgtcatggctgagctctttggcaaggccacaggctgctgccgtggacagggtg

SEQ ID NO: 51813 - DNA, 443 bp, Zea mays
  Clone ID: LIB3067-029-Q1-K1-H7
cccacgcgtccggtccctcttcatcgacccaaacaggcccttacgctaatcaaatggttcgtgactgggagcccaatgcctgtgcaatccagcacacacagcaacatgtaatccgtgttgttgcaactgattcacgagatgaatgaacatcccgaagcacccaagtcagccagttgtccaacccggcttgttctgcaacttgctgtagttgtttatgtatcagagctaccggtgccggttaccgcagcagccgtgcttttgtcggccctgatggtgcttgttgcagtaccagttatcccctaaggcaggtgacagaaactgcggaatagttcttgtttgcattgacgtgacagcactgtaatcttaaacatcgtaccatagtcctttctatgacaaaggtgtggtttctgatgtctgcagtaaatgatctggacttggggcgt

SEQ ID NO: 51814 - DNA, 421 bp, Zea mays
  Clone ID: LIB3067-029-Q1-K1-H8
cccacgcgtccggacaataagcctgtcacaaatagcagggacacccaggaggtgaagctggaacagggcctccagatgctaacaatcttcaagagccatgaggctgagacaacaattgtggaagatttcgacttctatgagcagcgggagaaagccttgcaggagaacagacgtcaacagcatgctgtcagcaccgatactcagaaactggtggataccaaggctcaagatcctgtggccgacatatcagatgcatttgccaaggccgtccagttgaagaatactgagaacagtgggacaacccccaaaactgagggtgcttcagctgaaaagggatccgctgccaccgccaaagttgaaagaagtgcaaacctgaacacaagccctgtggaggaaagcaggtgattcgttttccttctat

SEQ ID NO: 51815 - DNA, 425 bp, Zea mays
  Clone ID: LIB3067-030-Q1-K1-A1
agaggatagaaaaattatgatttcgaggcataaccttgttaaattgcacaaggtgcttgaggagcatgatctttcttgtgtggagcttttggatgtgaagttggatggtattgttttaacaaaacaaaaagcggagaaggccgttggttgggctagaaaccactatctgtcatcaacaactcttccttctatcaaaggtgacaggttaatcattccccgtgagagtctggatatatcaatcgagaggctgaaggaacagggtataacagctaagaaatcctctcaaaatctgaaggttttggctaaagatgagtatgagcgcaatttcatttctgctgttgtgcctccgaatgaaattggagtgaaatttgacgacatcggtgcacttgaagacgtgaagagaacattggatgagcttgttacac

SEQ ID NO: 51816 - DNA, 86 bp, Zea mays
  Clone ID: LIB3067-030-Q1-K1-A10
cccacgcgtacgaaaaaaaaaaaaccatataaaagaaaaaagaaaacaaaaaagaaaaaggggaaaagaaaaaaaaaaggtagcat

SEQ ID NO: 51817 - DNA, 392 bp, Zea mays
  Clone ID: LIB3067-030-Q1-K1-A11
ctcgcggtgaatcctcccgagtcgccttcccctcaagttccacaaacgcaagccccaagctcgccgtcaccacccgcaatccagcaaacgcaaaccccatctcgccgccgccgccgccgccgccgcgatgtctcgccgctatgacagccgcactacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctccttcagacctcgcgctccgtcgagaagatgtacaagatcgactcccacctggcgtgcgccgtggccgggatcatgttcgacgcaacattctgataacaac

SEQ ID NO: 51818 - DNA, 394 bp, Zea mays
  Clone ID: LIB3067-030-Q1-K1-A12
agggagtgcaaagaggcacagttgcttttattagaagtgttagcattgaagcagtaggggttggagtccatttggctgcaggagctcatgatatacttatgaagacagaacatgctcttacaactgttccaccacctttagcctcatgtgaagcgaaacgaacaaaacacaacattagagctaaccaacctgaaagtgcacaacaaggaatgaaacaggcatatgaaagtttgactgttggttttggaaggacagcctctgctctcattggcaaccctattaaagtttataaccgaggggcgggtgttggatcagttctagctactgcaatctgtggagcaccagctgctgcagtagctccagtctcggcatctgctcgcgctttacattatgc

SEQ ID NO: 51819 - DNA, 443 bp, Zea mays
  unsure at all n locations
  Clone ID: LIB3067-030-Q1-K1-A2
cggacgcgtgggcggacgcgtgggcggacgcgtgggtcctgcagtgacattggacagtcaggtattttacgtaattgaattgaacacttgatctctgattagcacatggatggaaacacatgtctctgctctacgtcagatgatctccggtgccaagaagaaggaactcttctttgggatgccttaccgccagggcgaccagccagatccgggcgcgggcaccgtcgagagcatcccgcacaacccagtacacttctggagcggcgacccgaggcagccgaacggcgaggacatgggcaacttctactccgccgcgcgcgacccgctcttcttcgcgcaccacggcaacatcgaccgcttgtggtcggtctggaacggccttcgtcccggcgtcagcgacttcaccgaccccagctggctggacgccagcttnctcttctacg

SEQ ID NO: 51820 - DNA, 426 bp, Zea mays
  Clone ID: LIB3067-030-Q1-K1-A3
tcgcacaggcctgccgccacagcaccgcggatagcagagcagagcggcagccaggtcggtcggcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaagtgacgctggccgaccgcaaccccaacgaccgcgtgggcatcttctacaagcgcctggacgtgttcgtcacctaccgcgacgaggccgtgacggtgcccgtgtctctgccgccgcagtaccagggccacc

SEQ ID NO: 51821 - DNA, 386 bp, Zea mays
  Clone ID: LIB3067-030-Q1-K1-A6
cccacgcgtccgggagagcaccctccacttggtgctgcgcctcaggggaggcatgcagaggttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggaaggca

SEQ ID NO: 51822 - DNA, 441 bp, Zea mays
  Clone ID: LIB3067-030-Q1-K1-A7
accgcccacgcgtccggcagagcacccttcactttttgctgcgcctcaggggaggcatggagatgttcgttaagaccctgggcggccagactatcaccctccaagcgcaatcttcagacaccatcgacaacctcaaggccaagatccatgacaatgatggcattcccccacaccagcatcgtctcatctttgctggaaagcagcttgatgacagtcgcactcttacctactacaacatccagaacgagagcacccttcacttggtgctgcgcctcagacgatgcatgcacatcttactgaagaccctgaccggcaagactatcaccctcgaagtggattcttcagacaccatcgacaatgtcaatgccaagatccaggacaaagagtgcatcccaccgtaccagcagcgtttgatcttcactggcaatcagctggatgatg

SEQ ID NO: 51823 - DNA, 426 bp, Zea mays
  Clone ID: LIB3067-030-Q1-K1-A8
cccacgcgtccgggagatcaaccccgagaacgccatcatggaggagctccgcaagcgtggggaggctgacaagaacgacaagtccgttaaggaccttgtcatgctgctgttcgagacggcgctgctcacttctggctttagcctcgacgatcccaacacctttggcagccgcatccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctagttaat

SEQ ID NO: 51824 - DNA, 395 bp, Zea mays
  unsure at all n locations
  Clone ID: LIB3067-030-Q1-K1-A9
cccacgcgtccggagagagagagaccctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaaggagttccagcgcaggaacaggatctacaaggaggagcaacgtcagatcagagctgctgctcgtaaggccaaggaggaagctgagggtgcccctgctgttgcagcacaccattagtctacctggctattttntgcgttgatgttttctgttaactcatctttgggtcaattatgatggctagggc

SEQ ID NO: 51825 - DNA, 445 bp, Zea mays
  Clone ID: LIB3067-030-Q1-K1-B1
gcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgacgacgaacgtatgctgtttgacattcagaagttctacaacgtgttgatt

SEQ ID NO: 51826 - DNA, 375 bp, Zea mays
  Clone ID: LIB3067-030-Q1-K1-B10
ctccatgttatgacacagaaacagccatcaacagaccgtggatcatcagatgttcactggggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagc

SEQ ID NO: 51827 - DNA, 451 bp, Zea mays
  Clone ID: LIB3067-029-Q1-K1-H5
cttgctctgtgaaattgatagtttgaagacacagcaacttctcgataggccttgcagtggcatcaatggcttagtttcatcctttgtttcacggctaagggaagagaactcttctcgagagcataccattttaagaactgctcaaaagcttaagtcattctcgtttaacaagttctcagcaaacggctaccatgatttcctgccatcgcggcttcgtcccaagtttcagaacattgatgccaacgagtgtactttctctgagattctttgcctaatatgtggaagcccgttcagtgaatcagagctcctgaatttggaaaacacaaagctcaaggctcagaagaaaattgatctttatactgcccattgttgtcaaagttgccatttccagattctcccagcagctacagatatgtatggacatttcttttcgctactaccgaaattttgg

SEQ ID NO: 51828 - DNA, 400 bp, Zea mays
  Clone ID: LIB3067-029-Q1-K1-G2
cggacgcgtgggctgttatacattctgataatagcactgaggtgccatcaagccactcgcgcggagtgtcattatacgactgcgcggagtgtatgaaaaggatgtctaaagggtcgctcatcaaaacactgattgtgtacgcttacgacgctcaagcacatgagatcacatgaacactgatacgaccttctacatagacgctcactacgaactatatgctcaatatgtaactactgtgcataattcaacgacacttgtacattaaagagtgacaatcacacactgatactctcgcctctattgctgcagtctggcaggaacataagggacttcctaactaatatcaggtctcgcattaaatcactctggggacgtcgacatctgcctgatatgcttcaca

SEQ ID NO: 51829 - DNA, 404 bp, Zea mays
  Clone ID: LIB3067-029-Q1-K1-G3
aggacggccagataataagaggtttgggtgagtgagcccgagcagtccgggtgacgtctcgtaggaactgtgtatgctgcttagcctctgttgttgtacaggcttgtcatttgtttggtctgcgcttaccggtagggcgcgccttgtccggtgaacgatgatggtgtattatgagagggatttcttaaggggttcacgtttggtgtgcttgggttgctttgatagaaacatttgggagaggtttatcgcgcctgctctgctctctcatgtaactccagattgctgagctggcacctgctctgctctctcatgtaatgtaactccagattcctgagctgctatgtttttttttaaaaaaaaaaataataaaaaaaaaactaaaaacaaaaaaaaaaacatattac

SEQ ID NO: 51830 - DNA, 433 bp, Zea mays
  unsure at all n locations
  Clone ID: LIB3067-029-Q1-K1-G4
ctggaagttatagggttggtgatgttatgaccaaaagggaagagctccatgttgtgaaaccaacgacttcagttgatgacgcccttgagatgctggtgaagcataggatctctggctttcctgttattgatgatgactggaatttggttggcgttgtgtcagattatgatttattggcactggatacaatatcaggagctggaccggctgaagcagacatatttcctgaggtggatagcacttggaagacatttcatgagatacagaagcttttgagcaaaaccaacgggaaggttattgctgatgttatgaccccagcgcctctcgtggtgcgtgaaacaactaaccttgaagatgctgcaaggttactccttgtgactaagtaccgcaggcttncagtggtcgatagctcaggcaaactggttgggatcat

SEQ ID NO: 51831 - DNA, 334 bp, Zea mays
  Clone ID: LIB3067-029-Q1-K1-G5
cccactcgtccggttggttcttgctcaaactgtcttgatgaagggtttctgttgggacaggttcctgaaattatgttttgccctaggataatcttgcagttatggaaccttgttatattgtatcctgcaatttgtttcttgcaacttataagagtgattttatttgatgagtcttagaaaaaaatacattaaaagaaaacacacataatatcaaaagcatataaaaataatatagactacaattactaccactataagatcattacacaacatgtctgccaaaatcatgacgtatatgacaaaaaatgtggctctcgctattgatcactaacta

SEQ ID NO: 51832 - DNA, 411 bp, Zea mays
  Clone ID: LIB3067-029-Q1-K1-G6
cccactcgtccgattgcgaacaacttattgtaatacacaactactatattttgtacaatggttacttttgtcttctgtgcaatgtctgctatgctcctaagatagcatcagccgaccacttctgtatgtatatatatgttaaaattttatgaatataatccagataaagacttgctcaaaaaaaataaaaaaaaagaaaacaaaaaaaagcaacaagaaaaagaaataattctaagaaaaacaatgataaaacataaaatggctacaaaaatcactgactccctgccaagttacatggcttgataacattttgtcaacgcgaatctgcatgaggatacttcacctagacttacctctgattcagcagacaaaaactggtacactctgcttgactctctttagttcgctaac

SEQ ID NO: 51833 - DNA, 385 bp, Zea mays
  Clone ID: LIB3067-029-Q1-K1-G7
ttcactcgtcctatcactcgtgacataaaataatacacaaaatactattacaataactaagggaaatttagtaaaaataaacaacgtatgttgtcgttctattatatgatattatgttaatgtatgacatattctatttattaaatttttttgagtatgatctaaattaaataattctatgaataacattcaatatactgataacgtgaaaagcatgaagattacgtatttattctcatatcatcatgtatatctttaaaatggttgcataatttctaatactctgaaaattacatgtattctcaacattttcgctaaccgaatgtgcattgtaataattcatgtagagttacatctaattcagcatataaatacgtttacacta

SEQ ID NO: 51834 - DNA, 457 bp, Zea mays
  Clone ID: LIB3067-029-Q1-K1-G8
caggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggat

SEQ ID NO: 51835 - DNA, 453 bp, Zea mays
  Clone ID: LIB3067-029-Q1-K1-G9
acgcggacgcgtgggcggacgcgtgggctgcaagccatgatgaagttgatcttgatgagttggtggatgaccctgaacttgagaagttgcacgcggagagaattgctgcccttaagaaagaggttgagaagcgtgaagtgctaaaaaggcaaggtcacggtgaatacagggaggtaattgaaggggacttccttggggaggttactggcagtgaaaaagtcatatgtcatttctatcaccgtgaattttaccgttgcaagatcatggataagcatttgaaggcccttgctcctgtctatgtgggaacaaaattcatcaagcttgatgctgaaaatgctccattctttgtagccaaactggcaatcaaaaccttgccatgtgtaatattgttcaagaagggtattgctgttgaccggttagttgggtttcaagatctcggaagtaaagacgatt

SEQ ID NO: 51836 - DNA, 451 bp, Zea mays
  Clone ID: LIB3067-029-Q1-K1-H1
cggacgcgtgggtccccattccaatacacagatctcgcacccgtaagtggcgacgaatctcgcggtgcggaggcgcgacagaggcggtgtcgactccgacggactcgcagccaccggtggagacgccccaccggcgcactcctccaacgttcatagtttaagggcttgatttggataattagtcatcaacagaagtgataaaaaatggtggttcttgcagcatcaatcgtttcaaagtcgggaaaagcacttgtttcaagacagtttgttgacatgtctcgcataagaattgaaggattacttgctgcgttcccgaaactggttggaactgggaagcagcacacttatgtcgaaactgaaaatgtgcgatatgtttatcaacctattgaaggtttatatcttctacttatcacaaacaagcagagcaatattcttgaagatctggacactt

SEQ ID NO: 51837 - DNA, 450 bp, Zea mays
  Clone ID: LIB3067-029-Q1-K1-H10
cccacgcgtccgcccacgcgtccggtcgatcctgctggacaccgcgcagagcgagaagacggcggcgccgaacctgtcggtgggcgggtacgaggtgatcgacgcgatcaaggcgcagctggagagggcgtgcccgggcgtggtgtcgtgcgccgacatcgtggcgctggcggcgcgcgacgccgtgtcgtaccagttcaaggcgtcgctgtggcaggtggagacggggcggcgcgacggcacggtgtcgctggcgtccaacacgggggcgctgccgtcgcccttcgcgggcttcgcgggcctgctgcagagcttctcggaccgggggctgaacctgacggacctcgtggcgctgtcgggggcgcacaccatcggcgtggcaagctgctccagcgtcaccccgcgcctgtaccaggggaacgccagcagcgtggacccgctgctggactc

SEQ ID NO: 51838 - DNA, 449 bp, Zea mays
  Clone ID: LIB3067-029-Q1-K1-H11
cccacgcgtccggtaaaataacagttctggtgcacccggtggcaccacgtgaggaacggtggcagctggaggaggacgccgacaaggtgaacctgtggttcgaggtgcctgggcagtccaaggaagacctcaccgtggagatcgacgaagacgtgctcgtcatcaagaagaggaaggagctggtgggccagcggagccctggcagtggcgtcgcagagtacggctcccagtcccagcagcagagcaggaggggcaccgcagatggcaaggacccgctgccggcggcacagcaaggccagggcggcgaggtggtctatgcccggatgctcctcccggcggggtacagcagggatggcgtgcaggccgagctcaagtccggcgtgctcaaggtcactgtcgtcaaggtcacggagcgagcgcgcatgaagatcgacgtccccattcaagtc

SEQ ID NO: 51839 - DNA, 352 bp, Zea mays
  Clone ID: LIB3067-029-Q1-K1-H2
aagacgcgtgggtccccattccaatacacagatctcgcacccgtaagtggacgacgaatctggcggtgcaaaagggccgaccgatgtcgaggttcaatgctaccgactgcgtgcctccgacggagacgctctaccatcgcgctacttaaacgcaaataactgaccgtcttgatacaactaattaactgtgaacacactggatttaccaagctgaatctcgcagcatcaaatgcctcattagtccagatgagcacttgttctaagacgccttgacgacatgtctttcataagaattgaacagatcactatgctgaatggcaaaacccctttaaactggcataaagcacactta

SEQ ID NO: 51840 - DNA, 298 bp, Zea mays
  Clone ID: LIB3067-029-Q1-K1-H3
gaaatatcttgccacctgacgcgacagcgacaagatccaagaactcgctcgcgcgcacgggcagggccggagcccagggatcgagactgatcagcgcttcgagacgccatgatcgtagatgatgagtgtcgtatgctgaaggatgagatccataagctcggccagcattaacaccgatggctactacaaggtcaagttcggcgctctatttaacgacgatcggtgtgctaatatttttgaagcactagttggtaccttgagggccggcaagaataggaagatcttgacctacgaaagc

SEQ ID NO: 51841 - DNA, 382 bp, Zea mays
  Clone ID: LIB3067-029-Q1-K1-H4
gtcagacatacctcacccaggtgtggcctggccccgtctacttcccggacttgctcaaggcgaacggtgtatcgtggtggatcgatgaggtgcggaggttccatgatctggtcccggtggatggcctctggattgacatgaacgaggcctccaacttctgcacggtcaagtgcacgattccgaatacgcaccagtgccctattcctgacaccaagacaccatggctctgttgcttggattgcaagaaccttacaaacacagggtgggatgagccgacgtacaagatcaacgcttgcggtcagactgcccgtctcggcttcaacaccatctgaaccagcgctacacactacaacggcatcctgtagtacaatgcgcacagtct

SEQ ID NO: 51842 - DNA, 378 bp, Zea mays
  Clone ID: LIB3067-029-Q1-K1-G12
gcgccaagtcccggaggcggaggcggtgatctttgttcgtttcctcgcctctcctctcctcccctctcctttcattccctgtcccgtggacggcaatggcgggcaccgcgcggcttcttcctgccgcggcggcggcgctgctgctgctgctctgcatcgcgggcggcgcgcgggcggccaacgtgacgtacgaccaccgcgcgctggtcatcgacggcgtgcggcgcgtgctcgtctccggctccatccactatccgcggagcacacccgacatgtggccggggctgatccagaaggccaaggacggcggcctggacgtcatcgagacctacgtcttctgggacatccacgagcccgtgaggggacagtacgacttcg

SEQ ID NO: 51843 - DNA, 382 bp, Zea mays
  Clone ID: LIB3067-025-Q1-K1-D5
cccacgcgtccgcccacgcgtccgcccacgcgtccgcccacgcgtccgccccatctcgcccgccgttttcgtccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaagtcggtatgagtcattctggaaggagcttgatggtgtcaagcaggta

SEQ ID NO: 51844 - DNA, 229 bp, Zea mays
  Clone ID: LIB3067-025-Q1-K1-D6
cccacgcgtccgaccacgcgtccgcccacgctttcgcccacgcgttcgaccaatctagatcggcgtcattgtccttatagatctccttgcacctcgttgccacacctatccccttatatccaccaagggtacatgatacttcataattgctgcgatgctggcacatctgcacactcatgcggttcactctgacagaattcgcctctaagcacgactacattctactaca

SEQ ID NO: 51845 - DNA, 433 bp, Zea mays
  unsure at all n locations
  Clone ID: LIB3067-025-Q1-K1-D7
gcagcacctgcaggacattgagaaccagccagctaaccaaccaaccaaccggcggagccaaagccaagaaggaaggcaacgtgcccatccagtcaggatgtgcaactccaacgtcaagtccgcgggggtggcccagatcgacggccgcccggtgctgcagccggcgggcaaccgcgtggcggcgccggagccggacgcctcccgcccgctcaagaagtccctacagaagtcgctctccatgccggcctactacgacagcaatgccaccgcgggcgcccgtcctgcgccggccgagaacacccgcgcaagcgcagcggcttcgtctccgctgcctnccgcgaaagcgacgaatgcagctggcgctttacccgcggagaagagcggcaggcccaaggcggccaggatgccaggcgccgttgccgccccggtggtg

SEQ ID NO: 51846 - DNA, 391 bp, Zea mays
  unsure at all n locations
  Clone ID: LIB3067-025-Q1-K1-D9
cttgagtgtcagcgtggttaaccttaggaggcagtgcaggcaggttgatgacctgaacctacccaacaacggacatcacacagcccattaaaaggcttactggttgtggttgtgggtggctggctctagtgcagtgcacaggaacttccaacggagtatgtgcaagtcgtcagaagttgttcaaggcagcttgtttgtcatcatcaccagggatacaagacatgcttcctcagtaaggtgttatcggaatttttcggttcctgtaaactgatataaatcgatggtggaactgtactgataatcttccgtatggtgttattggaatttgtgtgacagttcctgtaaactaatgcagagagagagatccagcggtgctcctgcctnctaaatc

SEQ ID NO: 51847 - DNA, 439 bp, Zea mays
  Clone ID: LIB3067-025-Q1-K1-E1
cgcatgctcttcagcaagtattaactgatgatgttgatttcaatgtgatgctttcttttctagaattctatgagactcttctaggatttgtgaacttcaaaatctatcattcaataaatgtaaattatcctcctattctggatccacgtctggaagctttagctgttgagctctatgcattgtgccgatacatgtctgctggttccagaagaatgattgggaattcacaaactgacgaagtaatggaagataaggatgagaaaagtaaagctgaggaagtaattgaggaagagaaggttgtgaagaataaagcaagctcaaaagcagatgaatctgagttcagattagcacagcttcaacatcagctcccaaccaatgaacctggtgcactgatgaatcttgtagaagaatcaactgccgatgatgcagatgatgatga

SEQ ID NO: 51848 - DNA, 449 bp, Zea mays
  Clone ID: LIB3067-025-Q1-K1-E10
cactctccccagctcgagtaaccaccgcgagaaccaatcaccaagcaaaagcccgagaaggaaagaacaaacaggagacagatggcggctgcagcgaaggcgtcgtggatggtggcgatgagcgtcggggccgtggaggcgctcaaggaccaggcgggcctctgccgctggaactacgcgctgcgctccgtccaccgcgccgccaaggccaacgctcccagcttcgcgcaggccaggaaaaagctggcgccgcccgccgcggacaaggccgccgcggaggaggggatgaggaccgtcatgtacctcagctgctggggccccaactagctagggcctctgctagtttcggcttcctgcaaccgtaccgagctcggcttcaaatctgatccatgactgggtgccttgccgacccactgtaacataagagtttagcaccacgatgatgatga

SEQ ID NO: 51849 - DNA, 262 bp, Zea mays
  Clone ID: LIB3067-025-Q1-K1-E11
ctgcctacgcgcacctttcggccacggcgctgttgcagaaggcggcgcagacgggcgccagcgtcaccagcgcgggctacacccacatggcggcgcccgcgacaagcgccaccttcagcctcagtctgccatacctgcagaatacccagccacaccagcatcaggacggcgggatcatggccgggctctctaggacaggctcccacagccagtgctgcgaccaacgcgcggtccagaagcggacgcgaccgactgaccagtg

SEQ ID NO: 51850 - DNA, 372 bp, Zea mays
  Clone ID: LIB3067-025-Q1-K1-E12
cgcacacgtccggtgccctaccaactacgcgctgcccaacgacgacggcggctggtgcagggcggcgaggcaggacttagacatggtcgagccggcctggctcaagatcgagatctaccagcgctgcatcatgcccgtcaactaccaaagggtgccgtctgtgaagaaaggctcactgaggttcatcatcaactggcgcgactactacgagctggtgctcatatccaacgtgcacagctgcgggtccatccagtcggcgggcatcaaggggtcgcgcaccgggtggatggccatgtcccggaactggggcgttaacttggcaattcaacgcgtaccttaatggccagagcctgtcgttccaggtcaccatca

SEQ ID NO: 51851 - DNA, 292 bp, Zea mays
  Clone ID: LIB3067-025-Q1-K1-E2
aaaaaaaaaaaaaaaaaaaaaaaaaaaaaaaaaaaaaaaaaaaaaaaaaaaaaaaaaaaaaaaagaataataaaaaaaaaaaaaaaaaataaaaaaaaaaaaaaaaaaaaaaaaaaaagtaaaaaaaaataaagtgtaatattataaataacatatatttaaaattttaaaaaatttgttggctgcttcgttgattagcatttactgcatttggattaagaagggattagctttgtaaaatctgtcggtaaaatattttattggtatgtgatttttaacgctgttaataaat

SEQ ID NO: 51852 - DNA, 187 bp, Zea mays
  Clone ID: LIB3067-025-Q1-K1-E3
aaatttaggagtagggcatcgtacgtagtgactgttatgctgttttagccttgctgtttgtcgcccctacctatactgggaactgtaaccatggggtgcatctgtgcatgcaaacgcgacaagcaaaattcgggattatcaatcatctgtgctactcgtgctctgttgatgatcttcttgttaaggc

SEQ ID NO: 51853 - DNA, 330 bp, Zea mays
  Clone ID: LIB3067-025-Q1-K1-E4
cggacgcgtgggtgctgctgctgctgctcgtggggctgagctgcgccaatcccaactgtgaggagcgtcccgcgatgcggcgggtggtgcagatcctcaaccgagaggcggagcctgtgcccgtgccgcccaagaaaccactgctggtgttcagctccagcgcgtccgcgaagctgcaggagatcgccttctcctgtggcgatgacgtccgaggcggctactccgttgccaagcctgcatcaccaaagtccgagggagccgacattgaacgctgacgcgaagcagtcgataccaattacactactacagattttgtggtgtgggaatata

SEQ ID NO: 51854 - DNA, 397 bp, Zea mays
  unsure at all n locations
  Clone ID: LIB3067-025-Q1-K1-E5
gagaaatccctacgaagaagtactcattgctcttcatacttggtgctggaactctaccttttggaacactcttcatcgagctcttcttcattctttctagtatttggcttggaaggttctattacgtgtttggcttcctccttgtcgtgcttcttttgctgattgtggtgtgtgctgaggtatcagttgttcttacctacatgcatctctgcgcggaggactggaggtggtggtggaaagctttctttgcttctggaacagtggccctttatgtgttcctttactctatcaactacttggtgtttgatctcagaagcttgagtgggccagtttctgctattctctacattggatactctntcgttgtctgccttgccattatgctagcgactggtac

SEQ ID NO: 51855 - DNA, 465 bp, Zea mays
  Clone ID: LIB3067-025-Q1-K1-E6
cccacgcgtccgcccacgcgtccgcccacgcgtccgcggacgcgtgggcttgttatgaaggtaccccatgtatcacggactgtgttatggctgagcttgaaaagctggggcagaagtatcgtgtggccttgagaattgccaaggaccctaggttccaaagattagcatgcacacacaagggaacctatgctgatgactgcattgtggagagggtcactcagcacaaatgctacatagttgctacttgtgatagagatttgaaaaggaggataagaaaggttcctggtgttccaatcatgtacatcacaagacataggtattcgatagaacggctccctgaggccacaattggtggagcaccaagaatctgatcggtgcagacatgaaatgttctgggatgtaatactatggcggtacttgtccatctgaccaagtcactatttcatgtttcagtccacgacaagg

SEQ ID NO: 51856 - DNA, 441 bp, Zea mays
  Clone ID: LIB3067-025-Q1-K1-E7
tgcctcgtactcgtctcggaattcctcgtgtcgactccacgtcgttccgctccacgacgtctcgaaaagaaaaataataatagaataataaataaaaagaaaaaaagaaaaatataaaataaaggagaacaataataaataagagtctataaattaatataatatataagtatgaagaaatatgaaaaggtatataatatacggtgttatggaatttgtaacttgatcgtgctatctttttgctgatatgtggtgtgtgctagaggtattcagtgtgttcttactgtacatgcatagtgtgcgcggtggacatggaggttgtggtggaaagctttatttgcttctggaacataggccttttatgtgttcctttactctatcaactacttggtgcaagatctgaaaagcttgaatggaccaggttctggtagtctatacatt

SEQ ID NO: 51857 - DNA, 318 bp, Zea mays
  Clone ID: LIB3067-025-Q1-K1-E8
cagccaaattgttgtactgaggatgagcgattgaaaaatacagaagggattgaacggcatccagatgtttcaaatcactataccgacatatgtacaaacgaggctgcctctgttgcagcagaatcttcagccccatcagttgagatagtggcagagaaaacagtagatgaaccatcggaggcagaaagagcagtggatgaaccggcagaatcatctttggacagttctgtctctatacctttgcctgctcctgttaatagtagtgagcctgctaactcggaagcctcttccgaacaagttgcccatgacaactgatgt

SEQ ID NO: 51858 - DNA, 446 bp, Zea mays
  Clone ID: LIB3067-025-Q1-K1-E9
cggcaacgtgtggcaccccagcagggtccggaagtacctgacacaggacgactggtcgccgacggagaccaagggcaggccttggttcggccttctggcgcttctcaggaagtacccggagcactttgtcatcaacacgaggtccaagggcaggatgacctcggagttcgtctcgctggtctccttgctctcctagagggacggagatggcgtgttgtgtccagcccgtgtccagaagggtcggaggtgtactggctctcgtttgcttgccccttgctgtgtttcagcagctgttatatggacccaccctgttgtgctgtagtatctcgtgtggtcgatcgaggcagctgcactggtccgtgaccgtctctgtagtgtcggcagcagtgtatggaaagcatgcgttttaagttttaacctatgctagcaattcagcagcagctcgg

SEQ ID NO: 51859 - DNA, 313 bp, Zea mays
  Clone ID: LIB3067-025-Q1-K1-D4
agaagagctacaaaccaccaaagaagccactcactgaaaaggagattgatgagctatgtgatgagtgggagccagagctgctatgccctccaatcaaggagggggccaaaatagatgctccaacattggaaagtgccgttggaccacatacgattgttgattgttgatggtaaagaagttgtgaactttgcatcaacatgaggtctggagtctagacacagcgttgcaaactgaggtttaatcatcttagcaactacggtacgtgaccctgagcgcgtgattgttgcgaaacaatgaccacctcggtctacac

SEQ ID NO: 51860 - DNA, 426 bp, Zea mays
  Clone ID: LIB3067-025-Q1-K1-C1
gcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatcgataatgtcaaagccaagatccaggacaaggaaggcattccaccggaccagcagcgcctgatctttgctggcaagcagctggaagatggccgtaccctcgccgactacaacatccagaaggagagcaccct

SEQ ID NO: 51861 - DNA, 451 bp, Zea mays
  Clone ID: LIB3067-025-Q1-K1-C10
cgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgccctagaagcccatgcagctcccaac

SEQ ID NO: 51862 - DNA, 342 bp, Zea mays
  Clone ID: LIB3067-025-Q1-K1-C11
cccacgcgtccgcgcgtgattccgcatcccgttcgcgagcgcgacacacgctgacagctcacggctgaccttcccgagtcccgacggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcagggtgtatgacgtcactccgtttatggatgagcatcctggtggagacgaggttttgctagctgcaactggaaaagatgctacagctgatttagaagatattggccacagtgattcc

SEQ ID NO: 51863 - DNA, 432 bp, Zea mays
  Clone ID: LIB3067-025-Q1-K1-C12
cttctaccgagttgtgaactgctgaactctagttctgtgtatctgttacgacacctagcactagcaggcatcagaactctataggtgtgacacttgaaattgttacagattaagacgcactgacggtaccctgcgctcagttgctcgatactcgaggcttgtaggtgattgtatccagtagtttgaagaactggttatctaattatttatgtaccgtggatccaccattttggatacgcttcatcaatataaaagagctccaattatgaaagttaggagaaaatgacgatctctaaactattcttgagttgtcgtccagctgccaagactaatggaattgcagtttaatgtctctgatatattggaacgtgtcatctcgctccaagcttatacgttggtctgctggtacgtgccagttctgtaaggagaaat

SEQ ID NO: 51864 - DNA, 166 bp, Zea mays
  Clone ID: LIB3067-025-Q1-K1-C2
agcacggtgagcataaagctgggcttgccgcaccggaacgccggcgcggacgagcgcagcgagagctgcgagccggctatggacgagatacaacgcgaggtgtactcgaataaaggcgtgatgcttcagctgatgcggtggacacgtccgcgatgggccacggttg

SEQ ID NO: 51865 - DNA, 329 bp, Zea mays
  Clone ID: LIB3067-025-Q1-K1-C4
gcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgtgaaaaagcttgaagatattgttccttcatgacacaactgtgacatttcccatgtga

SEQ ID NO: 51866 - DNA, 432 bp, Zea mays
  Clone ID: LIB3067-025-Q1-K1-C5
caattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaattgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacgcgacatgctagactagaaacccaaaagtgattccagttgcttactggaatcttcttgatgtgtcttgaatgcccagtgtagcacagcacaattatgccagtgctgataaccccca

SEQ ID NO: 51867 - DNA, 276 bp, Zea mays
  unsure at all n locations
  Clone ID: LIB3067-025-Q1-K1-C6
cccacgcgtccgcacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctggatccgacggtggtgcgtgtgggtaccagggtgccgtcgaccagcctncgttctcggcaatgatcacc

SEQ ID NO: 51868 - DNA, 454 bp, Zea mays
  Clone ID: LIB3067-025-Q1-K1-C7
gtgagacaaaagcagagatattgcaaaacctagctgagttccagttttcttgtgtcatgtacaatggtgccctagagaatgcatgcagtgagcttggagcccgtatgtctgccatggacagctctagcagaaatgctggcgatatgcttgatcgtctcacgcttacttacaacaggacacgccaagcattcatcaccacagagcttactgagattatatctggtgcatcagcccttgaaggataggtgaagagactatgtggacttctgcctttttccccatttgtgttcctcacacatgaaagcttcttttcttccggaagctcagtttcaacccttctcgtttcacttttgcttgataaacgtattctcatgctttattgcaataattaagccaacgacagtgatgatgccgtgcgtatttgcatattgcaaaaagaatggtctacatctat

SEQ ID NO: 51869 - DNA, 395 bp, Zea mays
  unsure at all n locations
  Clone ID: LIB3067-025-Q1-K1-C8
cccacgcgtccgcccacgcgtccgcccacgcgtccgcccacgcgtccggcggccgagagaggccgacgcgcaccagcagatcccaaactcaccggggaggagggagtgggcgaccggcggcggcgatgggtttcatcatggagttcgcagagaacctgatcctccgtttgatggaggacccggacaagcgcgaccaggttcggcgggagcatgcctacaagatgaaggagcggtgcgagcgcaccaaggcggcgtggagcctncctctgcgcccctacagcttctggaccttcgaccgcttcaactcgcagctctcctgggacctgcagatcagccaggctgccggtcgccgggacccttacgacgaccttattacccgcactccggctcccggc

SEQ ID NO: 51870 - DNA, 423 bp, Zea mays
  Clone ID: LIB3067-025-Q1-K1-C9
cccacgcgtccgcccacgcgtccgcccacgcgtccggttccccgtcggccgcatcgggcgctacttgaagaagggccgctacgcgcagcgtgtcggcaccggcgcccccgtctacctcgccgctgtcctcgaatacctcgccgctgaggttctggagctcgctggtaatgctgccagggacaacaagaagactcgcattattccgcgccacgtgcttctggcgatccggaacgacgaggagcttgggaagctgctgggcggcgtgaccatcgctcacggcggtgtgctccccaatatcaaccctgttctgctgcccaagaagacggcggagaaggcgtccagtgtggggagcaaggaggcaaagtcgcccaaagaggccgtcaagtcccccaagaaggcatagactgactgtctggagtgatc

SEQ ID NO: 51871 - DNA, 388 bp, Zea mays
  Clone ID: LIB3067-025-Q1-K1-D1
gcgtaccgtgagacaaactcagacatattggtttacctatctgagttgcagagttcttgtgcggtgtagaatggtgccctacagaatgcatgcactgagcttgcagcccgtatgtctggcatggacagatctagcagaaatgctggctatatgcttgatcgacttacgcttacttacaactggacacggcgagcatccatcactacatagcttactgagattatatctggtgcatcagcccttgaacgataagtgaagagactatgtggacttatgcctatttgcccaattgagatcctcacacatgaaggcttattttcttccggaggctcagtttcaacccttatcggttcactgttccttgatgaacgtattctcatgctttatt

SEQ ID NO: 51872 - DNA, 428 bp, Zea mays
  Clone ID: LIB3067-025-Q1-K1-D10
aagtcatcgaggagggcttgggcatgcacagcatcatctgcattgaggatcttgttcacgagatcatgactgttggcccacacttcatggaggcgaacaacttcctgtggccattcaagttgaatgctccgctgggaggcctaacgaagaacaggaaccactatgttgagggcagtgatgctggtaaccgtgagaactacatctatgagctcatccaaaggatgaattatgttcacgatcgagctcattgataccctgtgctctaagcgacttgtgctatccttattttatattagaaagttggatcgtggatgaatatgcatgcaggtttgatgtttcgaactagatgtgtctggaagaaatctgatcttctttctggaggttcgggattattatttaaagcatttcgtatctaagatgttagcacc

SEQ ID NO: 51873 - DNA, 201 bp, Zea mays
  Clone ID: LIB3067-025-Q1-K1-D11
aaaaaatgtcagcgtggttgaccttaagaagcataacaagcatgaaggatacctgaaactaggtcacaaactgacatcacacagtccattgaaagggttactggcttagggtcccgttaagttggctgtagtgctttgcagacgaacttccaacaggaaatgctctggtcgtgagaaaaaaacttagggacctgggaaatc

SEQ ID NO: 51874 - DNA, 326 bp, Zea mays
  Clone ID: LIB3067-025-Q1-K1-D2
cccacgcgtccgtgatgtttcttttgaattgaacctttttgacaaattggatcttggttggtatgtgatcgcagtcacttcaactccaagcaaggtccataaagctgttgatgcctgcaaaggtgttctgagaggattgcatagtagccgaattgtggaaagggagctcgatcgggcaaagaggacactgttgatgaaacatgaagctgagacgaagacaaacgcctactggcttggtttgtttgcccatctacaatcttcatctgtaccaagaaaggatgtatcatgcatcaaggaattgacgacattatatgaaaatgcaacga

SEQ ID NO: 51875 - DNA, 459 bp, Zea mays
  Clone ID: LIB3067-025-Q1-K1-B9
cacgttcacacttcgggcttattcgtttcaccgttaatccatgtggattgggtggtattgaggtggtattgagtcggtttaaatccatagcaagctaaaattcatcccaatttattccaatacactccaatccacatgtaattagaataactgaacaaggtcttcagtgtttcattctattccacacacttagttcaactttgtttaaggtatactacattatccttgtacactactcagcctgtgagttcatatcggttatgatgattgcctgtcactcatcaaatcatacttttcattatccatagaaaaaaaaaccgaattaggtttttaagacagctagcttttgatacatgtgtgtgttatctcaatattatgagggctccaaaagagtatgatgggtagctcgagtaaatcgaattaaactattttttactggcagatatctggaacagttta

SEQ ID NO: 51876 - DNA, 453 bp, Zea mays
  Clone ID: LIB3067-025-Q1-K1-D3
gcaagcctaactgccgcagctgcagctgcaccagaagagattccaaccaacaacccttctttcagagcaagagccttggcagtctcgatagcttcatcacttgaaacttgtagagtttcatcaaggagatcaacatccaagactccagggataaaaccagctccaattccttgaatcttgtgtggtccaggttttccaccattcaaaacagcactctccactggctccacaccatagagcttgacattaggattttgctctctgaggtatcgcccagtaccggtgatggtacctcctgtcccgataccagatacaaggccatcaatttttcctgctgtagctttccagatttcaggcccagtagtctcatagtgaatctttgggttagctggattttcaaattgttgaatgatgtaagagttgggtgtctttgcttggatctcttccgctttc

SEQ ID NO: 51877 - DNA, 306 bp, Zea mays
  Clone ID: LIB3067-025-Q1-K1-A3
acacaacacaccatgtctcgtagcttgctatttctagcggaggctttctatgatgatacttcggtattgaaccagcctagtgcgatgaaagtgacagaaaagagtcttgcagaaacattttctgagataatgaaaagcgctgaaagagaacgagctctaaatatgctcatttcactattgtgttcacattggctagcatggaagtgctgttattaggaaactgccgcaactgtatttctaaaaataaggattatctcaacttaattattatgcaacaaattaatcatttatgacaaatagggctat

SEQ ID NO: 51878 - DNA, 420 bp, Zea mays
  Clone ID: LIB3067-025-Q1-K1-A4
cccacgcgtccgcccacgcgtccggaaacccagattgccatctatgaaactacaaaactagagccagtgaagcagtggcctgttcgagagaattcacctccaatcacacatgctgcattctcgtgtgacagtcaactgatctatgcaagctttatggatgccactgttggcatatttaatgcatcgagtttgagacttcaatgtcggattcttccagcttcgtatctccccccaaatatcagtccgagtgttcatcctgttgtggttgcggcacacccttcggaagcgagtcagtttgctctagggctgactgatggtggtgtttttgtggtggaacctttggaatcagatagaaaatggggaaattcttcaacggtagaaaatgggtctggttgcaacttggccggaacggcttctaat

SEQ ID NO: 51879 - DNA, 455 bp, Zea mays
  Clone ID: LIB3067-025-Q1-K1-A5
gggagcatgaagaggcagcgcatgagcggtgcgcatgagcaaggttcgctttagtgtgctaaaactagctagtagctgcctccctcgatgcaagcatgaaatatgcaagcatgcgtgcatggctagctagcttctcaaactcaagttattaattagtatagttataaagctatatagccacttcaaacttgggacgagcgagctgaatcttctgtttttgttactatggtatggtgtgtgcatgaaggaaagaaaatgggaacacatggacatgcaagttgattagtaagagagtttcattgtatcccttatatatctttgtggtgcattattttttacttagttcgcgtatgtattattgtggggagtgggggaaatttgaagggttactgataaaccgctcgtaacatggggggtggtaagggtgtacacatgtataatctctggggtattat

SEQ ID NO: 51880 - DNA, 384 bp, Zea mays
  Clone ID: LIB3067-025-Q1-K1-A6
cccacgcgtccgcctcccttctccaatcatccctttctggctttctcctcccccctgagaccccgagtcctgccggaatccgagatcccggaggcagcttcccacgggctcctctcactacggtagctggatcaaaccatcgtgctctcgtctcgacagaaaccccggccgaaaacccagccggacccagccctgttcgccgcgcgcgcggtgcccaggccgtgccagatctgcgagatccgcgccgacaccgctacgactatcaccaggtggatgctctcgtgatctctcggaggccgcggggactgagcagcgtctcggcggcggcgtggcctgcataagctgtggcttgccgagatgcaacggaacggggtggtggaatgc

SEQ ID NO: 51881 - DNA, 368 bp, Zea mays
  Clone ID: LIB3067-025-Q1-K1-A7
ccgaggcttaagaggcagttcatgaacgatgcgcatgagcatggctcgttttagtggacagggactatcttgtagctgtctgagatgatgcaagcatgaaatatgcaactatgcttacttgggtagctagatcataacactcaacttattaattaacatagacataaagctatatccccacttgaaacatgcgactatcgagctcaatcttctgccattgctactatgatatgctatatgcatgacgacaccaatacgactataaatagacatacgctctgatgagctctgagagtgccgattggactgatcatatatctttgcggtgcattattctgtacagatgttggctatgcaagatgcaacgg

SEQ ID NO: 51882 - DNA, 409 bp, Zea mays
  unsure at all n locations
  Clone ID: LIB3067-025-Q1-K1-A9
ctctctctaccccctatattcctctcccatctcttcgccgtcttcttttcctcccctaggtcggtctcctcccctctccccaccgaggttccccctccttccttcgcttccttttttccctgtcgccggcggcgacagggttccgttttccttgctccggcgggctgtaaatgcttccggccctcttcggtgcctcagatccggtggtgctcgttcttctggtcttgattcgagtgggaggggaaggggtcgcttcggtgttgggtgactcggagacatgcctgcgctctacgcttacggagatgacgggtgcctcgtctcggcgccggctgagctggccggactcttctgccgcggcgccgtgcagcagcggaagcgcacgctagtggccgcgtccgctgtggccgnc

SEQ ID NO: 51883 - DNA, 329 bp, Zea mays
  Clone ID: LIB3067-025-Q1-K1-B1
cggacgcgtggggtgcgggtgcatggggtacgcggcgttcggcgacaaggcgccggacaacgggctgacggggttcggcttcttcgagccattctggctgatcgacgtggccaacgtggccatcgtggtgcacctggtgggcgcgtaccaggtgttctgccagcccatcttcgccttcgtggagcgccgcgccgtcttggcctggcccgacagcgccttcgacgcgcgggagctccgcgtggggcccctcgccctcagcgtgttccgcctcacgtggcggtcggtgttcgtgtgcgccatcaccgtggtggccatgcttgtcccctttt

SEQ ID NO: 51884 - DNA, 426 bp, Zea mays
  unsure at all n locations
  Clone ID: LIB3067-025-Q1-K1-B10
gatagaatatagaattttaaaaagggagcgaaataggttttttcctttttgcagctccgtcgtccaccaacctcctccgatccggccgctgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctnctcctcctgcttcttatagatcccacccnctcgccgtcgtcgtcggcacggcagctagctcgctagcttctgtacataggtcgacgcgccatatagatactagtctcggattaagc

SEQ ID NO: 51885 - DNA, 428 bp, Zea mays
  Clone ID: LIB3067-025-Q1-K1-B11
cacgtacacactaatggctaattcggatcaccgttaatccatgtgtattggctggtactgcggccacatagatcctgcgatcatccatatcaagctaaaactcattgtaatttatttcactacactggactcctcatgtctgtagaatgactgctcaaggtcttcagtgcgtcatactattgcaaacactcagttgatcattgtctaaggcatactacattatacttgtacactactcagcctatacgtccatatcgcttatgatgatcgccagctactcatgacataatacttttgattatctatactactacataccctattaagagattaagacagctagctgtcgatacatgtacgtgatatctcaatattactagggctcctaaagagtatcaccatatacatgctgtaatcggattaaacta

SEQ ID NO: 51886 - DNA, 447 bp, Zea mays
  Clone ID: LIB3067-025-Q1-K1-B12
cggacgcgtgggcggacgcgtgggcggacgcgtgggagggtgggctcacaaaagatcatagctcaacaagttgtggggaataatgtgcatgaactcaccaaaggtgggagttgatgtgtagtgtaaggctgaacaacaaataatggttaaagctgagcatctcttttaataagttggtcaaaaattattagcacttactaaatgtaagtgtatgccaacccaaagtaatagtaaatcaaaattaataataaaccataatgtgatgcaaatgacaaattaagtttacttccacaaattaattatgtgagtgtacgagctatctaggtggcgtctcctagtcagcttgatggcgccaaggaataattattagttctttttattgttatcgtttattttttttaagactcttccgctatgtaataatgatgtgacatttatctctataca

SEQ ID NO: 51887 - DNA, 300 bp, Zea mays
  Clone ID: LIB3067-025-Q1-K1-B2
cccacgcgtccgcccacgcgtccggcggaacgacgcacgcggacgcctccttgttccgggtcctactcccgccgcctagaggcctcgccctcccccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcata

SEQ ID NO: 51888 - DNA, 459 bp, Zea mays
  Clone ID: LIB3067-025-Q1-K1-B3
cccacgcgtccgcaaacctgtgcgtctgcccctttccagctttcctctcaaacggagagatgtactcggatcagatctccaccgggcgcaagcgctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatcggaggttggtaacatctcaaggcgtcaaattgctgatgaaatgcatg

SEQ ID NO: 51889 - DNA, 318 bp, Zea mays
  unsure at all n locations
  Clone ID: LIB3067-025-Q1-K1-B4
cccacgcgtccgcccacgcgtccggaaccgcagaagtgcagcagaacgatcggatctagcagagttctctcaacctcatcggcggcggcgaagagcgtgcggatcggagatggagacaagcgggtggaggaggagagcggcggcgcgggcctnctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaaaga

SEQ ID NO: 51890 - DNA, 380 bp, Zea mays
  Clone ID: LIB3067-025-Q1-K1-B5
cagtttgatgcgaccgcgggagcgtccgcccgaccgccaccgcgtccgcctcagctcccctcgcttccctctaatttccagcccagtagtagggagactagaatcgtcggcgcgacgccttggcagattcgtccgccccgatcccaccaccaccgtgccccgcgggtgacgtcggaccggcggcgatggcaacgtcggcggcggcgggatcgcgcaggaaggcgccgagccctccgaagcaccgtcacgacggtacctcgccgctgcctctcggcatggactggagccctcccccgaagagatgggagggaaggaacaccatatggccacacaaccctcaaacaggttggagttactgtgtgatgatgccttcttggatc

SEQ ID NO: 51891 - DNA, 461 bp, Zea mays
  Clone ID: LIB3067-025-Q1-K1-B6
cccacgcgtccgcccacgcgtccgcacacacaattaggtcacatacacacttcccggctgcctccctaggtagcagcttctacaatggaggcatccaacaagctcgcagtcttgctcctgtggctggtcatggcagctgccactgccgtgcacccttcctactctgagaattcgcctcaagactacctcactccccaaaacagcgcccgtgccgccgtcggtgttggcccggtgacctggagcacgaagctgcagcagttcgcagagaagtacgccgcacagagggccggcgactgccgtctccagcactcgggcgggccctacggggagaacatcttctgggggtccgccggcttcgattggaaagccgtggacgcaatgcgatcgtgggtagacgagaaacagtggtacaactacgccaccaacagctgggccgtcggcaaggtgtgtggccactacac

SEQ ID NO: 51892 - DNA, 355 bp, Zea mays
  Clone ID: LIB3067-023-Q1-K1-B9
gccacgcgtgcggccacgcgtccgcccacgcgtccgcccacgcgtccggaaggggatgcataccgagtttgaagagaccaatgcactgctacgagctgtcttgaaacttcagaaagattgaggtagggatgcataccaagtctgaggatgatgcctttgcttaaggtttttctaccttgctagaacatatctgtggttagaactttgtcagaactacgtgcaatctgtttgaatgcttcaaacctttgtggtggaacctttgtatgtttgaacctctgttgtggaagaactagtgtgctggaattgtgtatgacttgtgatgagaatgttgtgtatgatggcttttctgtgtatt

SEQ ID NO: 51893 - DNA, 296 bp, Zea mays
  Clone ID: LIB3067-023-Q1-K1-C1
cccacgcgtccggccctttttttttttttttttttttttttttttttttttttttttggttgttttttttttttgtttgtttttttttttttttttttttttttaaaaaaaaaaaaaaaaaaaaaaaaaaaaaaaaaaaaaaaaaaaaaaaaaaaaaaaaaaaaaaaaaaaaaaagaaaaatgagggaaaaaaggacaaagtataaaaaatacatataaaagaaataaaaagaaaaaaaattaaaaaaaaaaaaaaaaatagaataaaagaaaagttaaaaaaatttatatgaagt

SEQ ID NO: 51894 - DNA, 349 bp, Zea mays
  Clone ID: LIB3067-023-Q1-K1-C10
cgaaggtacacttgctgagactggtgaagttttcgataccacccatgaagataactctattttctcatttgaaattggacaaggcgctgtcatcaaagcatgggatatagccttaagaactatgaaggttggtgaggttgcaaaaattacatgcaaatcagaatatgcatatggagctgcaggctcaccaccagagatacctcctaatgcaacccttatttttgaggtggagctagtagcttgcaggccgaggaaaggttcaagcttaggcagtgtatctgatgagaaagccagacttgaagaacttaagaagcaacgggagctagctgctgctaccaaagaagaggag

SEQ ID NO: 51895 - DNA, 423 bp, Zea mays
  Clone ID: LIB3067-023-Q1-K1-C11
gcgtccggtcacggcgtccgaccgacaggacgagactcgcagctagctgacacggccgagaagcagctggcatggcatgcgtagtacgtagccagcagcatctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatccccgacgcgcccgacgtcgccttcaccctgctccgcacccacttccacgactgcttcgtcaggggctgcgacgcgtcagtgctgctcaacgcgacgggcggcagcgaggcggagaaggacgcggcgcccaacctgacgctgcgcggcttc

SEQ ID NO: 51896 - DNA, 406 bp, Zea mays
  Clone ID: LIB3067-023-Q1-K1-C12
ggaaaagacgcaagcgagttcaatccacagaggttcgaggatggcatttccaatgcgaccaagcatcaggccgccttctttccatttggatggggtcccaggatctgcataggccagaacttcgcgttgctggaagcaaagatggcactgagtaccatcctccaacgcttctcctttgagctctcatcatcctacactcatgcgccatacaccgtgataactttgcatcctcagcatggtgctcaaatcaggttgaagaagctttgaccatgatggtcatactgaatgccaaaacatgcactcctagtaacatattgtgattgttcatgtatgcaggtttaaatttagctttgatatgaataatgagaaccaagtgtgtatgaatggagtaagggtgtaatcggat

SEQ ID NO: 51897 - DNA, 240 bp, Zea mays
  Clone ID: LIB3067-023-Q1-K1-C2
cccacgcgtccgcccacgcgtccgcccacgcgtccgaaaaaaaaaaaaaaaaaaaaaggaaaaaaaaaaaaaaaaagaaaaaaaaaaaaaaaaaaaaaaaaaaaaaaaaaaaaaaaaatataaaaaaaaaaaaaattaaattaaaaaaaatataaatatataaattttatataaaattaattaaattgaattaaatgtaaaaaattttataatttttaaaatggtaaaaatttaaatatt

SEQ ID NO: 51898 - DNA, 421 bp, Zea mays
  Clone ID: LIB3067-023-Q1-K1-C3
cccacgcgtccgcccacgcgtccggttccccctaaacctgccttgggacctaacagctacactcctgaagctaccaagggcgcctcgcccaatggcacccaagtcaatgtcttgcagccttctgcaagtttttcgccgaagctgcgttgcaacagaaacgtcctcgtcgccgctgctctgctgttcctcgtgatcctttgatcacctcaactccccatgacaatcttttcagaaaccaaatcgacagatatgatagattttagttaaacttggtttacgttgtatgtattgagttacgtatagtgtgatagtatcacattcttttggcctgtgtccacagttccagtaggagttaggatagaacacgggatgagtccatagccctttttttttgcacgttcataatgtacctggtggatgt

SEQ ID NO: 51899 - DNA, 424 bp, Zea mays
  Clone ID: LIB3067-023-Q1-K1-C4
cccacgcgtccgcccacgcgtccggcatcaagagccatgtcattttctgggaatggatgggctgtttgtatcctgacagccaatggcactgtatctaatgtgaccctgcgtcaaggagagtcttctggtggaacagtaacttatgagggccgttttgagattctctctttggctgggtcatatcttctgtctgaaagtactggcatgagcagtcgaacgggtggacttagtgtttctcttgctagtcctgatgggcatgttttaggtggtgctgtcgcaggacctctaactgcagcttcgccagttcaggtggtcattgggagctttctggctgatacaaaaatggagcttgaccctggatcagcacctgagaaacatgttttcagcaggtttcaaactaccagcagtccatctaggggtaccg

SEQ ID NO: 51900 - DNA, 369 bp, Zea mays
  Clone ID: LIB3067-023-Q1-K1-C5
cccacgcgtccgcccacgcgtccggccaaccttcagcagcagaacgtgcgggtcgtcgtcgacgtcgccggctcgcgcgtcgggttcgcgagggagccctgcaactgagcccctgaatccgtccgtgccctatgcacgggaggaaggaggagacgcgctgcggctgccgcatcggtcggtgtgcagttagttgtcctgttagtctatgctacgttgtctgcactctgcaataacggacgtgacccggggaaaaaaactgtttcgtcacgggtagctagagaatcacgtaaggctcttgttttcgtttgtgtcctataatgtatggctattggcctgtttcgagaggttaaaatttggaggtgctgcatc

SEQ ID NO: 51901 - DNA, 369 bp, Zea mays
  Clone ID: LIB3067-023-Q1-K1-C6
cccacgcgtccgcccacgcgtccggccaaccttcagcagcagaacgtgcgggtcgtgggggacgtcgccggcgcgcgcgtcgggttcgcgagggagccctgcaactgagcccctgaatccgtccgtgccctatgcacgggaggaaggaggagacgcgctgcggctgccgcatcggtcggtgtgcagttagttgtcctgttagtctatgctacgttgtctgcactctgcaataacggacgtgacccggggaaaaaaactgtttcgtcacgggtagctagagaatcacgtaaggctcttggtttcgtttgtgtcctataatgtatggctattggcctgtttcgagaggttaaaatttggaggtgctgcatc

SEQ ID NO: 51902 - DNA, 223 bp, Zea mays
  Clone ID: LIB3067-023-Q1-K1-C7
gatgttccaagatgtactcagacaacagtgaacctacaggatctccagaacatcgtgggggcatctaaggagctgggcaaagtacttgccaacttatcgtgaccctgacaacttaatctcgctagtgcattactcatatctgctcctcctacaaatccttactctaccctatctttcacattaacgctaatcatcttgatggtctatacttcatcgtttacta

SEQ ID NO: 51903 - DNA, 312 bp, Zea mays
  Clone ID: LIB3067-023-Q1-K1-C8
cccacgcgtccgtgcacagccagggagagcaagagaagaaggaagacacgtcagacaaaacagaagacgataagaactgatatagccatgttcacgcttccatgcgtacaaagaaattgaagaccggtctccattgactgcgtttactctcttggtcgtggagtttgtttatcctcatataacggtgctttgattataacttaccgccgagggaatttgtattatgacactgcaacaatcttctctccatatatgttcaagggattttcgtgtttcaatgctctccatatatgttcaattgatttccgtgtt

SEQ ID NO: 51904 - DNA, 416 bp, Zea mays
  Clone ID: LIB3067-023-Q1-K1-C9
gaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagacctgattagtacactcttttcta

SEQ ID NO: 51905 - DNA, 371 bp, Zea mays
  Clone ID: LIB3067-023-Q1-K1-D1
cccacgcgtccgcccacgcgtccggcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggcta

SEQ ID NO: 51906 - DNA, 398 bp, Zea mays
  Clone ID: LIB3067-023-Q1-K1-D10
ggaactagttaatctatagacttatatatcgtaatgtgttcaactggtggagccacagatttagcactgttgtaaatcggaaatagtgagtgatatgatcgtcggaagcatagcacgcaaaaacaagaaatgggacatggggtacatccttgagtggatgaatttatgctgtcatatagagcgcgaagtctgcttcctgcgagacaaaaagctatatgacgttcatacaagatggtgatgcaggatataacataagatcattgcttgttcagagaacagcgacatgtataaaaaatctatgatggtattactgcttagatgtatatttgagactgataagggcgatgtattcttggagataattgaatatttattagaaaaggggatgccgctctaaa

SEQ ID NO: 51907 - DNA, 410 bp, Zea mays
  Clone ID: LIB3067-023-Q1-K1-D11
cccacgcgtccgaggaaatgacaattatccactttcaacaggagctgcaaataatttattgttgggtattgagcaaggagctggaagcagcaatggtcagtctgcctttcccaagtttgacaatgggagctcagtggcattaccatctgggcagggaatgtctggtcttatgggaaaaggggcaaaatggcgtgacggggactggttgtgcaacaactgcaacaatcacaactatgcatctcgtgcgttttgcaacaggtgcaaaactcagaaagaatctgcagttcaccctggtgtgttatagcttgctgttggattattttgttccaggatatgttgctgcctgttctagctccttcctcaaggctgcggtttgagttttttcgattctgcagtgtttttgctgctct

SEQ ID NO: 51908 - DNA, 416 bp, Zea mays
  Clone ID: LIB3067-023-Q1-K1-B8
cgcctgcgcgtgcaggctcaccccgacgtgccccctcccctgccctccgcgcgcgatgcccccatggccctacaccgacgcagagctcgcccatgccaccgtgcacgtgccccggcggcgtcgcgatgcccgtgtatccccgccgtcgcgcgcctacgtcagcatgtacctggagcagaagcgatttcgacagcattgccgaggagctcaccgctgtgaaagtgtgttagtcccgtcccctccaggtcctgactctacaattcacttgtgtattcccccgaagcattacgagacagtctgcacggctcctatcaagcaatgaagacaacatcatggtttgctttttcaggagcttgaagtatggtgatagaaagactactgctcagtatttaaagtgtggatgtataggtgaaaaa

SEQ ID NO: 51909 - DNA, 407 bp, Zea mays
  Clone ID: LIB3067-023-Q1-K1-D12
gccactcgtcagacgaaatgacaatcatccactttcaacacgagctgcatataatggatgggtgagtattgagcatggagctggaagcagcattggacaatatgcctttgccaagttcagacaatgggagctcaccgacatataccatgtgtgcaaacaatgtctagtcttatgggaataggggcaacacgctgtgactggtaatgcgtgtgcaactactgtagcgaggaacgctgtgcatatcttgcatattgcaacatgggccgaactgataaagaatttgatgttgacgctgtagtgttatagattgctgatagactattcagttgcaagatatgttactgactgttctagctccttcctcaaggctgcggtttgagttctttcgattctgcattgtatatgct

SEQ ID NO: 51910 - DNA, 406 bp, Zea mays
  unsure at all n locations
  Clone ID: LIB3067-022-Q1-K1-H9
cccacgcgtccggccagagatgagaagaagggtgggaacggacaagacactgagtcaccttccaaggacaccaggactgagagggtggaatcttatgctgcaaagccaagcacgaagaaatggttttgttgtgtgacagccagccctacgcaatcctgaggaagacaactgcatgcgctttggaaatactgtccctttaattttctatacatactatccataagacaatgtangggtacccaggcctctccgggctccaggatgggctatctcgtaaaactcttgcgtgcgtgtatgtatggtgtgagagaattcgcaaagtggacttctggttgtaattcttagtcgtctctctctctctctctttgggttggtcacggttctatgatccagcaatccactgaac

SEQ ID NO: 51911 - DNA, 374 bp, Zea mays
  Clone ID: LIB3067-023-Q1-K1-A1
gtccacgcgtccggggttgccagctttaacatcattccgagcagcagcggggctgccaaggctgttgggaaagttctccctgatctgaatggcaagctcactggtatgtccttccgcgttcctactgtggatgtctcggttgttgacctcaccgtcagaatcgagaagggggcctcctatgaggatatcaagaaagctattaaggctgcttccgagggtccactcaagggtatcatgggttatgtggaggaggatctggtttctaccgacttccttggtgacagcaggtcgagcatctttgacgccaaagccgggatcgctctgaacgaccacttcgtcaagcttgtctcgtggtacgacaaccagtggggcta

SEQ ID NO: 51912 - DNA, 402 bp, Zea mays
  Clone ID: LIB3067-023-Q1-K1-A10
cggacgcgtggggttgcgcatttaggaattaggattagatgattagtggattactcactcagacaagcatcttctgcaacaggcaatttttctgtttcataatcaactgggtctgaaatgtctcatatcaactaatggccgtgagaatgttatttaggcttatataagttatacagaagatatttcgttatgataatgcacaaaagttatggtgtgcaatgaaaggtatatttgagagtaatagaaatagactcattgtgctgcatccttaactgtaagtttcttgtgtgcgactcatcgtaatcgcaggtgtttcctgtttccaatttgcaggtgcaaaatgtgttttccaccctggataggtactgtatttcacttattttcgtttgttccctgaactgg

SEQ ID NO: 51913 - DNA, 241 bp, Zea mays
  Clone ID: LIB3067-023-Q1-K1-A11
cccggtcgacccacaccacgcgtccgcccacgcgtccgcttacgcattcgataactcgtacgacatcatttgcgcataccagtcggggacaaacctctcgtctgctgccatgtacaacaccttcatcataaattggaattgattagacaaatatcaattatggcatgggcgaatgcgtcttactcttatatatcatatacacacaatcttcagccatgctagtggacacatattctagtgt

SEQ ID NO: 51914 - DNA, 287 bp, Zea mays
  Clone ID: LIB3067-023-Q1-K1-A12
cgactgagggacaagagggtgaggctatagctgaggaaacaaagaagagtaaccatgtgcagaggaagattgagaaggcggacacatctgccaagaaaagcaagaaaaagaagaccaaaaccgagactgatggtgatgcaatggatgtggataagccctccaacgtggctgatggagaagctgagcttggaaccgagaagaagaaaaagaaaaagaagcacaagctagaggaggcacaggagaacggtgcagcacatgctaatggcgctgaagagacccagactccc

SEQ ID NO: 51915 - DNA, 351 bp, Zea mays
  Clone ID: LIB3067-023-Q1-K1-A2
cccacgcgtccggcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggctgaggctgaggctgaggctgctgctcctgctgctcccgaggagcttccggcggccgagcagcaggcagccgccgagccggaggccgctgctcctgctggtgccgaggagcccgccgcggccgaacc

SEQ ID NO: 51916 - DNA, 437 bp, Zea mays
  Clone ID: LIB3067-023-Q1-K1-A3
ctcggcccggtcggaattcccggaccgacgcgtccgcccacgcgtccgcccacgcgtccggggctgccagctttaacatcattccgagcagcaccggtgctgccaaggctgttggtaaagttctccctgatctgaatggcaagctcactggtatgtccttccgcgttcctactgtggatgtctcggttgttgacctcaccgtcagaatcgagaagggggcctcctatgaggatatcaagaaagctattaaggctgcttccgagggtccactcaagggtatcatgggttatgtggaggaggatctggtttctaccgacttccttggtgacagcaggtcgagcatcttcgacgccaaggccgggatcgctctgaacgaccacttcgtcaagcttgtctcgtggtacgacaacgagtggggctacagcaaccgcgtcgtc

SEQ ID NO: 51917 - DNA, 407 bp, Zea mays
  unsure at all n locations
  Clone ID: LIB3067-023-Q1-K1-A4
gcgaatcgacgcgcctatctcagcttgctgcactgcactgcactgccctgccatcatatcgtacgtgagcccggccgagagcgagggagaggcatggctgctccgaagctcgcgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgncgcgctgcccagcaagtg

SEQ ID NO: 51918 - DNA, 361 bp, Zea mays
  Clone ID: LIB3067-023-Q1-K1-A5
cccacgcgtccggccacccgtgctgccttctttaacatcattccgagcagcaccggggctgccaaagctgttggtaaaggtctccctgatctgaatggcaagctcactggtatgtccttccgcgttcctactgtggatgtctcggttgttgacctcaccgtcagaatcgacaagggggcctcctatgaggatatcaagaaagctattaaggctgcttccgagggtccactcaaaggtatcatgggttatgtggaggaagatctggtttctaccgacttccttggtgacagcaggtcgagcatcttcgacgccaatgccgggatcgctctgaacgaccactttgtcaagcttgtctcgtggt

SEQ ID NO: 51919 - DNA, 296 bp, Zea mays
  Clone ID: LIB3067-023-Q1-K1-A7
cggacgcgtgaatcgacccacgcttccttaacaaacacaataagacacaccagggaggcttacaaaactggggggaaagatctacctgatctaaatggcaagctcactgatatgtacttccaagttcctactgtaaatatataaaaataataacctcaccatcataatcaaaaacggagcctactatgaggatatcaaaaaaactattaaagctgcttcctaagatccactcaagggtatcatgggttatgttgaagaagatctggtttataccgacttccttggtaacaacatgt

SEQ ID NO: 51920 - DNA, 273 bp, Zea mays
  Clone ID: LIB3067-023-Q1-K1-A9
cccacgcgtccgcccacgcgtccgcccacgcgtccgcccacgcgtccgcccacgcgtccgcaataaccggcagcagcaatccgataccaatcacagatatacagtaagccacatctactagctcgcgggtaggcatgcacagggcgcgggcgtcgtgcttcgccgtctcggtgatgcgcagcgccagccgcgcaggccgggccataggcgagtggatcggcatcgagccgtcgacggcggactctagggcggccggtggagcggcgaacgcac

SEQ ID NO: 51921 - DNA, 407 bp, Zea mays
  Clone ID: LIB3067-023-Q1-K1-B12
gttctagatcgcgagcgccgccctttttttttttttttagtttccaagttccaaccaagaatgccattgaacatcacttgcaaattcaatacttttattgaggagcacaactttctaaggcttataaatagcccaaaaaattctcctcttctgctgtatcaggcattcagagtttcagactcacaatatgcacccttccattcagatatacgccgttgtcctctgcatcgtacccagcttcctcagctgcaatgcagaagatgccagagcaccccagacccagagcagcctggttcttggccttagccatgtcagatccctgtacaccccatcactgacactagtgaactccacaggatacgacttcttggacatcgttgagccagtgacagcatacacagacggct

SEQ ID NO: 51922 - DNA, 207 bp, Zea mays
  Clone ID: LIB3067-023-Q1-K1-B3
cctcacactcgtccctaaatttatttttttaaagcttatagtttgttccacaataagtggagattttatattgggcgggatcatactactaataaagtcattaatcctatcaacttcccgatcatcttatattccaataaaaaataaatcaatacacaccatttcatataaatctaatactcttacataaatttatacttaattaat

SEQ ID NO: 51923 - DNA, 425 bp, Zea mays
  Clone ID: LIB3067-023-Q1-K1-B4
gaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaaaggcatcctctacctgaacacctacgacggccgtaccattc

SEQ ID NO: 51924 - DNA, 440 bp, Zea mays
  Clone ID: LIB3067-022-Q1-K1-H8
ctctgaaaacaagcgggctaaaggatgacaccacctgtgtcgtagttgacattatcccgtccgatcatctgacatcgccacaattgtctccaaagaaaaatcagaacaagttgaagtcactttttcgtagaaggtcgcatagttcagttagaaagcttggaggcaagtctgcctccattggttccgtggaggagttatttgaagaagggtctgcaatgctagaagaaagcttattttcagcttcttcacaaatttaagcagaagttctgccaaacagccagcttctacagcagcttattagttcagctgcttctcagaatacactaaaagcagccaacaagcagaagctgcctttcaccagcttctcagataagctgctttttcaacaagcagcagctgtgccaaacagggccttttatgtaacatataatgtgtgggat

SEQ ID NO: 51925 - DNA, 131 bp, Zea mays
  Clone ID: LIB3067-023-Q1-K1-B5
cccacgcgtccgattctttgtatcactgtatgtagtacatcactggatggtatttagatggaaaacctgagtattctttatctccacgtatgttcttgttctgcattatggcaatggatcttctgttttgc

SEQ ID NO: 51926 - DNA, 227 bp, Zea mays
  Clone ID: LIB3067-023-Q1-K1-B6
cactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaagattggattgcttgttaaagctcaatattgttattgaagtgttattgctt

SEQ ID NO: 51927 - DNA, 408 bp, Zea mays
  Clone ID: LIB3067-023-Q1-K1-B7
cccacgcgtccggaagtgtagggtgggaaggtttggagtgggtacggtggaaattggaggtttcttctgtgttgctattattactactaataaggtcattaatcctatcagcgtccgtaggttgtgatttttggatggaaatgggatcggggtggacggttggatggagattgatggtgcttggttgattggaatggaattattagagaggagaagatgttaggttgaggcttgcaagttgggactggaccagagtgtgactgtgcgagggcaggagcagtttcacagtgactgattggaacctgctgtggggaactgtcgcctcgcctatcagaaatggtctccacaaatgttttccgttctacctttttgaaaaagtctcaaattattacattttttgtggcttta

SEQ ID NO: 51928 - DNA, 287 bp, Zea mays
  Clone ID: LIB3067-022-Q1-K1-G2
gcgagagtcctcccatccacaagttcttagcttttgcgagattgagatccggctggggacagaccgacagaggaaggtgaattgtgggaaagaggacagaaaaatggggattggagatggatcttcaaatgggaaccagcaaccggtgcataaggaaatacgagatgagaccacaccacttcttccagtcaaggtggaagaagacgaagggtttcatgagttcaatggagcttcattctctggggcagttttcaatctgtcgaccaccataattggggcttgaatta

SEQ ID NO: 51929 - DNA, 426 bp, Zea mays
  Clone ID: LIB3067-022-Q1-K1-G3
cggacgcgtggggcacacgagttcttaaatttccttttgaatgaacttgttgatattctggaaaaagagtcaagtgctgctaaggactcaccccaatcatcatctccagaaaaagctccaaatggcccagttcaacctttagccaatggagttaaaaaagaaccaccagttactctggtccataaaaatttccagggcatattgaccaatgaaacaagatgcctaagatgtgaaacagtaactgcaagggatgaaacgtttcttgatcttagtgttgacattgaacaaaatagttctatcacaagctgcctgaaaaatttctgttctacagagactttaaacgcagaggataaattcttctgtgacaaatgctgcagtttgcaagaagcacagaagagaatgaagatcaagaaggctcccacatac

SEQ ID NO: 51930 - DNA, 404 bp, Zea mays
  Clone ID: LIB3067-022-Q1-K1-G4
agcgcctgctgttgctgccactcctgaggtcgcagcgaccgaggaggaagcggcggcccctgctcccgaggccgccgtcgagtgagtccagccagcgccggacggcggccgatctagctcgctgcgtcagcctgtcacctggcgtgcgccgcgctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcgggtgggctgg

SEQ ID NO: 51931 - DNA, 420 bp, Zea mays
  unsure at all n locations
  Clone ID: LIB3067-022-Q1-K1-G5
cggacgcgtgggcgagcgcgtcagcacgctgcagaacgagccggtgggactgggtctggatgggagtgggggtccagagccgccggcgacgcaagcgcatgatgtgcctcagcatccgcaaccggagccggagccacgtctgcctcagcagcccgaggggccatatgtctatcagccgccgaagcagtcctcgtcgtcgtcgtcagggacgaagaggccagctggagcgtcgccgacgctcatcaggaggaaggagaaggcgaagaagctgctggcggtctgcttaaccctgtgctgcatcctgttctggcttctggtggtctgcatcgggctcgccatcctggtggtgtaccttctgtaccaccccaaggggccccggatccacgtgagcaccgncacgctcaacgccgggtacatcga

SEQ ID NO: 51932 - DNA, 407 bp, Zea mays
  Clone ID: LIB3067-022-Q1-K1-G6
gcgcccacgcgtacgcccacgcgtccgcccacgcgtccggaaaacgccaccagacgcagatcgaattaagctctccgagtctccggttccctcctctcggcggcggctcaggtccctctccatcttcggcgcggcgctcggcgtctgacctcaacacgcaagaaagcaaatggcatgcggcagggctgcgcatgccaccctcaagggcccgagtgtggcgaaggagatcttcattggactgaccctgggtctgatcgcagcaggcatgtggaagatgcaccactggaacgagcagaagaagactaggtccttctatgacatgcttgacaagggccagatcagcgttgtcgtctaagagtaaagagttcttcccagatattttcaaagaactctctcgagagcatgac

SEQ ID NO: 51933 - DNA, 397 bp, Zea mays
  unsure at all n locations
  Clone ID: LIB3067-022-Q1-K1-G7
cggacgcgtgggctcccctgataaggtccaagccgtgcttctgctgcttggaggcagggagctgagtagcctgagcggagcgtcgtcctctgcaccttatagtaagaggttgaactttccacatcgggtggcatcactgatgagatttagggaaaagcggaaggagcggaactttgataagaagatccggtacaatgtccggaaggaagttgcacttaggatgcagcgtaatagaggtcagtttacatcttcaaaaccaaagcctgatgaaatagcagcatcagaaatggcagctgcagatggctctctgaattgggcactagttgaaggccgacctncatctgctgctgaatgtcatcactgtggtattaatgcaacagctacaccaatgatgcgt

SEQ ID NO: 51934 - DNA, 382 bp, Zea mays
  Clone ID: LIB3067-022-Q1-K1-G8
cccacgcgtccgcccacgcgtccgagcagaccggcaaggtccgcctagtcatgcgccaggctaaaacgcttaagatctgcgcgaaccacctcgtggccttcaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgagggcaaggaaggtgaagatggtggttccacggctggattgctggcgaagctcactgtgagcgagggcgaatctgatggaagtggcaagtctgagtccactgattc

SEQ ID NO: 51935 - DNA, 336 bp, Zea mays
  Clone ID: LIB3067-022-Q1-K1-H1
accacgcgtccgaccaaattaaagatacagttcttcggaatgtgtgatgatctatactggacagatatatatatatatatatatatatatagtatttgtttaatatataactctgctagtatatatagtatttgttctgaattcaaaaagaaaaaaaaaaaaaagcaaaaagagcaaaacaaaaataaaaaaaaacagaacagggggccgctataaaggagcccatattacgcaacccgttataggaaagcatacatcttctaaacgagaccctgaagaaaaatcaacgggccgacttttaccaagcacagggctgggaaaaaccgggcctaaccc

SEQ ID NO: 51936 - DNA, 428 bp, Zea mays
  Clone ID: LIB3067-022-Q1-K1-H12
cccacgcgtccgcccacgcgtccgcaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaactagtacgaacagtattgcctcaatctttgcgtggacaagaggacttgcacacagggcaaagc

SEQ ID NO: 51937 - DNA, 226 bp, Zea mays
  Clone ID: LIB3067-022-Q1-K1-H3
cccacgcgtccgcccacgcgtccgcggacgcgtgggctgcaggacgtgcagctgcgctgcatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccagggcc

SEQ ID NO: 51938 - DNA, 394 bp, Zea mays
  Clone ID: LIB3067-022-Q1-K1-H5
gtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgtccgccgactgctagcagtgtgctag

SEQ ID NO: 51939 - DNA, 388 bp, Zea mays
  Clone ID: LIB3067-022-Q1-K1-H6
ccttgaccctccatttccccattacccttagaactgaggcaattaaggatgaccggccggagtacgcgtccatccaagcggtgctgttcggaccgcacctcctcgccggcctgacacacggcaagctgccagtgacagacagcagccactccaacgacggcctgaccgcaggcatctgggaagtggacgccacaggcgccgcctccgtcgccggctgggtcaccccgctccactccgagacgctcaactcacagctcgtcaccctgaaacagagcattggcgggcgcaccctcgtcttgtcggtgtccatcgctgacgcgaagctggagatgcagcagcagcccgcccccgggaccgacgcgtgcgtgcacgccacgttccgcgccta

SEQ ID NO: 51940 - DNA, 365 bp, Zea mays
  Clone ID: LIB3067-022-Q1-K1-H7
gccgccgccgctgcagtgtccatagcctccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctggctactgcactggccttctgttggctc

SEQ ID NO: 51941 - DNA, 411 bp, Zea mays
  Clone ID: LIB3067-022-Q1-K1-G12
cccacgcgtccgcgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagct

SEQ ID NO: 51942 - DNA, 448 bp, Zea mays
  Clone ID: LIB3067-033-Q1-K1-D7
cggactcgtgggcggactcgtgggcggactcgtggggtagatcgcagcggatcagaggggtggatggaaagagctttagcaacgaacagcaagcccaacaaaagaacccagacgcagtgacaaacagtgttccgagccaaggccaggagcccttgaacacgtttccagattcagactatggaaacacgaacaccggtccgttgaatggccatgcagcagctcatgtgaacatggaagctgccatcttcacggaggacgtcatacgggctggcgggttcggtgcgaaggacgacattggcagccttcttccgactgcaattgattccaccgattttgaggcctcgctgcgggatgcccgtggtttcgagggcgagaaagcggcgccgtcgcatcctggactagggtggaagggggagaaagctgatggtggaaccaaactggcagatgt

SEQ ID NO: 51943 - DNA, 448 bp, Zea mays
  Clone ID: LIB3067-033-Q1-K1-D8
atccagtaactgggagtgccgtaatgctgccaggagttgaagacgattgcgtctgggttgcacgtctggtcagatgctgtgaccctgacaatctccacaagtgggctccaggccagtatcaacgctctgggatcaaccgccactgttctcacatcagcagatgtgatggatgaaaactccttcagcaacccaaccaaggttgtgccggtaaagagcgatctgagcaatgctgcagagcagatgcaggtcacgctggctcctcgctccttcagctcgttcgatctcgccctggctcagtccaagcttgtagcggagatgtgagctaggctggtacactagtatacaatacaacgtgtgaagtgtggtacacatataccagcaaccacaggggttgccaagctgttgttagcatcttgaacacatggctttgtatggtgtataatgacat

SEQ ID NO: 51944 - DNA, 259 bp, Zea mays
  Clone ID: LIB3067-033-Q1-K1-E10
cccactcttcctgtccaaacatattagatgctgctcttaaccaacctatccagcggagggttttcttctatattacagatattcaatctatactatagactctacaataatgaccaatacactaagcagacagaatttaaaaatagaattctcagatatacaactgtgcctcctattccatgaacccccatatctcagcaactcattctatagtcttaccactgtaaagacaactattcataacaccaatttcatatat

SEQ ID NO: 51945 - DNA, 427 bp, Zea mays
  Clone ID: LIB3067-033-Q1-K1-E11
gacccacgcgtccgcggacgcgtgggcggacgcgtgggcgcgagacgcgagtcgtgctgctctctgtcttcgctcggcgatctatcaaggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccct

SEQ ID NO: 51946 - DNA, 353 bp, Zea mays
  Clone ID: LIB3067-033-Q1-K1-E12
ggccgcttcgccacggccgagcccgttcccgccgagacaggagtggtggatctggggtacaacaagcagccccacacggcggagatggagaaagagggccctgtcgtcgtcgagggcgctgtagatcctgagcccgagcccgagccccaacacgcggcgcacatggagcggagcaggtcggaggcggatgcagaggcgaagctgccgttgctcccgtcgcgtctgcacaagtccgccagcgacaagtcggcgttcgcgcacttcggcgcctaggaggtggaggagaccgtgcgcgcggtggatgcgctgcgccccgcgacgacgagggagaaccgcggtcggcggctccccgt

SEQ ID NO: 51947 - DNA, 374 bp, Zea mays
  Clone ID: LIB3067-033-Q1-K1-E2
aaaagatgatggaagtgacagtattgccgtgcagcttgctgacgaaacacactggaatgatctggtaattattattgcagtggtcagttcaaagcataaggaaaccagtagcaccagtgggatgcgagatagtgttgaaacaagtcctgtcttgcagtacagggcccatacagtggtgccaggtcaggtgttgaaaatggaagaagctatcaagaaccgtgactttgaatcatttgccaaattaacttgtgcagatagcaaccagttttatgctgtatgcttagacacgagctctcgcatgttctatatgaatgacacgtcacaccggataattagccttgtggaaaaatggaaccactcagaaggaaccccac

SEQ ID NO: 51948 - DNA, 413 bp, Zea mays
  Clone ID: LIB3067-033-Q1-K1-E4
gggaaaagagggatcgatcgacaatgtccggccaccgtgcaccttaggatccatgttcgtgagagaggtggttcagacttcagagccgtcggtcgctcctgattcctaattacccagctctctatcgtctgttacccgtcgatccctccccggatcaactggctcggtagctagttggggctagctagctatataaggaatcaccatgaatccaccacacgtgcactagatacagagacatgacgacgagtacacgatcgaggtttcaggccaccgcgttccactccagcagcggccacgtatcccacaggtccggagtggcgcagacgaaggggtcgtgcatgccatcgtactcgtacgcgacgtggtcgtagtactcgccggtcgccgtcgagtcctcggaggcgtctact

SEQ ID NO: 51949 - DNA, 445 bp, Zea mays
  Clone ID: LIB3067-033-Q1-K1-E6
ctcagatagtctccattcatacaggcgaaatgaaagaatccgactggttccagatgagcgtccccaaggcagaagtgctgatcctcaacttcgcgtcgagcctgtactacctgccgccgttcatcgcgactatgcagaacctgaaggccctggtgctgatcaactactgcagcggcagcgcggccctggacaacctctccgccttcaccacgctgagcgggctgaggagcctgtggctggagaagatcatgctgccgccgctgcccaagacgacgatcccgctgaggaacctgcacatgatctcgctggtcctctgcgagctgaacagcagcctgagggggtcgacgatggacctgtcgacgacgttcccgcgcctgtccaacctgacgatcgaccactgcatagacctcaaggagctgccgtcgagcgtctgccagatcgggtc

SEQ ID NO: 51950 - DNA, 435 bp, Zea mays
  Clone ID: LIB3067-033-Q1-K1-E7
ctgactcgtgggttgccaggaagatgctatcttcacgacccacaatggttagctggggagatgttgacaaagttcctccatatgaatctatttgcaagcggctacgataagtacccctacacaatgacctctggttgactttgaaggatccttccgttgaaaactaaacaatcgcttgtatgaagtgccctagctcatgaactgcttttctttggggcattcaatttagtgagcttaggatttcagcagctacgttcagttgtaactgttccatagtagattaggaagactggcgatcatttttatgtccattttctgcgactatggatagcatgagtattctgctggcctgaattcccggtgtaaacggcttctgaaattttgaatcattgataaactaatagtgtttggtttgaggaaaaaaaaaaaataaag

SEQ ID NO: 51951 - DNA, 426 bp, Zea mays
  Clone ID: LIB3067-033-Q1-K1-F1
tcgcggcctcgagtttaactgcaacagaaatgggctccagtatccaagttgaatcctctacggatgagttagaggccatacaacctcctgacgatgacatgggcatctcatcatctgcgtgggtagaagtagagcgtcaagaactagaagtcactgtttcgagtgaaaatgtagttgttgaggatgtaacttctccaggaattgcaccattgccgtcatcaagcccaagagtgcgtcattcgttgtcacaaatgctgcaagcagatagcaatgaaccagaaattattgagtggggaaatgctgaaaacccacccgcaatagtttttcataaggattctccaaaaggattcaagaggcttctaaagtttgctcgaaaaaacatgggagacaacaatgctaacggctgggcaagcccctcggtagttt

SEQ ID NO: 51952 - DNA, 380 bp, Zea mays
  Clone ID: LIB3067-033-Q1-K1-F10
caccacgcgtccgcccactcgtcctggcttcgctgcgcgggatcagggccaatctgacggagcacctggagaaggtgatcagcggtctgctgctgggctcggcggtggcgctggggtggaagtcgtccgagcagcagcgcgagatccagagcctgttggccgagaagagctctctccgagccaccaacgcctctatgtccgccgccatgtgggcctggcggcaggagctcttcgccctcgccgccgagccctcctacaccatttacgcgtcccggctccgccacatctactgcgaggaggagcccgcgccgatcgcgcccgcgcccgcgccgtcaggagcaaatgatgggaaggaagaggaaccgatctgcatagcctga

SEQ ID NO: 51953 - DNA, 318 bp, Zea mays
  Clone ID: LIB3067-033-Q1-K1-F12
gcgcgcatacacacacagacagatacacagtgagtgagagagaccgcacggcctgtcaggggtccctttggccaatcgcacgacacgagcatggctcaacgcgacaagaaggatgagcccacggagctgcgggcgccggatatcgcgctctgcgccaacaactgcggcttcccggtcaacccggccacgcagaacctgtgccagagctgattctcagcgtcgaggtcgtagtagtcgtcttagcagccgtgcactaactcctctgcctgagattacgagccggccgacgcggtgcctcagccgaggccggcgctaatg

SEQ ID NO: 51954 - DNA, 354 bp, Zea mays
  Clone ID: LIB3067-033-Q1-K1-F2
tcgctgactcgtgtctaactagctcacaaacgttcttttgtatccaagttgaatcctgtacgggtgggtttgttgccatacaactctactgacgatgacatgggcatctcatcatctgcgtgggtagaagtagagcgtcaagaactagaagtcactgtttcgagtgaaaatgtagttgttgaggatgtaacttctccaggaattgcaccattgccgtcatcaagcccaagagtgcgtcattcgttgtcacaaatgctgcaagcagatagcaatgaaccagaaattattgagtggggaaatgctgaaaacccacccgcaataagttttcataaagattctccaaaaggattcaag

SEQ ID NO: 51955 - DNA, 429 bp, Zea mays
  Clone ID: LIB3067-033-Q1-K1-F3
cggactcgtgggctgcgatctcttctgtgcagtataaataatgcagcatgaggactgaagatctgcattgattggtgtaagaaaaagaagttttctagagattcacatagttgactagccgatgagaggcggagattgttggcgagatgtacaagcagaaatatcatcagcaaacaaaaggtactacagtaggtaaattacctactgtagtaccaggtaaaggacaagagacgattccctggtaagagatccacttgtcccgttccacccttactttccctctctctgctgctcgcaaatatccatctttgaaaccatatatcatcctgcaacatgaatccatccttgagtcctaaaccggtgttcctatcatttgctactgcaaagggcttctctttgcatgcttcagtcacatgaatgatgagctcg

SEQ ID NO: 51956 - DNA, 446 bp, Zea mays
  Clone ID: LIB3067-033-Q1-K1-D6
gctgggggatggacactcacgtcggcaaattaatcgactcggtgggctccatcttgcgcggcagcgacgtcctgccctggtgcgatcccgacatcatcgccggtttcgagagtgaggttgctgaggctgcaaatgaagaacagaaaaccgagagcctgatgaggctctcctgggcgcttgttcactctagacagcctgaagacgtcaaccggggcatcggaatgcttgaagcttcattggacaggtctagcagcccagaggaaacaagggagaagctctacttgttagctgttggtcgttacagaactggggattatacaagaagccggcagcttttagaaagatgcttagagatccaacatgactggagacaagccataactttgcaaaggctcgttgaagaaaaaaccaaaagagatggtatgattggcatggctatcattaca

SEQ ID NO: 51957 - DNA, 70 bp, Zea mays
  Clone ID: LIB3067-033-Q1-K1-B9
tcttgggaaaaaaaaaaattaattaaaaaaaaaaaaaaaaaaaaaaaaaagaagaagaacatttataaaa

SEQ ID NO: 51958 - DNA, 367 bp, Zea mays
  Clone ID: LIB3067-033-Q1-K1-C1
cccacgcgtccgctcgccacgtttgaagggatgtacaaggaggaggtctcgtggttcgagcagcgtctccagcagctcgagctgccaatgcagcttgatttgccgccgcagccaccaccaccgcagctcccagtttctgtgccagtgcaagcgcccctgaggatgtggggtgggaggaggcccaagcccaaggctagggagccaaacaagagggagatggatgaggaggagaagcagaagctgacggtggagattgagaacctgcctgaggacaaagtgctgaatgtgctgcaaattgtgcacaagaggaacagagatccagcattgtcggcagaggttgtggagctagatttcgacgagctggata

SEQ ID NO: 51959 - DNA, 406 bp, Zea mays
  Clone ID: LIB3067-033-Q1-K1-C10
gcagaggagagagatctagagcgagggatggagggaaatgggccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccatcatctcgaggaggaatatcaatttccagctcatcttgtcagctctaacattttctggtgtattccttgctgagagattaaatacgttcctggcgcaaaactggaagagcttctctacccaaaac

SEQ ID NO: 51960 - DNA, 386 bp, Zea mays
  Clone ID: LIB3067-033-Q1-K1-C11
acactgtcaaatccttgctgtggcaactgctcaacggcctcaactatcttcacagtaactggattatacatcgagatctaaagccttccaacatactggtcatgggagaaggagatgaacatggaattataaagatagccgattttggacttgctaggatatatcaagctccactgaaaccattatgtgataatggggttgttgtaactatctggtatcgtgctcctgagctgttacttggggggaaacactacaccagtgctgtcgatatgtgggcagttggttgcatttttgctgaactgcttacactgaaacctctattccaaggtgtggaagcaaaaaatccttcgaacccattccagcttgatcaactcgacaagattttt

SEQ ID NO: 51961 - DNA, 426 bp, Zea mays
  unsure at all n locations
  Clone ID: LIB3067-033-Q1-K1-C12
cccacgcgtccggccaagacaaacctgaacgtggagcaagtgttcttctccatcgcacgtgacatcaagcagaggcttgcagagactgattcaaagccagaggacaaggcaatcaaaattaacaagccagaccagggttccgaggcaccagctgcccagcgatctgcatgctgcggttcataagcagacgcacgatagccataatcattggttatttgacactatttatttcctgcttggcttttataggaagaatttgaggaagccacttatgatatactgatgatgtggttgtactcttgtttgcttccactcttcgaagcaaacacctcttgctgttgacgtagctattgcactctggacatccgttggaacaacctgtctnctncctacagactacagtgtgtaatggacgaattccatgtc

SEQ ID NO: 51962 - DNA, 415 bp, Zea mays
  Clone ID: LIB3067-033-Q1-K1-C2
cggacgcgtccgcccactcgttcgcccactcgttcgccactcgcggtcgcggtagccgggggcggctgaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggacctgtgctggtcaagcaggacctcgcggaggccaaggccaacgtcaagaagcgcatcgagtacatcttcgcagagctgaagcggatggatcgggcgctcaaagacttggaggaaaag

SEQ ID NO: 51963 - DNA, 394 bp, Zea mays
  Clone ID: LIB3067-033-Q1-K1-C3
tcgcgcttggttcttccctgccggaagatacctttcgttcggtgtcgccaactcgccattcgtgggaggtcttggtcgggaccggtgctgatggaggagaggtacgaggcgctgaaggagctgggggccggcaacttcggcgtggcgaggctggtcagggacaagcggaccaaggagctggtagccgtcaagtacatcgagaggggcaagaagattgatgagaacttgcagtgggagatcatcaatcaccagtcgctccggcaccctaacatcgtacggttcaaggaggtttgtctaacacccacacatcttgctattgtcatggaatatgctgctggtggagagctatttgagaaaatctgcttaacatggcgattcagtgaagatgagttca

SEQ ID NO: 51964 - DNA, 436 bp, Zea mays
  Clone ID: LIB3067-033-Q1-K1-C4
cccactcgttcgcggacgcgtgggctccttaagtaacaaatcccttgaggggctgcaggcgaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaagcgtttgcggcctatggcaagctccgccttgagcggatgaacaagaagcaccttggtgcccgccagaagaaggcagctgatgcagaaaaggaagacaagaagtgaagccaccaaactttgtagccctgtttgttctgttcagtcatagctagatgctacttccattaagtgcttgtttcaagtttt

SEQ ID NO: 51965 - DNA, 301 bp, Zea mays
  Clone ID: LIB3067-033-Q1-K1-C6
ttcccggtcgacccactctcctcggactcttggtcggacacgtggaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaattaaaaacaaaaatccctagaaaaaacaaaaacaattcaccaattaaacacaatagcaacccatttaaataattaaaacattccaaaaaaataaaagttcataacataacaaaattcaa

SEQ ID NO: 51966 - DNA, 142 bp, Zea mays
  Clone ID: LIB3067-033-Q1-K1-C7
aaacccgacccgacccactcgtccgcccacacgtccgcctacaccacaatcacttctccaaaataacaaatctacatatcggaagatttttttacattacccacaacccttccctacacaaaccaaacaaaaaataaaccac

SEQ ID NO: 51967 - DNA, 450 bp, Zea mays
  Clone ID: LIB3067-033-Q1-K1-D1
tcgtctcggctagtttcataatgtgtcccatctcatattgagctatatatctcgctcacgatgtctgttagacttgacgagcttattgatgcttccttgtactgacaagagtgtcgctgtagcaggggcaacgcagaatctattgttcaagatattgtaaacatggttcgatcttatgttgacaagccaaattgcatcatcttggctatctacccagcttaccaagatatatcaacgtcagatgctatcaagcttgccagggatgtttatccttcatgtgacaggacatttggagtcttaacaaagcttgatttgatggacaagggtaccaatgctgttgatgtacttgaagggagacaatatcgcttacaacacccctgggttggaattgttaatcgctcacaagctgatatcaacaagaatgttgatatgctttcagcaagacgcaaa

SEQ ID NO: 51968 - DNA, 409 bp, Zea mays
  Clone ID: LIB3067-033-Q1-K1-D10
agtcgatctcactgtatacattgtgtaatcgtcaaaggagaaaacttgatgaatggagaatgtacaaagagcaaattatggctaattgaccttgctggaagtgaacgggtagcaaagacagatgcacaaggagaaagattgaaagaagcacagaacataaacaaatcactttctgcacttggtgatgttatatctgctcttgcaacgaagacctcgcacataccctttaggaattcgaagctaacgcacttgctccaagactcactaagtggagattccaaaaccttgatgttcgttcaaatcagtcctaatgagaacgacgtgggtgaaactctttgttcgttgaacttcgcgagcagagtgcgaggcatagagcttggacaagctaaaaagcaagtcgatattggag

SEQ ID NO: 51969 - DNA, 405 bp, Zea mays
  Clone ID: LIB3067-033-Q1-K1-D11
cccacgcgtccgcccacgcgtccgcccactcgtccggttctagatcgcgggcgggcgcgcgctggtggagatcgcgtgcgcgcgcacgcccgcgcagctctttgcggtcaagcaggcgtaccatgaccggtttaagcgatcgctcgaggaggacgttgccgcgcatgtcaccggcgacttgcgaaagcttttagtgcctctggttagtgcgtaccgctatgatggcccagaggtgaacacatctttggctcattctgaagccaaaatacttcatgagaagatccataagaaggcttacagtgatgaggagatcattagaattctgaccacacggagcaaagctcagctacttgcagcattcaatagctactaggatcagttcactcatgcaatcaacatggatct

SEQ ID NO: 51970 - DNA, 377 bp, Zea mays
  Clone ID: LIB3067-033-Q1-K1-D12
aaaggaggtgttgtagctcttgtggatgggcttaagggtttcgttccattttcgcaagtgtcatcgaaaacaaccgccgaagagctgcttgagaaagaattgcctctgaagtttgtagaggtcgatgaggaacaaggcaggcttgtcctcagtaatcgcaaggcaatggcagatagtcaggcccagctaggtattggatcagttgtcttgggaactgttgagagcctaaaaccttatggtgccttcattgacatcggcggaatcaacggccttctccatgtgagccagattagtcatgaccgtgttgcagatatctcaacagttctgcaaccaggagataccctcaaggttatgatactgagccatgaccgtgaaag

SEQ ID NO: 51971 - DNA, 320 bp, Zea mays
  Clone ID: LIB3067-033-Q1-K1-D2
ttcccggtcgaccactcgtctcggctacgcatcgtgacacgagaagaatgagtatatgtacaaaacatgttgataacttaacggatgggtgagcttactggactgacaaaaagtaactgaaaagagggcaagctgaatctattgatcaagatattgaaaacatggttcgatcttatgttgacaagctaaatagcatcatctcggctatttacccatctaaccaagatatagcaacgacagatgctatcaagcttgccagggatgttgatccttcatgtgacaggacatttggagttttaacaaatcttgatctgatggac

SEQ ID NO: 51972 - DNA, 373 bp, Zea mays
  Clone ID: LIB3067-033-Q1-K1-D3
cccacgcgtccgatggcgaccattatctgtgacacatgcggtgggagggggcacatgtgttatgagtgcccttcggcaagaatattcgggctccgcaggctctgaagagcttttcgccaagagctccgctttgttctgatggctgagaattcgccaggatgtttcatttgtttctgacagtattggaacagttttccttctgccgttgtagttgaggaatgattctgtaggatgtgttgcgggtgaaaacttccttttttccccccttttaatcaggatagccctttgtgggctcaaacattgctgtaacggctcgtgtgaaaattgccaggtcatggtttaactaaaaaaaaaaaataattatttataatat

SEQ ID NO: 51973 - DNA, 348 bp, Zea mays
  Clone ID: LIB3067-033-Q1-K1-B8
ggatacccgggccgacccactcgtccgcccggacgtccgagcattttaacttcatttataatcttcggcatttaaccttatggagggaacatttatggagcttgggagcagtatcttggactggaacatccggacacggctcctaggaaggcacacacggctaatcagaaccggcattcatttgagagacctgtaaaaatttataactaggcatgttagaaatcgagcgatgagctgccgctcaataccaagccagggctgaagtcgctggcttgaaatagagagcatgttgctcaggtttttcgatggagctgtggaactagttcagaggagactgatctggcgact

SEQ ID NO: 51974 - DNA, 211 bp, Zea mays
  Clone ID: LIB3067-033-Q1-K1-A3
tcgactaggcataaagattccactcgctttgttcgtcacttgctgttaaaggttttatgcttgtctgtttctgtttggcccatctcccccatcttttttatagatctgctagggcagataaagatcgtggggtttgtacttgttctcctttgatagctggagtctcgatttcgagtgacttgtgcgggaataacatatatactcaattccc

SEQ ID NO: 51975 - DNA, 444 bp, Zea mays
  Clone ID: LIB3067-033-Q1-K1-A4
atcgtatttcatgcgtcctgagtatatttttaagcaactgtatctgattgtccccattaaaaggtggtattccagtaacaagttgatatagaatgacaccaacactccacagatctgcctttgcatcatacttctgaccttgcatgacttctggagccatgtaaagtggtgaaccacaaagtgtttcggctagggcaaagggttgcaaaaattttgcaaatccaaagtcggcaatcttcaacagagtattttcattattttcaacaagaagaatgttctgaggttttaggtctcggtgaaccacgttattatcgcgaagcattttcagaccagatgctaactgacggatgaagtgcttagcaaccttttcagaaactcttttatgacgttgaaggtatgcatgtaagtcaccacctcgacaatactccagtatgagatatatac

SEQ ID NO: 51976 - DNA, 444 bp, Zea mays
  Clone ID: LIB3067-033-Q1-K1-A5
cggacgcgtgggtcctctcaatacccctctctccctcttgtgggtagcgttgtgcgtcgtttcctcagcagcaaccggagagcggctgctcgcctgctcctcctcctagggaaaggacagcggcggcggcggcggcggcgagaagttgggcctgaagcccggacgctttctcccgagataccgcaatactgctagagcactgtcactaatgtttgcttatgacaatggagtcacctacaactgccgctggtggtgaactggagagctacttctccttgggtttgacagtatcccactcacagaaagataatgctgaatttccaaaggttctgttgcttctctcagcgtatcttgacaagacagttcagcagaatgaagagttactagactccagtaaaataaaggagtcgaccactatctttcatggtcagagggtgcctgaac

SEQ ID NO: 51977 - DNA, 441 bp, Zea mays
  Clone ID: LIB3067-033-Q1-K1-A6
ctcattggcatgctaatgaacacttgcatatcatctgagtgtggtattatgcatcctcacgggtcaggacagattggtgtgcttccataacatgattagtaagttttagtttttcttccttcttacttcagagatcttctaaagattggaactggagcagcaaaccatgtagaaagaagaaaagttaaccgactacatgttgaagtagtcatagtgattgcacatattgcatctgattcagattgttgtatggcaaattgctcgtccactcatgtttgaaccacgaaggttttagttatacattttcatttcctaaatagttgtttctcctaggccctagtgcggtacattccccatgccaagacaatcttattttaatttgacaatggaaatgacttgttcgtttgacttataacttactaacagttcaataactctcgt

SEQ ID NO: 51978 - DNA, 426 bp, Zea mays
  Clone ID: LIB3067-033-Q1-K1-A7
cccactcgtccgcccacgcgtccgggggcgtgcaaactactttgccaacctttcaaagggacttctgccaaagattggccgccggctgcccaagggccagcaagcaaacagcttgcttgacttgatgactataagggctttccatagcaaggtactgcgttgctttggccttggaacggcagtgggcttccgcatcaggaaaggggttctaaccgatatccctgcaattctttgcttcgttgctcgcaaagttcacaagaagtggcttgatccggcccattgccttcctgccattcttgcgggtccaggaggtatttggtgtgatgttgatgttgttgagttttcgtactacggtgctccagctcaaactccaaaagtgcaaatattcacagagcttgtggataagttgtgtggcaatgatgaatg

SEQ ID NO: 51979 - DNA, 447 bp, Zea mays
  Clone ID: LIB3067-033-Q1-K1-A9
ctggcataagctggttgctaccaaggataaccaccagtgcatcctgataaacaccccatcctgcattcatgggtggccatgcgcttgcgaaatcggcagctctgctccgggaagttaagaacaagcaaaggactaaccttgtgaagcgactggagcctacagaagcgaggtctccacaaacatcattgtgggtaccacacccaaggacagggatctactaccccaagggctttgaatgggtcatggaggatgtccccagcagcgcagcttcattccagcagtcatactggttcaagactggggaggcagagccagcaagctctattacatcaaagaatgattctacttgctttgaccatccatttgcttgatatatgagaggctttgcactggaataaaaaccattgaaagacacagctgtgtgctttcaggaagaaaagagataca

SEQ ID NO: 51980 - DNA, 410 bp, Zea mays
  Clone ID: LIB3067-033-Q1-K1-B10
ggggctgggaggccggggcgtggtgggtgacaggtggtcgcaacgcatcctctggatttgcgccctgggcagcgccgtgagcctctacttcgtggcggtggagaggcaggctcagaatcgtgcgcgggcggtggcggagggcctcaaggcgctcgacggcgccggggatgacgtgtgacagcggtggacgctgccgtgcagagggcctcctttggttcacatgttcacagaacctcatagcgttgcaataatgtactaaacatctgtgctcagtctttgtagaattaaatgtggatcaatgtgagtgttctcctatttcacataattcatctgagcctttgttgctgcacagaaatgttgatccgtgccactacgtgagtgttttcttatttcacacaatttgtccattt

SEQ ID NO: 51981 - DNA, 430 bp, Zea mays
  Clone ID: LIB3067-033-Q1-K1-B11
cccactcgtccggccggccctgccttctttttttcccccgcgaagcagggcgaggcaggcagcgtgtataaactgagcgaacgtgagcggtcttcgccttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagact

SEQ ID NO: 51982 - DNA, 404 bp, Zea mays
  Clone ID: LIB3067-033-Q1-K1-B12
aacactcatcgcaacactcgtctttcccttccctccctcggaagcagcaaagctagagacgatgactctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgacctacggcgcctaggtgtcagctgtggccgacaagggccggctcaagaagatcacgggcgtcaaagccaatgagatgctgctgtgggtcaccctgcacgagatctgcgtcgacg

SEQ ID NO: 51983 - DNA, 104 bp, Zea mays
  Clone ID: LIB3067-033-Q1-K1-B2
acagggctctcaagataatttccggtctttagaactttgacaggagcagtgttgcatctgtaggcattttttcagataacggaggtgcatcccatgaacccata

SEQ ID NO: 51984 - DNA, 393 bp, Zea mays
  unsure at all n locations
  Clone ID: LIB3067-033-Q1-K1-B3
ttcccgtcgacccaccgtcgcggactcgtgggtctgttggggattgtctctgggaactgctacaggagaagagccgatggtatgtacattatggtgttataataggtggcattggagcaacactctacggccgcagtgcccgactcgcgaccccagtggaggtcactgatggacaatgctggtcaacagaaccatctgagcggccaaacttacagaggttgnattaggctgcgctcatgcggcatctagaaggtcaacaacactagggaccatctgcacgcataagttgtaccagggcagcagtcagtcaaacttgcatgttacatccatgggccgtcaattcacgccatccgccatatatgcctaggatctgttcataacccttcatttgtt

SEQ ID NO: 51985 - DNA, 418 bp, Zea mays
  unsure at all n locations
  Clone ID: LIB3067-033-Q1-K1-B4
cccactcgttcgcccacgcgtccgagtggtataacaaggaggaagtcattctcggaaaggggatgaaggactggatgcgcttcagtgttgcgttctggcacacgttccgtggtactggtgctgatccttttggtgcgcctacaaaggtttggccttgggaggacggcacaaattcgttggccatggctaagagaagaatgagagctcactttgagttcatggagaagctgggggttgacaaatggtgcttccatgatagggatattgcccctgatgggaaaactctcgaagaaacaaatgctaacttggatgagatagttgagctggcaaagcagctccaggttaggggtgagaccaatataaagccattgtggggtactgcacagctctttatgcatnctcgttacatgcacggagc

SEQ ID NO: 51986 - DNA, 242 bp, Zea mays
  Clone ID: LIB3067-033-Q1-K1-B6
tcccactcgtcctaatcccttcagatttgtctcaaaaatgtgaagatcttgaaccttgattgggggaataactttattgagaggagttcagatttgaaggtactttctgaattgcgctacttgaggaaccttaatttgcagggaaatcctgtttccaagaaagacagtcttgtcaaaaaggttaagaaatctgtgccaaccttgcgcatactgaacgcatagcccctagaggccatcttcaa

SEQ ID NO: 51987 - DNA, 445 bp, Zea mays
  unsure at all n locations
  Clone ID: LIB3067-033-Q1-K1-B7
cccacgcgtccgagcattttaacttcatcttttttcttcggcatttaaccttattaagagaaacatgtatggagcttgggagcagtatcttggactggaacatccggacacggctcctaggaaggcacacacggctaatcagaaccggcattcatttgagagacctgtaaaaatttataactaggcatgttagaaattgagcgatgagctgccgctcaataccaagccagggctgaagttgctggcttgaaatagagagcatgttgctcaggtttttcgatggagctgtggaactagttcagaggagactgatcgggcgacttgtcatctttcctgtttgttttgctgccccggatatataaagttgtacagagatgaccccaccagacaattgtctttagtagataagataactntttacagtcgagtggccgacgttttagtc

SEQ ID NO: 51988 - DNA, 423 bp, Zea mays
  Clone ID: LIB3067-033-Q1-K1-A12
cccagcgcggcgccaccggcgacccgttctcccctcccccggagagcgatggcgacggagctgacggcggcgcagctgcgcgcgtacgacggcaccgacccgtgcaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgcccgactcgccgtcgacgcctgaactcgtcagtctcggtctaaatttactctgtcctgcctcttgcggtgttcagtgctgtgc

SEQ ID NO: 51989 - DNA, 374 bp, Zea mays
  Clone ID: LIB3067-001-Q1-K1-F11
cccacgcgtccgaaaaaaaataaaaataaaaaaaaaaaaaaaaaaaaaaaaaaaaaaaggaagaaaaaaaaaaaacgcattctgaatcaaaaaaaaactttcatataattactcttgctaaaaaataaatttacctatgttttacttcgtaaattaattatatatgtgcattactaataacatgcgacccctattatcaagttcctattttattatcactattcttgcattgcattagttttcatattgatcgcacactcaagcttttcatgatctaggttcttaaattctactctcgctctatcatcgccttaacctcacatagatcataactttgtctttactcattcacctatctttaacacttctataat

SEQ ID NO: 51990 - DNA, 174 bp, Zea mays
  Clone ID: LIB3067-001-Q1-K1-F2
gcgtccacgcgtccgggaatgtatcacatgatggtacttctgggttgctgctgaagcagagagagccatagtcgggtcgggatttgtacccacctagctgaacctgaaccttgaagtttggtgcaattgcaatcgattttgtaccactcttttaaaaagggtatcggtcaatgc

SEQ ID NO: 51991 - DNA, 374 bp, Zea mays
  Clone ID: LIB3067-001-Q1-K1-F4
gcggtcctcgatccgatccgccgagtgcacaccacctttccccactccgatcgaatcgatggccgccgagggcgagaagaagatgataaccctcaaaagctccgatggcgaggagttcgaggtggtagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccggcgccgtcgccgccgtcgtctcgaaggccggttccgacgacgtgggtgccgtcttcggcaacagcaccgtcggctccggtgaggaccttaagaactgtgatgcggact

SEQ ID NO: 51992 - DNA, 365 bp, Zea mays
  Clone ID: LIB3067-001-Q1-K1-F5
aaaaaaaaaaaaaataaaaataaataaaataaataaaaaaaaaaaaattaaaaatgggggaaataaatattagatgaaaaaattaaataaataagaaaatttaaatgctaaaaaatggaggatatgtttataggttccacatttaccaaagtatgctttggaagtgtatttcattcatgttgcatgttaaattatacacaatgctatcttgtttaatacattctgacttgaaaatccttattgtgaattatttaattgtgcttactgcattttctattttagacagttaagcaagataagaatagtatttcgagaatatgacattatatgaatttagcatgatcattgcattaagggatcgctct

SEQ ID NO: 51993 - DNA, 288 bp, Zea mays
  Clone ID: LIB3067-001-Q1-K1-F6
gcggtactgttgttggtatcaagttcaaagatggcattgtcctgtgtgtcgagagagctgctaacctcaaagatgatgcttgaaggatcaaaccgaacgtatccattcaaggcaccgtgactctggcttggatgttgctggactatcagcagatggcatcaaattgctcaaggaccagatcacaagctgacattgattaatagggtaatggtgaacccatttctgtgaagtactaggcttatcgacttacacggtatactcatttttacactgctgtactggtggatc

SEQ ID NO: 51994 - DNA, 304 bp, Zea mays
  Clone ID: LIB3067-001-Q1-K1-F7
cttcaagctagctgatcagccaaaagggggcgaaagacggcgtttctgctcgccgtctttgttctctttccttggttttaaacgatttttctttctcttttcgttgcataaaaaaaaaaaaaaaaaaaaaaaaaaaaaaaaaaaaaaaaaaaaaaaaaaaaaaaaaaaaaaagaaaaaaaaaaaaaaaaaaacaaaaaaaaaaagaaataaaaaaaaaaaaaaaaaaaaaaaaaaaaaaaaaaaaacaaaaaaaaaaaaaaaaagcagctgagctctcaaaaatccgagtttaaaaacccttgg

SEQ ID NO: 51995 - DNA, 421 bp, Zea mays
  Clone ID: LIB3067-001-Q1-K1-F8
cgagaagggcggcggagggcacttcgtcatcgggaccaaggccagctacacctgctgcccgctgctctccggcgtggccgacctcgacgccgcgctctgcctatgcaccaccatcaaggccaaggcgctcagcgtcagcctcgtgctccccgtcgccatctcggtgctcgttaacgagtgcggcaagcacgtgcccttcagcttccagtgcccgtaatctatagtacaacaattaagcccatactgatcatcggctgcatatatgtgctagctactatgaagtatcaccaccactaatctatatccgcatgcatgcatcagtgcatgggtgattaagggtttatacgctgtcaaagttatacacgcatacttatatcacacatatatatagcttatattaagcatatataaggtagcttta

SEQ ID NO: 51996 - DNA, 432 bp, Zea mays
  Clone ID: LIB3067-001-Q1-K1-F9
aggaggtcttcattctcagctaagcctgaatatccagaaaatggctccaaaaattctgcagctctgccaagctacatggctgctacacaatcagcaaaggcgaaactgcggggaaatagctcaccaaaacttagctctgattcagcagagaaaaacggcttcactcgtcgtcactcccttccatcctctaacaacggtaagatggtttcacattctccacgtacacaaaggccagctaatgctggttgcaaggatggagcgaaaggtgacaaggctatgctgtcatcaagagatgcaagcgagagaccactgaaagctgagtggagacgttgacgcggcgaatcaaatccaaatcctgcatttgattagcgtgaccgtttgggtggatggatcgcccttgcagaatgctcggatttgttttgcttgggatgt

SEQ ID NO: 51997 - DNA, 221 bp, Zea mays
  Clone ID: LIB3067-001-Q1-K1-G1
tcgcttcaagctatctgatcaaccaatatgttaccaaagaccgcctttctgctcgccgtcggtttttaaaaacctttggtttaaacaatattactatctcttttcatagcataaaaaaaaaaaaaaattaaaaaaataaaacaaataaaataaaaaatttaaataaacacatcaatataataaataataaaaaacaaaataaaccttaaacataatcaaaa

SEQ ID NO: 51998 - DNA, 445 bp, Zea mays
  Clone ID: LIB3067-001-Q1-K1-G10
gcgtgcacccgcatcatcaccaacacgcacgtcggattcagctgcctttcagccttaacagggaggtctccgtcgactcagcgggaaactcgttactcaaacagtaggactttcaggggagacgcctggcgaaaagcatgcgtaagatcaacgtcgcatagcgactacaggacgtctagatcaaatgcctacccagacgggacactgagcttcagaatgaccacatgaacctcaggaccaagattgacgagggagagcaacagctgcagcaagtgactgtggcccagtctgtcgcagcagcagctgccatccacgtggagctgaatccgttcttggagatggataccaaatgcttcttccctggcggtcccttcgcgacactggacatgaagtgcttcttccccggcagcttgcagatgctggaggcacagtagcgccagatgct

SEQ ID NO: 51999 - DNA, 261 bp, Zea mays
  Clone ID: LIB3067-001-Q1-K1-G11
ctcattcgatcggatgaactaatctattctgatggcatcatctaaacgtccttcgctgctctctgatgtgcagtcggggtgccattagcctttagataagactcactggacttcgttaaaggctactgatatctttaaataattctgtttttctctcaggtttttaaactttgaaacacaaatatgcacttatactgcacctactatataaacacacccatatcttaactaggtcactattactagaactgttgaaactgg

SEQ ID NO: 52000 - DNA, 374 bp, Zea mays
  unsure at all n locations
  Clone ID: LIB3067-001-Q1-K1-G2
tcgcatgacagagggtctgcattcccagttgcaaaaagaaatgcaaatgttgacacaagagtttgacgggtcaacaaagaagctcagtgagttggaaaaaaataagttagacctggagagcatattgaaagaactgaataacaccattttaggtttgaactcggagaaggatgcaacactccttcagcaacagcagtctttacagaaagtatctgatttggagttagaactctcaaagatgcagttggaaatggagggtccttgaagacanctgtttgtgagcttgaagaaggatggttgagncgccatacagaaacanaaccagtcctttgaggtgcttaatacagaaacttggtgaggagataaatacattc

SEQ ID NO: 52001 - DNA, 418 bp, Zea mays
  Clone ID: LIB3067-001-Q1-K1-G3
cgagtaaacttccagtcaggcattctccatatgtatcagggattttacatccgttgaaggtgtttcttgaaggggaccgtatacgctatctatcagaagatgataaaactaagttgtgtcgtgggtctacagataagattactgcaatttactatgacttggtctctgaagttgtcactgtggcaaggaaaaccgagtcttcgttgcaaagactgcgccaaggtgcacaaaggcgagtaggagctagtacagatgcctcagataacatcatatctgatacagacaagatctgtatgcagctatttcttgatattcaggagtacgcacgaaaccttcgtgcgataggaatagacgcgagagagattgattcctacagagctctatggcagtgtgttgccccaaaagacaaacatgagaa

SEQ ID NO: 52002 - DNA, 197 bp, Zea mays
  Clone ID: LIB3067-001-Q1-K1-G4
tcgtccacgcgttcgtacacacgtacgctcactctttctaaaaaaaattatataaatatagaggatgcatattaaataggacgcgtatacaaatatatatctaaatatgataataactaagtagtatcttatttatacacataagattactggagtgtattatgacttgaaatttgaagttaatactgtttcattga

SEQ ID NO: 52003 - DNA, 416 bp, Zea mays
  Clone ID: LIB3067-001-Q1-K1-G5
cccacgcgtccggacgtcacctcgtgttcaccagttaccaccggagtccggagtgaagcgcaggtcgggttcgcttttttcctcggcttcttctctctcgtccatcaacccagggggaaggagcgggagggagcgagccatggtagtcagcacgttcaatggacccgggattgggatcgggttcggtgtcggctgcgggttcggcgtcgggtgggggttcggaggaatgcctcttaacatgttcggcttgggtatcggtgggggttgtggatttggtcttggactaggatggggctttggaaatgcttttggttgtcagtatcgatcttcaagagttcagttccaaggcattgaatttcagaagaaggcgaattgagatgatgcaccaaaagttgtatcaccggagctttgctcaa

SEQ ID NO: 52004 - DNA, 423 bp, Zea mays
  Clone ID: LIB3067-001-Q1-K1-F10
cccacgcgtccgctgatgtatatagctttggcgtggttgtgatggagatcatcagtggaaggaagaacctggacacttgtcggtctgaaaagagctttcatcttattaccttgctagaagagaagttgaggagtgatcgcttggtagatttgattgatatgtgcattactagtgacagtcaggcacaggagcaagaagcaattcagatgatgaagctcgcaatgtggtgtttgcagattgattgcaaacgaaggcccaaaatgtccgaggtcgtaaaagtcttggaaggctctatcagtgtcgaaactgacatagatcataactttgtcgtgacaaatccaccaagctttagcgctcctagaattgtggtcatgtcagctccacctctagcttcagaagtgtcaggcccaaggtgaaattcct

SEQ ID NO: 52005 - DNA, 361 bp, Zea mays
  Clone ID: LIB3067-001-Q1-K1-G6
cccacgcgtccgcacagatctgcaatgatttacaggtggatcctcaggatattgttatgcttgtcatatcgtggcatatgaaagcttccactatgtgtgaattcactcgccaggagttcattggtggactgcagtcaataagagtggattcaatagagaagcttcaggccgaagtaccctcaatggcagctgacctaaaggatgaccagaagttccatgaaatatacaactttgcatttgcctgggcaagggagaagggccagaaatctctcgcattggagactgctattggcatgtggcagttgctatttgctgaaaggagctggcctctcattgactactggtgccaatttctacaggt

SEQ ID NO: 52006 - DNA, 264 bp, Zea mays
  Clone ID: LIB3067-001-Q1-K1-G7
caaaaccaatcgcggagaggcaatcaccacgtacgtatacacacgggcacgtaactagctagctagctagcagtcgtagaatgacgatgaggggtctctctgttgcggtcgctctggtcgtggtggtggccgcggcctgccttgccgcgccgcggggcgcggacggcgcggacgagtgcggatgcgacgcctgcggacactgaggcgctgaggctggcgccgtgcgcgtcggcagctgaggaccccggctgctctccggccgga

SEQ ID NO: 52007 - DNA, 229 bp, Zea mays
  Clone ID: LIB3067-001-Q1-K1-D4
gcgtccacgcgtgcggccccggttcagcaatcgcagagcggcgatggacggcggcggggtggatacggccacgacggcggcctggatggagaagcaccggcagatgtacgagcgggccacccggcacccgttcaccgtctccatccgcgacggtaccgtcgacatgtctgccttcaagcgcttgctgagccaggactatctggttggaaagggatttggtgcattcata

SEQ ID NO: 52008 - DNA, 422 bp, Zea mays
  Clone ID: LIB3067-001-Q1-K1-D5
gaaccttccgggcctagggatctcgatggggcccgagcaggaggaggccgtgctggagaccatctgggacctccacgacaaggtcagcgacgcgatccacgccctctcccgcgcccacttcctgcgcgccgttcgccgccgctcctcggcctccgcccccggcctcgtggacgtcaagggcggcggtctgggtctcggcgcgcgcggcggagaccaggtcgtcgccctggcggccctggctgatgaggccaggagcctgcacgccatccgcgccgcgcttgatgacctctaggaccagttcgagtgtcttctcgccgcgcagacacagcatcaggaccgaacgagatttcgcgattgccagtcttgatcaaagtcgcatcatgctcgcgataaggctcaaagagcatcacgggagaaaccac

SEQ ID NO: 52009 - DNA, 260 bp, Zea mays
  Clone ID: LIB3067-001-Q1-K1-D6
cccacgcgtccgggcagaagcattgacaatctacccgtcaaatgagtcttctctgtggtttcatgatacaagagttcagttagacatgtcaatctgcaagtactgaggcaatgatatggttcaataaaaaaaaagaaaaaaaaaaaaagggctaaaaataaaaaaatccaaacttaaagaacatatataacaaataaataaacttataaataagatgacagttattttaaatagagttggccttgttttttaactattta

SEQ ID NO: 52010 - DNA, 321 bp, Zea mays
  Clone ID: LIB3067-001-Q1-K1-D7
cccacgcgtccgaacagcttctatgaaaaaaaaaaaaaaaaaaaaaaataaaaaagaggaaaaaaaaaaaaaaaagaaaaaaaaaaaaaaaaaaaaaaaaaaaacaaaaaaaaatgaaatactaaaataaaaaaaaaaaataaaaaaaaaaaggccttaatttttatagattcaaactttaattacacataaattaaaatttttaacattttattataatacatttaaataaaataaattgcccttgttttaaaaatttttattattgtaaaaacctttttattatcaaaattatttcatttgaataatatacattttttt

SEQ ID NO: 52011 - DNA, 417 bp, Zea mays
  Clone ID: LIB3067-001-Q1-K1-D8
gtcgagttggatggcaaacggattaagttgcagatctgggacactgcaggccaagagcgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcgaaggggcaagctctcgctgacgaatacgggataaagttttttgaaacgagtgcaaaaacaaacctgaatgtcgagcaggttttcttttccatagcaagggacatcaaacagagactttcggaaaccgattccaagcctgaggatcgaacttttcagatc

SEQ ID NO: 52012 - DNA, 332 bp, Zea mays
  Clone ID: LIB3067-001-Q1-K1-D9
gccaggtatgtgaggttcgactgggaacaattaccgaatgtcactgagactaccggggacggccacgacgaactgagcttacgacacgatccttaagaacctctacatcatctaccacaagcgactaatgggtcgactacaccttcaacaactaacgtgacgttgtcacattgaagatcatactgtatcgtcagacacgaactgtccgcggcttcgacttcatcaccttattgaccaacgacgacatacgcaatgccatcgaaggcatgaacggcatagagcttgacgggcgtatcataaacgctaaccaggtccaattcctcagagggcgt

SEQ ID NO: 52013 - DNA, 69 bp, Zea mays
  Clone ID: LIB3067-001-Q1-K1-E1
tcgaaaaaaaaaacatacaaacaaataatatttatttaaaaaaaaaaaaaaaaaaataaaaggggggat

SEQ ID NO: 52014 - DNA, 415 bp, Zea mays
  Clone ID: LIB3067-001-Q1-K1-E10
cccacgcgtccggcttgctggtgatgatacgcttactactgatgcacctatatctgagattgctcgcatgtcaatccataggcctgaggttgagcaatcgtcgaataaggattaggagatcagaggaacaggacagatatttggaagggtggaactggtacgctgaaagtgaagaacgttaaaaatggtgccgtcccatctaaagaccgagttgcaaagtctgacccttagcgccgcagcaattgaaggagatgtttggtttgaataatcaatctattttagatgaggtgatgtatcataagttcattccacaaatttggtggaataaatttattcctcatattatgactaattattaacctatgaggaataaaatcatggtggatcaacctattctattatctaaaccaaaagt

SEQ ID NO: 52015 - DNA, 418 bp, Zea mays
  Clone ID: LIB3067-001-Q1-K1-E12
cccacgcgtccgcacagctactgagtttgctacactgtctttatcaaagaaggattctgttgtttcaaatggtgctgtgcttagcattggatgtctcacatccggtgagaaagcaatgaacttatcagaatctgtggatcaagctaatgaaatcacaaaggcacttcctacgagtcagaacaatactgcaccagtaattgctcaagcagattgtggagtagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcatgagaagtaaaatgataagacgtgttgtagcctgc

SEQ ID NO: 52016 - DNA, 423 bp, Zea mays
  Clone ID: LIB3067-001-Q1-K1-E3
gcggatgtagagtgattgatgtacatcacttcactaatcatgaaatctgtagaaggcgaaactactagccatatatgatatgcataatccgagtggtgaacattatcaatatcccgcaaatgatttctaagctccggcggagaagaagcccaaggccgagaagcgcctaccggcgggcaagtccgacaggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaacttcttcatcaacgacatcttttagaagctcgcggtcgaatcccccgagctggcgcgctataacaagaagcccaacggcaccttctgcgagatcc

SEQ ID NO: 52017 - DNA, 309 bp, Zea mays
  Clone ID: LIB3067-001-Q1-K1-E4
atgcgtacgtaaatggattcaaatagatggatttatctcagcagggacaccgaaccacacaatgcagcttcacgactccgcgagggccaataaacagatcaggcactagagctgcacatacggcgaccaccactcagtgcttattcctcggcgaggtccttcttgacccatccgccgacaagggcgccgcggctgttgcagcagcctttctctttggcgacgccctttccggcgccccatcagcgggttcagaagccttcctcttttgctaagccctcggcacggtagccttcctttttgttgacgtcg

SEQ ID NO: 52018 - DNA, 370 bp, Zea mays
  Clone ID: LIB3067-001-Q1-K1-E5
cccacgcgtccgcacacgcgttcacccacgcgtacggccacgcgtacggacaggcgtgcgcgcacgcgttcgaaaaaaaataaaaataaaaatgaaaaaaaaaaaaagagaaagaaaaagaaaaaaaaaaaatatgaaaataaagacaaaagaaataacaaaagcacttaaatacgagtcagaacaatactgaaccagtaattgctcaagcagattgaggagtagagatcagctatggtgtcatcatgcacgttgctgtgtctgcttcatgcaatggaactacagagaaaaaggtgaattcgaagttaaagaagtttgtgaggtatcctgttgtgaacatgtggttagggttcagacatttaaagctagg

SEQ ID NO: 52019 - DNA, 377 bp, Zea mays
  Clone ID: LIB3067-001-Q1-K1-E6
gaaatggaatcgaattgatggttatatccagcagtagacacccaaccacacaatacattttcaggactccacgatcgccaagaaacagatcaggaactagagcagcacatacggcgaccaccactcagtgcttattcctcggcgaggtcctccttgacccagccgccgacaagggcgccgcggctgttgcagcagccttcctctttggcgacgccctcgccggcgccccagcagcgggtacagaagccttcctctttggcgaagccctcggcacggtagccttcctctttgttgacgtcgtcgccggcgtcgcggcacccggcttctgcttgctctccaacaccagctgctgctgctgctccgcggcgatgcggtcg

SEQ ID NO: 52020 - DNA, 392 bp, Zea mays
  Clone ID: LIB3067-001-Q1-K1-E7
caaatgctcctagcgaattcaccacagcttctcaccaccgctaccttcgatggcacccaaggcggacaagaagccggcggcgaagaagcctgcagaggagcccgcgacagacaaggcggagaaggctccggcggggaagaagcccaaggccgagaagcgcctcccggcgggcaagtccgacggtaaggagggcggcgagggcaagaaggggaaaaagaaagcgaagaagtccggggagacctacttgatctacagcttcaaggtgctgcagtatgtgcacccctacatcgggatatcgtccaaggccatgtgcattatgaactcctgctcatcgactgtctcctagaagctcgcgtccttatccgtcaagctggcgcgctatatcaagaagc

SEQ ID NO: 52021 - DNA, 343 bp, Zea mays
  Clone ID: LIB3067-001-Q1-K1-D3
gcgtccatgcttgcgggcgcggctcatgtataggacagcggcatttgatagcggctgcggggatgctgtcactacggcggcctgcatgcactatcaccttctgatgttccagcgtgccactcttataccgttcaccgtttgcatacattccgcagccggcgacgtgtgagccttgaagttcttggtgttccacgactgtgttgttgtgagagactttggtgcgttaatagcgagtgagcatactctcatactcctttcgggatttcggctccttcatggcaatcatgcttgacacactgtcgtctatgaacaataatgactgttgcatgaaaagctatggtgc

SEQ ID NO: 52022 - DNA, 145 bp, Zea mays
  Clone ID: LIB3067-001-Q1-K1-E8
cccttcttgttgaagtgtcgaccttaggtcctcgtgtccaatgtggcagctggggcagcatgaagacaaaagtcgtgggctcaataatcctggtgtcgaaaacagggctgtcaaggagcagatgggttgagcctgtaagaatgct

SEQ ID NO: 52023 - DNA, 422 bp, Zea mays
  Clone ID: LIB3067-001-Q1-K1-E9
gcaccacaagcgagcgagggacccggggcggaagaagagagagaagacgtctctctgctctcggcgtccccgttccccaacctctcgtctgctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagcaatggaagtatatgccttgacattctcaaagagcagtggaaccctgctttgacaatttct

SEQ ID NO: 52024 - DNA, 402 bp, Zea mays
  Clone ID: LIB3067-001-Q1-K1-F1
ggatttgggtttggaaactagccctcaatcccatggattctgggagatgattggagttaaaaatctagctcttacatgatttattacctgcatttgttctttacatgctacagtctagagtatatggtttttgtagggcatggtccagagtagttgctggaggtgtttcccatgcacgttccatgttcaattatacacaatcctatcttgcacaatccattcccacatcagcatgggcattccgcattatttccttgtgcaaactgcattctctattgcagacaatgaagcaagagaagtttcttatttcgagaatatcacaatatctgcatttagcatgagcataacattagcaatcgctctttcttttcgatggatctcctatggaaaaaaagaagagca

SEQ ID NO: 52025 - DNA, 408 bp, Zea mays
  Clone ID: LIB3067-001-Q1-K1-B9
gccgcggccatggcatcactcggcgccgccgccgtcgtgcactgcaacaccgacccccacgcccaggccgccatcgtccgcgctgccaagtcccgccgccttcccttcgtttcctccgtgcccttcttctccccgtcctccgccccgacgctcaacgatttcgctggcagcgagtacgccctcgtcaccgagcgcggagattcgctctccaggctcgtcggcgtcgctgtcgcggccgatgctgcctcccgcgaggttcccgtctctgtctcggagtacatgcgaccgacgccgcgctcagcctccgccgccttcgactttgaggaagcagcaaccttccttgccgatgagggtctggattacgcccctctcgtatcagatgatggtgaggttgttgatctaatcacc

SEQ ID NO: 52026 - DNA, 422 bp, Zea mays
  Clone ID: LIB3067-001-Q1-K1-C1
gaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcggctttctcaaaatgagatgagatgtaacgctccggccctatgtccgtttccttttttatcttttagctatgtaat

SEQ ID NO: 52027 - DNA, 380 bp, Zea mays
  Clone ID: LIB3067-001-Q1-K1-C10
cacatgtgatcttcgtaatagtgtaacaggtcaaactgatgaatgaaaagcattcgcagagagggagtcattgtatttcatggagacctctgcactcgagtcgactaacgttgaaaatgcattcgcagaggtctgaactcagatctaccgcattgtgagcaagagagcagttgaagctggcgaagattcagcatctgggcctggcaagggcgcgaagattaacatacaggatgatgtttcggcggtgaagaatggtggctgctgctgtagctgacctgccctgatgtatttattgagcagctgtggtgatgtatcttatggtacggcatatccagcgaccgagaactggtactggcattagcagcttctatgatacctag

SEQ ID NO: 52028 - DNA, 390 bp, Zea mays
  Clone ID: LIB3067-001-Q1-K1-C11
cacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtaacacgtacgctagcaaagcag

SEQ ID NO: 52029 - DNA, 421 bp, Zea mays
  unsure at all n locations
  Clone ID: LIB3067-001-Q1-K1-C12
cggacgcgtgggctcaaaacgaaagccagctcagctctgctcagctgctcacacctcacacccacaggcctgccgccacagcaccgcggatagcagagcagagcggcagccaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctnggccgccgcaaccccaacgaccgcgtgggcatcttctacaagcgcctggacgtgttc

SEQ ID NO: 52030 - DNA, 98 bp, Zea mays
  Clone ID: LIB3067-001-Q1-K1-C2
gctttttgaagagtgcgttgtccacctgaaagaaaggttaaaagagaaagaacgtttgagggaggaagaaaaggcaaaaagagagaaagagcgtgagg

SEQ ID NO: 52031 - DNA, 76 bp, Zea mays
  Clone ID: LIB3067-001-Q1-K1-C3
tcgtctggatgaagttattcttgtgggtggatccacccgaattcctgcagttcaagaacttgtggagaaacttact

SEQ ID NO: 52032 - DNA, 425 bp, Zea mays
  Clone ID: LIB3067-001-Q1-K1-C5
atagtaaacgctccatacatattttctgcatgttggaaggtcgtgaagcctctgttgcaagagagaacaaggaagaaagttcatgtgttgcgtggctgcgggagagacgagcttctacagatcatggactactcctccctcccccatttctgcagacaggagggctcgggctcatccaaacattcgtcaggcgacgccgataactgcttctctctcgaccacccgttccaccaggagctctacagcttcatccaggagcaggcgctgaaccaggagctcatcaagcagggctccttgcacgtgaaaatccccgagcaggaccctgaggacgcaaagatcgtggaggtcatcgaggccgagttccacatgcttggcgtgcagaacgggtccgccaatggcatcgaccaagcatagcacctttgtct

SEQ ID NO: 52033 - DNA, 411 bp, Zea mays
  Clone ID: LIB3067-001-Q1-K1-C6
tcgctgacgcgtgcgggaaccaccagcctaagtttgagacatgctaccaactagcgattgcaatcaaaaaggaggttgaagatcttgaggctgatggtattcaggtgatccaaatcgatgaggcagctctaatggagggtctggcactacgcaagtcacatcatgcattctacctggactgtactgtccactctttcaagatcaccaactgccgatttccagacaccacacagatccacacccacatgtgctactccaacttcaacgacatcatacactccatcatcgacatggatgccgatctgatcactatcgagaactcccggtctgacaagaagctactgtccgacttccgtaatggtacgaagtacggagctgacattgaacctggtgtctactacatccaatctc

SEQ ID NO: 52034 - DNA, 337 bp, Zea mays
  Clone ID: LIB3067-001-Q1-K1-C7
accacgcgtacgggatgaagcattgccaatctacccgtcaaatgagtcttctctttgctatcatgatacaagagttcagttagacatgtcaatctgcaagtactgaggcaatgatatggttcaatagaaaaaaaaaaaataaaaaaaaaaaaaaaaaaaaaaacatactatataaaacaaacaattaagaaagaagaatgatataaatacaataaaataaaaacaaaactaacaacaggagatccaaatactgcattgacaggtcatagatatgttcagctaacattactagctcatcatttggaccttctaaataagttcaccttacatcaaatgg

SEQ ID NO: 52035 - DNA, 390 bp, Zea mays
  Clone ID: LIB3067-001-Q1-K1-C8
atcaaacttatatttacaggcatttgcttctatattaagataacattctgaacctggcaagggtcttgctaactagtattgtgctttcatgtcagatatgcttatatatgttctgtgtgcaaaattgtgtctgatttcattcttatgcatgccattgcgttacctactctataacacaggtaatttgatggatgaatgttcttgttttctttcatctttgcagaactcacaacagggatccaaatttgttaagacaggtttagatagttcagctaacattgggagctcatcaattgcacctaccaagacgttcaccctggatcaaatgtaatgcctacggcagaagaaccggttatgccttgacatcggtctatatccagtaagatgcta

SEQ ID NO: 52036 - DNA, 385 bp, Zea mays
  Clone ID: LIB3067-001-Q1-K1-C9
atgcgtattggtctgattggaacacgtggatcagtattcgcgttgggaacgatatgtcaccagacgggatctgcgaatgtgggtgggaagtgtagcatgatcatctaaaatattcaggttcaattggtcgcttctttgaaatcacattggctatacggagatgcataccccagtatgggctcaagtataacttacatgtctgacatcgcacagccttctcggaatatcaaagtcgtcgcctgatcctattcacgccaataaacagtggtcaagaactctgttgattgaaatccattcatttatacctactactgcctatagtctggcgattgatcaagtattcgatattcgttattttcatccataccgtgactaccgttgtaag

SEQ ID NO: 52037 - DNA, 388 bp, Zea mays
  Clone ID: LIB3067-001-Q1-K1-D1
atgcggtggtcgtcaaccgagtcccgactgcattgatctgaccgcctttctacgcgcaacgacggagcttctcgaataccctgcttgcttcggcctcaccttcttattctccgccgaacaagtcttagacgcctaatccgtagtttacatcccgaagggcggcaagggtgatccaggccgaccatgggttacgtcgagagaagtgttgtgaaagacaagcggactatatggcgactgggcataatctcagacttcttttgggctattgtcaacttcatcagaatcttctttgacacactgttctcagtggacaaaactgacagctacaacaaaaggtatggggctggtgagaagtgggatggtggacctcgtggtggtggtgggcggg

SEQ ID NO: 52038 - DNA, 376 bp, Zea mays
  Clone ID: LIB3067-001-Q1-K1-D10
agcatgcggcacgctatcttagacttctgttctctggaagtgagctgacccgaatagtctgcatggctgttttccgacaccttaagagcttgtttggtggcttaccgtcagactatagtgctgcagaaacaactatcgttcttgccaaggctgtttcctcttgtgtgcgccatatggaactcagtgctctcagtgcctgtctagcagctgttgtctgttcttcgcagcagctacctcttcagccactcggtactgcctctggtgatggagtgtctcagatagttaaatctgtgctggatagagcgaccgagctactggcggatccctattctgcagccaactacagtagatcaacactgtcgcttttgcatgcgtc

SEQ ID NO: 52039 - DNA, 433 bp, Zea mays
  Clone ID: LIB3067-001-Q1-K1-D11
cccacgcgtccgtggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgt

SEQ ID NO: 52040 - DNA, 349 bp, Zea mays
  Clone ID: LIB3067-001-Q1-K1-B8
gcgacaagccggggaaccacaacttcgagctgacgtatatcgggcagccaccgatgggcctcgccgcgccgtggtactctgccgccggatgcaagctatggaacatgtcccaatcgggctgcatgaactcgccgaggaagacggtgttgtacgcaacggaggcgacgtggacggtgtgcgatgccgggtcgcgcgggtagaagtcgtcggaggcgcgcacgacggcggtctgcctggcgctgtacagcatgtcggagttgtggcacatgcaggagatgcagccgttgtccgggaagctgcgcgccacggaggcctcgagcgcgcggtggtaggcgcgggtgatggcgac

SEQ ID NO: 52041 - DNA, 398 bp, Zea mays
  Clone ID: LIB3067-001-Q1-K1-D12
aaaaaaaataaaaaaaaaaaaaaaaaaaaaataaaaaaaaaataaaaaaaaaggaagaagctgttaaaaattacatgcttacgttaacttgcttgcaattatttatattgttttattatcttcgcctaaagatatatattttttcattggttttacacattgtaagctagtgggatatccttgtcttaataaactttatttgactttgactatgtaccgttttcttaagtttggatattatagatttggcacgtactgatcttacattagaccaattatctggtcttacatgctaatgggacccgccattgtactgctctttaatcgcgatgggtctgaatgttacgcgcaacgtgatctcaacacttattagttgccatctgcctgctatatatggt

SEQ ID NO: 52042 - DNA, 129 bp, Zea mays
  Clone ID: LIB3067-034-Q1-K1-H3
gtaccagtgcccattcattactcgagcgttcttacatacagaagatctcgcctcccatggggggtgtagtcatccaggatgtgcaagagaggcgcgcacgcaatcaagcaagcttgaatagagactatc

SEQ ID NO: 52043 - DNA, 414 bp, Zea mays
  Clone ID: LIB3067-034-Q1-K1-H4
cgcagcgccgccgctccatcttccgctgatccgctcgctcccgcctctcgccacgcaggcggcggcgctcaggcccgtgatttcagcgacggcgtcagcggcttcccctcccgtctcttcccagtcgcctcgcgccctcgcctccggtcctccgcacaccggccggtgaccctgcatccaccatgactggtgtcagcactggattgttgacgggcttgaggagggtcatggaacagcaaaggatttcaaccgctttctgcagacaatcacgagtttcgagctctactgtttctttctctgacctcgatgagaagggtgacatggaatatgatgataactctccaaattcaaagagggagttacgaccccaaggtgtagatcccaataagggctgggaattccgtggtgtgcaca

SEQ ID NO: 52044 - DNA, 295 bp, Zea mays
  Clone ID: LIB3067-034-Q1-K1-H5
cccacgcgtccggagcaaggccacacacacacacacaccactagtaggctagcctagcgttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgacc

SEQ ID NO: 52045 - DNA, 197 bp, Zea mays
  Clone ID: LIB3067-034-Q1-K1-H8
atgaacaatatgtattatttaccaagagcggttgtgtcatgacattcgtgccagacgacagtgatggcgtcgtagcccccagccgctagactgggtgggcatcgagaaccaaacggttaacgatggcggtatatctcaaattattgtcttatttagttaggtctgatttgcgtctatgagtaagtgaaagaccacgt

SEQ ID NO: 52046 - DNA, 295 bp, Zea mays
  Clone ID: LIB3067-034-Q1-K1-H9
gcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatc

SEQ ID NO: 52047 - DNA, 428 bp, Zea mays
  Clone ID: LIB3067-035-Q1-K1-A1
gacccacgcgtccgatcgaggataacctccttagcccacttatttctcgtcaggcaacaagtgtggaaggaaaggagcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctactggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttggtggca

SEQ ID NO: 52048 - DNA, 427 bp, Zea mays
  Clone ID: LIB3067-035-Q1-K1-A10
cccacgcgtccggacccacgcgtccgcctatctttgccccctgagtctcttagcattctgtggtctatgctcagtattttaaaagttcatttttttgcatatctatgtggcatcaattaccatatgtattgtggcatgtatggacttctgcttatttttagaaaataatgctcgcttgactgaatagataaataatactcactccattttttatattttgtgtgttttagttcaaaaatggactggtcggacgattaatattccagaacagagatgatatatctgacccatacatactttgatgtaacaacttggttttatgcttcttgcgctgatatggcagcttgacttcacaccatttacggtgcagatcattgtcatcctcaatgactgcatgcgtcctttatattagttatcgtgcatgatc

SEQ ID NO: 52049 - DNA, 428 bp, Zea mays
  Clone ID: LIB3067-035-Q1-K1-A11
cggacgcgtgggtgagcgcggcggcggcgagctcggtcaccaagttcatcaagtgcgtcacggtcggcgatggggccgtcgggaagacctgcatgctcatctgctacacctgcaacaagttccccacggattatatccccaccgtatttgacaacttcagcgccaatgtctccgtgggtgggagcatcgttaacttgggcctctgggacacggcaggccaggaggattacagcaggttgaggcctctcagctacaggggtgccgatgtgttcatcctctccttctccctggtcagcaaggcgagctatgagaacgtcctcaagaagtggatgccagagcttcgccgattttcacctactgttcctgtagttcttgttggaaccaaactagatctccgtgaagacagatcttaccttgctgaccattct

SEQ ID NO: 52050 - DNA, 89 bp, Zea mays
  Clone ID: LIB3067-035-Q1-K1-A2
gccacgcgttcggcatacaccacgtacgtatacacacgggcacggaactagctagctcgctggcagtcgtacaatgaccatgaggggtc

SEQ ID NO: 52051 - DNA, 355 bp, Zea mays
  Clone ID: LIB3067-035-Q1-K1-A3
cccacgcgtccggctccgctccggccacctccctcttcttcgactgagtaaacacgagcaggcgagcacgcgacccgacaacgctcgcgcggaggccgaaatgcccgctgctgctcctcttcccagtacgtagcagcggaacatcgtcgtgggtcgtccgccgttgccatcgtgtgacggcgtgaagggatcggatcgaaggaggccgcaagccaagcaaggatcaagaaatggcgtcgcgcggccacctgctgctactagcgctgctcgtgctggccgcggcggcagcggcagcgtcgggcggcgggcgacagcaccagcagcggcagcgcggcgggaggaagccgaagccggc

SEQ ID NO: 52052 - DNA, 176 bp, Zea mays
  Clone ID: LIB3067-035-Q1-K1-A4
gagacacctgaaataagagttgtcgagctcgatcagtcttacttctatcaacttgttcttgggctgcaacagagtactttaaaagggatcctcaatcatgactttccctgtgtattgctgatatattggcactagatattttaggaaactctatttacagcacagtgatttgcacc

SEQ ID NO: 52053 - DNA, 246 bp, Zea mays
  Clone ID: LIB3067-035-Q1-K1-A6
aaaaagaataagaaatagaacaaaatttgattgataccgcataaaaagattctatcataagtacgagttaatactataataaggaagatcttataaagatacttaaatgagagttgactgtccttgaggttccaacattacgactgcaaatacctgaacgataccgatcttaacaggtatgctaaatttaataatgtggccagcttattaaaacgtgaagaagggaaaacctttgggttttccaaa

SEQ ID NO: 52054 - DNA, 453 bp, Zea mays
  Clone ID: LIB3067-035-Q1-K1-A8
gggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaact

SEQ ID NO: 52055 - DNA, 450 bp, Zea mays
  Clone ID: LIB3067-035-Q1-K1-A9
gaacgggttcgcgtgcaaggcgaacttttcgtcggacgacttcttcttcgacgggctgaggaacccgggcaacaccaacaacccggcgggctccgtggtgacggcggccaacgtggagaagttcccgggcgtgaacacgctgggcgtctccatggcgcgcatcgactacgcgccgggcggccagaacccgccgcacacgcacccgcgcgccaccgagatcatcttcgtcctcgacggcacgctcgaggtcggcttcatcaccaccgccaacgcgctcttcaccaagaccgtcaccaagggcgacgtcttcgtcttcccgcgcggcctcgtccacttccagcagaacagggggcacggccccgccgtcgtcgtcgccgccttcaacagccagctccagggcacgcatgccatcgccatgacgctcttcggcgccgttgccgccgtgccctc

SEQ ID NO: 52056 - DNA, 434 bp, Zea mays
  unsure at all n locations
  Clone ID: LIB3067-035-Q1-K1-B1
cggacgcgtgggcggacgcgtgggcactgctgaaggctaaggtggatccggggcatcatgtgcttgacattggctgtggttggggctcattagcaatacgtttggtgaagagaactggctgcaagtgcacaggaattacattatcggaggagcaactgaaatatgggaagagaaaggtgaaagaatttggattagaggaccgcataactctcctgctttgtgattaccgtcaaataccgaacggccagaagtttgataggattataagttgtgggatgcttgaacacgttggccatgagttctacgaagatttctttgcctcctgcgagtatcatttggccgaacacggtctacttgtcctncagtccatcgcggtcccaaaggaactgtacgacaaaatgaggacgaaacctgactttctgaaggaatatatc

SEQ ID NO: 52057 - DNA, 369 bp, Zea mays
  Clone ID: LIB3067-034-Q1-K1-H2
aagagggacgaatggcgagctctcagtgctgcgataacccgccggccctgaacccgggctgcggtgagggcaaggtcgtcgacagcttcggcgggctcaaggcctacgtcgccggccccgaggactccaaggccgtcgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacatgttattggggctctaaaagagaagggagtgt

SEQ ID NO: 52058 - DNA, 442 bp, Zea mays
  unsure at all n locations
  Clone ID: LIB3067-035-Q1-K1-B10
cccacgcgtccgctggcaagaagtgcaagaaaccaggccccaggaagattcataaggctgagagggagaagcttaaacgagaccacctaaacgatctctttgttgagctgggtaatatgctagaagcagatagacagaacaatgggaaagcatgcatactgactgacactactcggatactaagagacctgcttgttcaagtagactctcttcgaaaggaacatagcgacctacaaaacgaatctcattatgtaagcctttttcttttagtatgtcaactaagatttggtctattggcagttgtgctgttgccctttatctagcaaactttgttatctgattttatccattggaaatgctttatacaaatgcctaaaccaactcatcactttgntgaatatttggcttgtcacgctacctttgttgcatcttccagcatggg

SEQ ID NO: 52059 - DNA, 378 bp, Zea mays
  Clone ID: LIB3067-034-Q1-K1-F3
ataaagctgaagaggatggtgtcgcttgcgtagagttcattgctggaaaggaaggccatgttgactatgacacagttcctggtgtggtttatacgcatccagaagttgcatctgttggcaagactgaggagcaggtgacggctctaggaattccctatcgtgtgggcaagtttccacttttggctaacagtcgtgcgaaggccattgatgatgctgaaggggtagttaaggtgatcgcggagaaggaaaccgataagattctaggtgtgcacataatggcacccaatgctggtgaaatcatccatgaagctgtcatcgccttgcagtatggagcattcagtgaggatgttgctcgaacatgccaagcacaccctaacg

SEQ ID NO: 52060 - DNA, 457 bp, Zea mays
  Clone ID: LIB3067-034-Q1-K1-F5
cccacgcgtccgcccacgcgtccgcccacgcgtccgcggacgcgtggggtaactttctggtgggactattttttctggagcttgtgaacaagtttggggttggagcagtctatgcaggttttggtggggtctccctgctgacagcactctttgcctacaatttcatagttgaaacaaaaggacgttcgcttgaggaaattgagatgtccttgagcagtgctacccctggcaagcaagagtagaacatctcaattgtatggacaaactgaacaactgacgggaggaatttaataagagcagagggggcctaatcccatgaatcttcagcagcagcagtttgttgcaaacaacatcaactcctatagataatgagcacaatcaaattcagcttttctttggtagcatgagaattgttgtacaatattaaaaagggttgagaaaatggccctttaaattt

SEQ ID NO: 52061 - DNA, 340 bp, Zea mays
  Clone ID: LIB3067-034-Q1-K1-F7
cccacgcgtccgacaaaccattgttggacgcgttcccctcctgcacgcaacctcatctggtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcgggtcggagcgga

SEQ ID NO: 52062 - DNA, 213 bp, Zea mays
  Clone ID: LIB3067-034-Q1-K1-F8
gcagcagtatggcttgaatccttatgaagccacaaccacgattcatgaggcacagagcgcagatgttgatgagagcacgacatgcatatagaggtacagcatatggcacgaggccacgcatgtacccatgtgcagcagcagcttaaatgaaccatggcttactgaccaccgcggaggcggagcaccatgtggagagtgctcttcttctggatg

SEQ ID NO: 52063 - DNA, 358 bp, Zea mays
  unsure at all n locations
  Clone ID: LIB3067-034-Q1-K1-F9
cccacgcgtccgcccacgcgtccggcagaacatacctgagacgacaggtagaagacgggtgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctnccttttcttcctcgtcggcgtcgacagcgatgagaatgagttagctatccttgaattcataca

SEQ ID NO: 52064 - DNA, 358 bp, Zea mays
  Clone ID: LIB3067-034-Q1-K1-G1
gctgctacctcttctgagggtttccttctgctgctgctgccgtctaggctgagtgacctatttctatgtatgtgacgattcaagttaacttgtggagcgcggctgcgcgtgcgtttgtgcttgtgcagtcgccactgttgctgtgttcttgcgatactcttgtcacttgagaggtggtgttgtatggactggtttagctggctcccccgtgcttccatcgacccgcttcgcgcttcatgtttactacttgcgatactgttgttacttgtgattgatgatgataaaagccacggcctgtgttactactgctgtaacaagtccgacagaagaaccattcaatgcatgcccacgaagggga

SEQ ID NO: 52065 - DNA, 423 bp, Zea mays
  Clone ID: LIB3067-034-Q1-K1-G12
cacctgtttcgctgctcgcccgatctcgcgctgccggcagcgatctgagatcgagcggggctaagctttttcatcgagatggtgcttgtactgcatgctaacagtggtaacaaaaatgcattcaaaacactaattgccgcagaatacagcggtgtcaaggttgagttggtgaaggactttcaaatgggtgtctccaacaaaactccagagttcctcaagatgaaccctattgggaagattcctgtcctggagactcctgatggtcctgtttttgagagcaatgcaattgcaagatatgttactcgcttgaaggctgataacccactttatggatcttcactgattgattatgcccatattgagcaatggattgactttgctgcaacagagattgatgcaaacattggaaagtggttgtaccca

SEQ ID NO: 52066 - DNA, 360 bp, Zea mays
  Clone ID: LIB3067-034-Q1-K1-G4
cgcgcgcttcccaacgccagggtcatgatccaccagccctcgggcggcgcgcaggggcgagccaccgacatcgccatccaggccaaggagatcctcaaaatgcgcgaccgcctcaacaagatctaccagaagcacacgcgccagcccatcgataagattgagcagtgcatggagagggacctcttcatggaccctgaagaggcgcgcgactggggcctcatcgacgaggtcatcgagaatcgacctgcctcgttcatgcccgacggaatcggtggaggcctcgatgtgcccaggctcggtggcgttggcggcggacgggggagggacgtctaggaaccttccgaggtgtgaggattggcc

SEQ ID NO: 52067 - DNA, 351 bp, Zea mays
  Clone ID: LIB3067-034-Q1-K1-G5
ctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgccttctccatcgatagcattgtcaatggcggtgataatgggaaaggacctgcaattgctgcaactgtaggtgtggcagttcctcaagtcgaggagaagactatcggcgtgcaggctatgcatgtc

SEQ ID NO: 52068 - DNA, 292 bp, Zea mays
  Clone ID: LIB3067-034-Q1-K1-G6
cccacgcgtccggcgcctcgacgtcctctccaccggcagatacatcctcaacctgtacgtccagaacctgctcgaccagtcctagctaccatatctgtatctgtactgtacatcagcatcgcttcactctgtatagatatacatacatatatatgttagctagtagcatcgaacacttgtcccggtgggtggcggacggagatagtgtttccctgcgtgctgctctgtgtaaactgaaaaatgcgagatgaggcataaagttcagtgaaaggttgcatacattttcttgaag

SEQ ID NO: 52069 - DNA, 403 bp, Zea mays
  Clone ID: LIB3067-034-Q1-K1-G7
cggacgcgtgggcttcggcccgacggccggcgcagcgctctgcagccacatgggtgtcgacaagcttgcgttcacgggatcgacgggcacggggcagatcgtgctcgagctggcggcgaggagcaaccttaagccggtgacgctggagctcggtggcaagtcccctttcatcgtcatggacgacgccgacgtcgaccaggccgtcgagctcgcgcaccaggcggtcttcttcaaccagggccaatgctgctgcgccgggtcgcggacgttcgtgcacgagcgcgtgtacgacgagttcgtggagaagtccaaggcccgcgccctgaagcgcgtcgtcggcgaccccctcaaggacggggtcgaacaggggcctcagatcgacggcgagcaattcaacaagatc

SEQ ID NO: 52070 - DNA, 434 bp, Zea mays
  Clone ID: LIB3067-034-Q1-K1-G8
agagaacttttacctccacacaatagtatggacagttaccatcatttatgcttcagtggtttgtccaataataaaaagccatctgcttcttattcagctaatcacagccaagtgatgtatccatgactcctttaacataattaaaatcccccaaaacattgcaaatttagtctggagggttgttgtttgttaaaccgctttccggttttaagttctgacccaatgacttgctgttaattatattttttccctcaattttaacattacagcttgaactgcagtgtgccaggaatccctgttgaattgtttttatagggataatctgaaatataacctagcatatgcaaattgtttctgtagttccttctggaattcattctcaggcaaaaaaatattttggcattattgcatctaccaatactaggtatgaacta

SEQ ID NO: 52071 - DNA, 341 bp, Zea mays
  unsure at all n locations
  Clone ID: LIB3067-034-Q1-K1-G9
atcgnnnctcgcgagccctcgcttcggcatccggaagaaatggccaagtcgaagaaccgcacggcgcacaaccagtcgttcaaggcgcacaagaacggcattaagaagcccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgttcttagctcagttccacctttaggacctgnggttttgttaaagatggaacttaagttggtgttactgtatgatggcaaggaccttttgct

SEQ ID NO: 52072 - DNA, 355 bp, Zea mays
  Clone ID: LIB3067-034-Q1-K1-H1
aattgtgcaggttaggagagggtatctgcctaaagattttgttgttccaaagtctccagaaagaatattgttttgtggttggcgccgtgatatagaagatatgataatggtacttgatgctttccttgcgccaggatcagagttgtggatgtttaatgatgtccctgaggttgacagagaaagaaagctaattgatggaggtttggacttcagtcgcctcgataatattactttggtgcatcgtgagggaaatgctgttattcgccgtcacttggagagccttcctttagaatcattcgattctatcctgattttggcagatgaatctgtagaagattcagcaatccaagctgac

SEQ ID NO: 52073 - DNA, 86 bp, Zea mays
  Clone ID: LIB3067-034-Q1-K1-H10
cccacgcgtccgcgcaactcgacgctgtaacacattttgattctctactcctgaagaggagcagcgaacgacatgatgacgtgtgt

SEQ ID NO: 52074 - DNA, 347 bp, Zea mays
  Clone ID: LIB3067-034-Q1-K1-H11
gtcccacgccgtcatcttcggcgtcgtggacgacctcctccgcagggcgcgcgtggccggcggcgacgtcggcgtgctcatcttcaactccagcctgctcagccccacgccgtccttcacgtcgctcatcgccaaccgctacgggatgcggcgcgacgtcgtcagccacaacctcagcggaatgggatgcagcgccggcatcatcgccatcgacctcgccaagcgcctgctccaggtgcacccggacacgtacgcgctggtggtgagcacggagaacatcactctcaacgcctacatgggcaacaaaccgccccatgctggtcaccaacacgctttttccgcgtcgg

SEQ ID NO: 52075 - DNA, 379 bp, Zea mays
  Clone ID: LIB3067-034-Q1-K1-F2
cccacgcgtccgggacattaagaaaccacttttgaggagcgacaagaagaacatggccgccctcttggcagagtttgacaagattaacaaaaagcttggctttcggaaggaggatcttcccaagatcgaggaagagcttgaattggaaattgccaaaagtgagctgactgaacttaagaaggaatgcgttgaagcaatggagactcaactcaagagggaggagtttcaagatgaggagatgcctgatgtcaggaaattggacatcagaaacttcctgtaggcctgatcgacgataatctttgaggcccaacgcacctctggttttggtttcaagttgatcggtgctccacacctatgaatgctgcttcttccctttttg

SEQ ID NO: 52076 - DNA, 364 bp, Zea mays
  unsure at all n locations
  Clone ID: LIB3067-034-Q1-K1-D3
gcgttcgagctgtcggagcggctgccgcacctgccgctgcggatgcaggagcactcgcgccgcgcgctggcgttcgccgagcggatgcaggggctgggcctgcgcgtgctgtacccgggccttccgggccacccgcaccacgcgcgcctggccgccatgggcaacccgggctacggctgcggcggcatgctgtgcctcgacatgggcaccgaggagcgcgccaaccgtctcatgcaccacctncagaacaccacccagttcggcctcatggccgtcagcctcggctactacgagacgctcatgtcctgctccggcagcagcaccagcagcgagatgcccgccgaggaccgcgcgcgcgcgggca

SEQ ID NO: 52077 - DNA, 419 bp, Zea mays
  Clone ID: LIB3067-034-Q1-K1-D4
caagaagaagagcaagaagaagcccaccggcacctcggcggcctccgcgccctcggacgatgaatctgcagatggcccgtctgccgacgacgactcgtccgatgatgccgcggacaaagctgccgccgcgccgtcgtacctgtccgctcgatgggtgaccgccgcagtgacgaccgccgtcgcgctggcgctggcggcctaaggtgtgcgctcatatgctatgttttttttataacttattggaccccctatcttcttttcttttgtccaagtcgtgtcccttccttgttggtgaacaaaataagaagggctatttttggttttttatatttattaccgcattccattaaaaaaaattggaggtgtgtgtgagtgatgtaagtctggattttggtcaatgggttggggtgatcattttg

SEQ ID NO: 52078 - DNA, 345 bp, Zea mays
  Clone ID: LIB3067-034-Q1-K1-D5
cccacgcgtccgaacagcctgcttgatgtatcccagagtgatctagaggctaatctgtgcaagcttatggaaaaacggggatacggagaggagtatataaatcgctataaaatgatgacaaggttccatcatcaacgggttccactagtaattttggtgtgtggaactgcctgtactggaaaatcaacaatcgctacacaacttgctcagaggctcaatttgcctaatgttttgcagacggacatggtgtatgagctgctgcggacatcaacagatgcgccacttacttcagttcctgtgtgggctcgcgattttaattcacctgaagagcttatcactgaattc

SEQ ID NO: 52079 - DNA, 308 bp, Zea mays
  Clone ID: LIB3067-034-Q1-K1-D6
cccacgcgtccgcggacgcgtgggaaaataaaaaaaaaaaaaaaaaaaaaaaaaagaaggaaaaaaaaaaaaaaaaaaaaaataaaaaaaaaaaaaaaaaaaaaaaaaaaaaaaaaaaataaaaaaaataataataaaaaaaaaggccttcctttttaaagtttccaattttacttacccttgcattttaactaataccttttatttagggtcacttaatttaatttaattgtccttctttttaaaactttttaattggaaaaaccttgtttttaccaaattaattcactttgtaaaaaattcttttt

SEQ ID NO: 52080 - DNA, 346 bp, Zea mays
  Clone ID: LIB3067-034-Q1-K1-D7
gccatctattggagcattcactgtccaatgtgctaaatgttttaaatggaggcttattgcaacgaaagagaagtatgaagaaattcgtgaacgtattatagaggaaccttttgtatgcaaaagagctcgtgaatggagacctgatgtaacatgcaatgacccagaagatatatctcaggatggtagcaggctttgggctattgacaaacccaatattgcacaaccccctcgcggatgggaaaggcagattaggataagaggtgaagggggtaccaaatttgctgatgtatactatacctctcctactggaaggaaacttaggtctctggttgaagtcgataggttc

SEQ ID NO: 52081 - DNA, 430 bp, Zea mays
  Clone ID: LIB3067-034-Q1-K1-D8
cccacgcgtccgcccacgcgtccgcccacgcgtccggcaaggtgtgagcatttgattcgttcagtttcatgctatcaggtacttcttcattttctgatcagaaacaaaaaaggacgaattgatttgaagagtatatgtggacatacttaaagttggatttggttcttgcaccaaaggaggtattatttattctgttgccatatctttaatcaagaaagatagttttctgcaagctcttggtattcttcggcaactaaagagtttggatcttaaattaagcaagggagccttgtcaactatagaagaagaatttaacaaggaaagcaaattggggatatgatgaatttgttggaaagagtggagatgtttccctgagttgcgtcttcgcaacaaaaatcttgtgtctgtgtgtacaaatcttggcactgat

SEQ ID NO: 52082 - DNA, 263 bp, Zea mays
  Clone ID: LIB3067-034-Q1-K1-E1
ataatgctgacaagtgtctcgagaaagatcatcagatcacaagctgtctgcttagccggatgaaagaacttgatcaaaagtgtcccactgaaatggatgaatatgctggttgcatgtattactacaccaacgaattcgacttctgccgctatgagcagcaagcttctgaagaatcctgccccatttccgagtagatcttgagagctctacttgcagggatctttgcaaatacagaaagaaaggatcgacaacctagttcatga

SEQ ID NO: 52083 - DNA, 61 bp, Zea mays
  Clone ID: LIB3067-034-Q1-K1-E10
cccacgcgtccgaaagaaacaaaaaaataaaaaaaaaaaaaaaaaaaaaaaaaccaagggg

SEQ ID NO: 52084 - DNA, 319 bp, Zea mays
  unsure at all n locations
  Clone ID: LIB3067-034-Q1-K1-E11
gtattntatgtcttgttggttacctgtaatttaattaaaaccatcacttgtatcaagggatacacttcggtaccaactgatggatctcctttgatcatacacaagtcctttgatcacagtcacacagaagtgagaactaagttcacagctaagactcttagcgatacaagagatgcatttgtcgccacaaactcaatcaccatcatcttactcctcggactcagcctcgccactcttcttgttgcccttccttgagtaccgaagtgtattttatgtcttgttggttacctggaatttaattaagaccatcacttgtatc

SEQ ID NO: 52085 - DNA, 367 bp, Zea mays
  Clone ID: LIB3067-034-Q1-K1-E6
aagaaaaagaataaaaaaaaaaaaaaaattaaaaaaaaaaaaaaaaaaaaaaaaaaaaagaaaaaataaaaaaaaaaaaaaaaaaaaaaaaaaaaaaaaaaaaaaaaaaaaataaaaaaaaataaaaaggggcggcccctttccattttaaaaaatgggggcttttttttaaccaaaaaggggggggtgaaattttttttaattttaaaaccctttgggaaaacattctggttcttttttggacccatttttttttccctttaaaaattctattttttttttggggccttaaccttgggttcctttttgttttcccccttttttaaaactttttttttggcctccccttcttaaaaatccctttttt

SEQ ID NO: 52086 - DNA, 186 bp, Zea mays
  Clone ID: LIB3067-034-Q1-K1-E7
cccacgcgtccggtaatgattgccctccctgctgtgtcttggttgcagttgaaaccatgtgtagctacattccccctcccaccacctccacacatcaacttctgcttcaccttttttagcatcaatggatggccggttgtttttaatgcgatgatctgcagttatcgtggcagaagctctttgtgc

SEQ ID NO: 52087 - DNA, 363 bp, Zea mays
  Clone ID: LIB3067-034-Q1-K1-E9
aggaaatgacaaaacagatattggaatggtggttatcaggggaaacagtgttgtagggatcgaggcactggagccagttgcgaggtcacagtgaatcattgttctttagcactagcagcgtgaaaactgatgtaaaagatatcagtggaccctgttgtatttgactaatgcttttgcacagcaacataacttcagaggtggaatgtctatccctttctctatgggatgcttgtagctatacaatcatcgagctcttaaattacatgatctaacgcatgctcatcgagctcttaaattaaaaaacaagaagatccaaccaagcaacaatgttggatgttagccgaaaaaatagaatcattaaaa

SEQ ID NO: 52088 - DNA, 382 bp, Zea mays
  Clone ID: LIB3067-034-Q1-K1-F1
cagagcagaacaagcaatgatggattccgtgccaggagcagaagtcctcctggcaagcccgtggaagtttccaactggtgattgcatccactaggtgcaatccaatttttgcgatggtgacgaaaccaagtagaagatggcaccctaacaagttatattatttccttttcttatcctgcttagatccaaggatgtgatggtctgaaccctaacggtctcctgctatcttgatttgacgtctgggagacgcttgattccgtgcctgtgggttgtaaagcgttaaaacttgactttgctagtgtactcccaatgatataacccaatcctgggtaaacaaacgcatggggatgaaatttggacgaaaccctggacaactgatgtg

SEQ ID NO: 52089 - DNA, 407 bp, Zea mays
  Clone ID: LIB3067-034-Q1-K1-F10
ccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtacta

SEQ ID NO: 52090 - DNA, 424 bp, Zea mays
  Clone ID: LIB3067-034-Q1-K1-F11
gagccaaactattccaagttgatttcattgtttgacagtttaattggaccaatcccttgcattataccaatcaatactgatggagcccaaaaggtagggcagaagcgtgccaggttgcttaatgatgacgacgaccatgttaaaaagaagattcggctgggtgctcctgcaacacagtggatttcagtatacaattcaaggcaacctatgaagcagaggtaccactataatgtggctgatgcaaggttagcgcaacatgtggagaaaggaaatgaggatggtttgttgataagttcaatatcatcatgcgcaaatctttgggcaatcattatggatgcaggaactggcttctcagctcaagtttatgagctatcttcacactttcttcataaggagtggatcatggaacaattggataaaagtt

SEQ ID NO: 52091 - DNA, 380 bp, Zea mays
  Clone ID: LIB3067-034-Q1-K1-F12
ctcactgatccagtatggctatggcaatggcaggcgcgccgagggtctcggcggcccggctggtggctctcgggctagcgctcctctgcgctgtcgccggcccggccgccgcgcataactgcggctgccagccaaacgtctgctgcagcaagttcggctactgcggcacgaccgacgagtactgtggcgacgggtgccagtcgggcccgtgccgctcgggcggcggcggcggcggcagtggtggcggtggtgcgaacgtggctagcgtcgtcaccagctccttcttcaacggcatcaagaaccaggccgggagcgggtgcgagggcaagaacttctacacccggagcgcgttcctgagcgccgtcaaggcgtacccaggc

SEQ ID NO: 52092 - DNA, 400 bp, Zea mays
  unsure at all n locations
  Clone ID: LIB3067-034-Q1-K1-D2
ccatgatgcgccacggcctcaacgagcccggcaagcacctcggcgtcgtcggcctcggcgggctcggccacgtcgccgtcaagttcggcaaggccttcgggatgaaggtcaccgtcatcagcacgtccgccagcaagcgccaggaggccatcgagaacctcggcgcggacgagttcctcatcagccgggacgagaaccagatgaaggcggcgacggggaccatggacggcatcatcgacacggtgtcggcgtggcacccgatcacgccgctgctggcgctgctgaagccgctggggcagatggtgatcgtgggcgcgccgagcaagccgctcgagctgncggcctacgccatcgtgccgggcgggaagggcgtggctgggaacaatgtcngcagcgtcag

SEQ ID NO: 52093 - DNA, 404 bp, Zea mays
  Clone ID: LIB3067-001-Q1-K1-A1
cggacgcgtgggtgcaaagctgggtggcatgaattcgttgctccaaattgaaacatcggcagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtttgattgacttctacaccagttctgggaagagaaagcctgaccaagtcatcatatttcagggacggtgttagcgaaagtcatttaatcaggtgctttacattgagttgcaac

SEQ ID NO: 52094 - DNA, 443 bp, Zea mays
  Clone ID: LIB3067-001-Q1-K1-A11
acgcactgccgtaccggtactgaatggctcgacccacgcgtgcgtccacgcgtccgcaaggatggcatccgtcccctctgggaggatcctgcaaaccagagtggtggcaagtggataattagattcaaaaaggcagtttcaggtcgattttgggaggatttggtgctagtggtagtaggcgaccagcttgagtatagcgatgatgtctgtggtgttgtgcttagtgtccgtttcaatgaagacattctgagcgtctggaaccggaacgcatcagaccatcaggctgtgatggcattgagggattctatcaagaggcacctcaagctgccgcacagctatctgatggagtacaaaccccatgatgcttcgcggcgtgacaactcgtcctacaggaacacatggctgagaggatagataaacctcatgatactcggcagcttcac

SEQ ID NO: 52095 - DNA, 337 bp, Zea mays
  Clone ID: LIB3067-001-Q1-K1-A2
ccggaattaatggctcgaccgacccatgcgttcgcgcgggttggcttatcctgccccttcggaatccgttcctgcacattagagcatccggggttactgctcttgggtgaacgttccaaattcatcttcaaatggaagtaccacatcgttctcctcgacattctcatgtacaatgtatagcacttgctgcaaaacgtcttcaatacctatcttatagtggcaatacagacctactatcctcacccaatcaactcaaatggacatgatctactgattggttaagctatgcacagctgaagctaatcgtaacgatcctcgagggcatgaacgacttgta

SEQ ID NO: 52096 - DNA, 356 bp, Zea mays
  Clone ID: LIB3067-001-Q1-K1-A3
ccactacatgccgttcctgatcgaggtcaacagcctgaacgacaacttcatctacgcgaccaggacgctcctgttcctgcgcggcgacggcacgctcgcgccggtggccatcgagatgagcctccccgagctccgggacggcatcacggccgccaagagcacggtgtacacgccggcgccgtcgacggccggcgcggaggcgtgggtgtggcgcctggccaaggcctacgtgaacgtgaacgactactgctggcaccagggcatcagccactggctcaacacgcacgcggtgatggagccgttcgtgatcgccaccaaccggcagctcatcgtgactcaccccgtgcacaggcttg

SEQ ID NO: 52097 - DNA, 242 bp, Zea mays
  Clone ID: LIB3067-001-Q1-K1-A4
gtacgaagcagactcgtccgcaagtccactcggaggcaaggccccgcgcaagcagctcgccacgaaggcggcgaggaagtctgcgccgactaccggcggcgtgaagaagccccacaggtacaggcccgtgacggttgctctgcgcgagatccggatgtaccagtatagctcggatctgctgattcggatgttttacttcatgctttttgttcgtaagatttctcttgacttgtagtcggttg

SEQ ID NO: 52098 - DNA, 395 bp, Zea mays
  Clone ID: LIB3067-001-Q1-K1-A5
cggacgcgtgggtgcaaagctgggtggcatgaattcgttgctccaaattgaaacatacccagcaattcctcttgtatccaaggtcccaactataatcttgggaatggatgtgtcacacggttctcctggacattctgatgtaccatctattgctgctgatgttagttctcgcgaatggcctcttatctcgaaatacacagcttctgtccgcacccaatcacctaaaatggaaatgattgactcattgtttaagccacgggaagctgaagatgatggtctgatccgcgagtgtttgattgacttctacaccagttctgggaagagaaagcctgaccaagtcatcatattcagggacggtgttagcgaaagtcagtttaatcaggtgctgaacattg

SEQ ID NO: 52099 - DNA, 417 bp, Zea mays
  Clone ID: LIB3067-001-Q1-K1-A6
gtgattcttatcctttcaaacgtggcctctaatgttcctacagtcctattgctcggtgcaagagtggctgcatcagcggcttcgatttctcatggttcagagaggaaagcctggctcatccttgcatgggtcagcaccgtggctgggaacctcaccctgctaggctctgcggcgaatctgattgtctgccagcaggccaggcgggcccaggtcttcggctacaacctcaccttctggagccacctccgattcggggtcccgtagaccatcatcgtcacggcgatcggtttgctcatcgtcatcagttactgaaacagctgaaggcagaagagcgtactgtaagagaagcagaatggataaaaatccttccaatacgaagtacatgtcaattaggcttgccctataactcaagtgtgt

SEQ ID NO: 52100 - DNA, 421 bp, Zea mays
  Clone ID: LIB3067-001-Q1-K1-B10
ggatttatcaaaatctatcaacttcgtgcacacacggagaaatcttgttgaaaatgaccgtgttttgctgaaccgtgcacatcgtgctcaacaagaatatgaaagagtggccaactattgtcttaaattagctggcgaacaagaaaagctggtgagtgaaagatggcttccggagctgagaaatgcagttcaagaagctcggaggtgttttgatgactgccagcgtgttaggggcttggttgatgagtggtacgagcagccagcagccacaattgtcgattgggtaacgatagatggacagagcgtgggtgcctggatcaacctcgtgaagcaactccacatggagatctccagacggacgctggcaatgtcatctgtaggagacgactgaagcaaccagctgtgacccagctgtggcttt

SEQ ID NO: 52101 - DNA, 390 bp, Zea mays
  Clone ID: LIB3067-001-Q1-K1-B12
cggacgcgtgggggcgccctcgagtgcggcgggaacaaccccgcccagatgaacgcgcgcgtcggctactacaggcagtactgccgccagctcggcgtcgacccggggcccaacctcacctgctaggctagctaggcggcatcggtggacggcggggccttcaggccttgtgctcggcgtcgcaccctctcgcgcgcgaaaccgagcaatagtgacaataaaacgcccgggctagctgagcctgtatgttcgacctgaataatgaagcagctgtgtgatatgcatgttgtttcgacacaacgtgtacgcttgcacatcgcttgtactttacgattgcattgcatgcaacaagggtttaaaggctgaatcaataaacggtgtgtaggcaaa

SEQ ID NO: 52102 - DNA, 377 bp, Zea mays
  Clone ID: LIB3067-001-Q1-K1-B2
cggacgcgtgggcgaacctgtgattgattattactccaagaagggcttagtggtgaacctgcctgcagagaaaccaccgaaggaagtgactgctgaggtgcagaaagccctctcgtgatgaaatgtccactcttgaggttaaacatgacatctaccaaaacccctttgtttgggtttcttcaaaatttgcactaggccaacatcatgaggttttttattttcagtatccttattgtgcggatgcaccatttttttgttatcacacctttcacaagctcggcaattgtctgaataatttctgtgtctaatgatggaactgtttttcagtaacaaactgatatgattacaacaattcatctttgggaaaatttccctgc

SEQ ID NO: 52103 - DNA, 427 bp, Zea mays
  Clone ID: LIB3067-001-Q1-K1-B3
cggacgcgtgggtggacgacaagttcaaggagatcgttgtggaccaggtcggggatcgcgctaccagctacgaggacttcacaaacagccttcccgagaatgactgccgatacgcgatctatgatttcgactttgtcactgcagaagatgtccagaagagcaggatcttctatatcctatggtccccatcctccgccaaggtgaagagcaagatgctttatgcaagctcaaaccaaaaattcaagagtgggctcaatggcattcaagtggaactgcaggctactgatgcaagtgaaatcagccttgatgagatcaaggatcgggctcgctaggcatcatgatcatgcatcatggactcggcctactactgtggatttgtatgccattatagacttggtgctgtgaaagactgcttgatgaattgcgg

SEQ ID NO: 52104 - DNA, 331 bp, Zea mays
  Clone ID: LIB3067-001-Q1-K1-B4
gcgtctggacttgagcaacaatttcatatctgggagcattcctgattcgctgtctagaatggagaatctggaggttctagagctttcatccaataacctcagctgcgtgatttcgatacccctgacggagctcaccttcctgtgcaagttcagcgtctctaacaatcacttggtggggcatatcccaatcggagggcagttcctgacgttcttcaactcgagctttgagggtaatcctgctctgtgccgatcacgtgcctgcatccacctgattttgtccagtgcaacttctaatgacacggacataaagtacgagccacgtatgacgaac

SEQ ID NO: 52105 - DNA, 74 bp, Zea mays
  Clone ID: LIB3067-001-Q1-K1-B5
attcggaagacgacgcatatcttgccacgcgttcacatttagatcgagggagtaagtgagagtgagagccatta

SEQ ID NO: 52106 - DNA, 418 bp, Zea mays
  Clone ID: LIB3067-001-Q1-K1-B6
cccacgcgtccgcccacgcgtccgcatcccttcacatttcccattccctccctcgttgatcccgcattcgtctatggcggctgcactgggcgccgtgctccggcggctgcatacggcggcggcgcagccccctcgcctgacgaaattcgcgctgcacccgcccaaattcaatttctcagagtatacagcccagcagttgatagcaaaatccgatcagtgggcggtgaaaaggttatatttggacgacgacatgttgggataatgtcagctgaatcagtaggaaactacggagtccggatactctttgatgacttgcacaagacagggatcttcacatgggattacttgcaccatctcggttcagacaaattcagtctgatgagaaattacatcagaactttgagaaagcatggtctta

SEQ ID NO: 52107 - DNA, 307 bp, Zea mays
  Clone ID: LIB3067-001-Q1-K1-B7
actgacgcgagtatcgacgacatgttcttagatatcgttgtggaccacttcgaggagggcgctaacaactacgagggacttgacaaacatcctccccgagaatgactgcctatacgctatctatgattgcgactttgtcactgcagaagatgaccataacagcatgatcttgtatatcctatggtccccattcttcgccaatgttaagagcaagaatctttattcaagctcaaaccaataattccagaatgtgctcaaatggcattcatgtagaacttcatgctactgatgcatgtgaaatcagtct

SEQ ID NO: 52108 - DNA, 371 bp, Zea mays
  Clone ID: LIB3067-039-Q1-K1-F9
ctgtagttcaggacccagatctaggcctggtcattcagctccaaggtgatgggcgcaaggatgtttctactttcctagttcaagctgggattgcgaagaaagagaacatcaagattcacgggttctaagggacctgtaaatgcttgtgccctatattgtgtgccttcacatattggggagcttgaagcatcgacaagttactagtcattgcttacttatataagaacataagtagtatttgctattgtcaagtgtgccttgcttgattcaagttgtgttttcgtatcattattattattcacggtcatcgtacgtgtatggcttgtatgggttattgccaacttaataaaagcacactctgtttgcctatt

SEQ ID NO: 52109 - DNA, 399 bp, Zea mays
  Clone ID: LIB3067-039-Q1-K1-G11
cccacgcgtccgcccactcgttcgctcaagtcctgcagtgtacatggactgtggctgctggccatgatccttcttgcatcgtgtgtcgttcatgctcacattattaatgggcggcaaagcaacaccgggagcctcactatgaccacgacgggggaagcaagcatgataattggagatgagaaagatgcaatttgctatataaaagccgcattgtattgctgcaaaaggactatacagtgctatcaggacatagcgcaatgcttgaggaactgccgtaaaaatgtctaacaagaggctatgctttctccaactcgtagatggagatcataaagatgttacgttagacctaatcatgcatagaccggaggagaaatataagctaattagcccattcaaaaa

SEQ ID NO: 52110 - DNA, 452 bp, Zea mays
  Clone ID: LIB3067-039-Q1-K1-G2
ctctgctttcaccccccgcatcgaacctcatccccgatctgatcgaatcgaaggctgcggcggcgattggcggtgaccatggcggtgggcacgccggcggcgacttccgccagaaggtatggagcatgacgggcggcccctactgccgccccgtccactggcgccgtaacaccgtcatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggacccttcaactagcatgaagtgtgtgcaccttgcttttgccttctttttgtggaaacctgtgcctagccataatgctggggtaagtgttaggagcatctctggaatgcttctcgtagtatcttttggatcttctt

SEQ ID NO: 52111 - DNA, 412 bp, Zea mays
  Clone ID: LIB3067-039-Q1-K1-G4
acgcgggtgttggcttcctgcagttctgcaacctgaacagcttccgaacaaaattcatcctggggttgtctttgtttatgggtttgtcggtgccacagtatttcaacgagtacacttccgtagcaggctttggcccggtacacacgcgtgcaagatggttcaacgatatggtcaacgtggtattctcctcgaaggcgttcgtcggcggggctgtggcgtatttcctggacaatacgctgcatcggcgagatggcgccgtgaggaatgaccgttggcaccatttctgggacaggttcaagtcctttaaagacagacccgcgcaaccgaggaatttctacttcctttccattcaaccttaaacaagttctttccggtccttctgaaccttattgcctggtaactgaaaaatgct

SEQ ID NO: 52112 - DNA, 449 bp, Zea mays
  Clone ID: LIB3067-039-Q1-K1-G5
ctcaccccttgcgttctacctcttgcattctcttttgttcactccgcgtgttctctcgctcgcggcctcaccctgctcgctgtatcccactcgacggcgactgggcgacaaccgatgtctccctaaacctggtgcctaggtatctctgccggcgacgagcacctgccagctgcaggggtatgggaatggaggtcgttggtgctgaagcagcaccagcagagatcaaagtatctgatgatgtgaatctattccaatagaaggaaagcgaagcaactgcaaaagaacgtgaggaggcagctgttttcggttcagagataactaccaatgtcaccgatctggcaccttcaaaggatgtgaaggatgagtggcctgaatctaagcagacttatgccttctacttcatcaaggtccgctcatttgaggatcttaaactgagggcaaaaatcgag

SEQ ID NO: 52113 - DNA, 456 bp, Zea mays
  unsure at all n locations
  Clone ID: LIB3067-039-Q1-K1-G6
cccacgcgtccgataacttaagaccatcgacatttatttatccgagtgatgagcgtatatgtggaagcacctgtgttttcgttgctttacatagctcaatgttacgtcttggaaggaagaggttacttcgtctggtcgtcagtttgaaccgcctggcatgcacatgatctatcttccatactccgatgatattagatatcctgaggaagttcatgtgacttctgatgatgcaccgcgtgcaacagatgaacaaatcaagaaagcttcgaatatattcaaacgtattgatctgataaatttctctgcatgccaatttgctaacccagctttgcaaagacactatgggatcttggaggccttagctttaggcgaagatgagatgcctgatataaaggatgagaccctgcctgacgaagaaggctngtctaagccaggggtagccaatgctattgagga

SEQ ID NO: 52114 - DNA, 435 bp, Zea mays
  Clone ID: LIB3067-039-Q1-K1-G8
cccgactcacgaatcccagagagcctccatggcgacgcaccgccactgcctcccactcctgctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgtcgaccccgccggccgcaccgtgccctacgtcgccgtcgtgtacgagcaggtctggacccgcacccgtcagctcgcctccttcaacccggtgccccgcgccccctgaaaccatacggacac

SEQ ID NO: 52115 - DNA, 423 bp, Zea mays
  Clone ID: LIB3067-039-Q1-K1-G9
cccacgcgtccgggagcgagaggcgaagcagataaggaagccagccggcaaggggagccggtccggcgtcgagaaacctagggcgagcgcctcgacgactcctatcaccccatggcggccttcgctacgggcagcaccacagcgcgcgcgacgctggcatcgccgacttcgtgccagccggccgcgcgccgggcgccggcccgatggatgccgctgcgctgctcgccgccggccctgggcctcaggggaggagcgcgttctcggcggagcgccacgctacgggtggaagctaagaagcaaactttttcttcatttgatgagttgctggagaagtctgagaagccattgttagttgacttctatgcaacttggtgtggtccatgccaatacatggttcccatacttcaagaagtgagtgagaag

SEQ ID NO: 52116 - DNA, 427 bp, Zea mays
  Clone ID: LIB3067-039-Q1-K1-H11
aaaaatatccccaaaccctagctcccgatctcgatggcgaaccctcgcgtggtcttcgggatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggca

SEQ ID NO: 52117 - DNA, 383 bp, Zea mays
  Clone ID: LIB3067-039-Q1-K1-H12
aaattgtggaatttaagatctctagttttgaaatccttacaccaatgtggcctctatgagaatgaccagaagatccttgattcctctaatttccaggttcttttgaaacctattgtctcccagttcgctgtggaaccaccaaaatctgttgaatcagttcttgacgctccatcaattgaagaagtagatgaaactataattctgtgcttgttccaaatggcattaactgcacggtcagatgttctttggaagcctcttaaccatgaggtgctgatgcagactacgagtgatgaaattcgccccaaaatgctaggcctgaacgttatcacgtacatggtccaacatctgaatgaggagtatgtcgctctagtaccacagaccat

SEQ ID NO: 52118 - DNA, 411 bp, Zea mays
  Clone ID: LIB3067-039-Q1-K1-H2
cccacgcgtccgcatttattgatctacttacagatcttgtgaaatggctcagttgcatgtgtttgcccatgcttcctcttttacatacatattattatgcgaagaatacaaaattgctctggccaatcctttaaactttgtattttatatatatgcaggcggaagcgcttgttaaagcccaagatgatcttagagaaactacaggtcacttgggaatgacattgattaagctggcaaaatttgaaagagagcaggcaacatgtaattccctaagaagacgtgctggtgaaatccataattttgcaaattctgttttaaagatgagcaggtcacagataaaattaaactctgaaatggtgaaacacctgtgcaggatccatgaatacttggagatgatgatatcagtttatc

SEQ ID NO: 52119 - DNA, 396 bp, Zea mays
  Clone ID: LIB3067-039-Q1-K1-H3
gctcaaatttgcttgtgggacattaaagcaatagtagaaacaaaagtcttgacgccttgcggatggttaagcatcatgatggtgtcgttgaagatgttgcttggcacttgaggcatgagtacttatttgggtcagttggtgacgattatcatcttttgatttgggacctgcggtctcccgcccctactaaacctgttcagtcagtggtggcgcaccagggtgaggtgaactgcctggcttttaacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactgtac

SEQ ID NO: 52120 - DNA, 123 bp, Zea mays
  Clone ID: LIB3067-039-Q1-K1-H4
cccacgcgtccggaatttggtgtacttgttaatgaaaattcggcttggacctgtgaaatgggtatgatctaaaatacggctggtctgatcctgaatgcaaccgcacaagagattgatctgtct

SEQ ID NO: 52121 - DNA, 443 bp, Zea mays
  unsure at all n locations
  Clone ID: LIB3067-039-Q1-K1-H5
cccacgcgtccgcccacgcgtccgacggcaatgacatcaggatttgaaagtggcagccctagcattgctgaagtcttctgcgggtctcatagccaagcagaaagtcaggatgatttggaacatgagagaagagactggcaacgattttcccatgctgtgattggagaggaatctgaaagaacttggcgtgaaaatgcagacatgtcatctcatgaggggacagcagttgaagatgataataacgatcatcttccagaagcaaatgaagagtcaaccagtgttgatcaccttcctgaaggacttgaagggtctatcactgatggtagtcttcctgaagcgcaagaagatcagcatgacagtgatcatcttnctgcagtgcttgaagagctgattggaataatcactttcaagaatcacatggggaatggagaaaagatgatcgt

SEQ ID NO: 52122 - DNA, 459 bp, Zea mays
  Clone ID: LIB3067-039-Q1-K1-F8
cccacgcgtccgcccacgcgtccgcgccgtcgtccgccccctccgcgacagcctccgagcggactcctggacctgggtgagcgcatttcaactgcgcccctcccctccgccgcagcacccagcccccttatgccatcccgctggtctcaacagctacactgtgttctctcgctcctcaccctgggtgctctgtaccgtcgtaccgatgctaggcatggacggacgtcaaagtgacttcccctcaactctcgcgggtggccacatataaattgtccctaaataaaacgacgctgcaattgacgtcttcaagggaatcgacaaacccttttgtggagcaggccatacaattctccgtagcagctgctaaagcgaccattattgataaggagaggaaggatgtagtagataagttactgctgcaaggtctgaacattacaattattggtcacaatgatttct

SEQ ID NO: 52123 - DNA, 246 bp, Zea mays
  Clone ID: LIB3067-039-Q1-K1-D7
gattcttgtaactatccgtaaagtcttagatcattagattttagtttacttgtaaagttggtaaatcgtcatttcctgtcttgcttatcagtgagttacacacgtttagtgcttttatcaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaataaaaaaataaaaaaaataaaaaaaaatattt

SEQ ID NO: 52124 - DNA, 412 bp, Zea mays
  Clone ID: LIB3067-039-Q1-K1-E11
tcgcggactcgtgggtcccgaccagcctcgatggcctggtcctgagatgcgaggacacgtcgggcctgtacgtgataccggtctagctagagaggttggttctggcgaatcctctggcgcggaaagggagtagggaaaaaaatgccttgacgtttggtttggtctccgtcggttgttagggttggaaggatgtgcaaatgcagggtgtgattattgggctaagtaagtaagtataatatgagtggtcggtcggttacctggagcttgatcgtgatagtatatggtatgtaatttcctcttctcttcttttggctgagccatggatggtgtgcttgtaacaaggatggcttgatgtcagtatactaccctaccataccatggagcatatttggagattcagtgggtttcagtc

SEQ ID NO: 52125 - DNA, 337 bp, Zea mays
  Clone ID: LIB3067-039-Q1-K1-E12
acggatcgacgtcgtcatcgacatgggaaaccccttcctcaaccgcaccgtcggcagcttgggcaagatcggcgccttcggcgcctgcaaggtggctgccgaggagaccttcgagtgcctccacaggggggatgtttcgaagcacaaggttgagcatgccctgacgaagatgtgcaaggagggcccatattggcgcactgttgctggagtttatgtgatcatggtgtacggcgtacaaaggatccgtatccgcagtgactggaagaacgcgattatcggaggcgccttgtccggctccctgatctcctgctccagcaacaacgacagatgcaatgtc

SEQ ID NO: 52126 - DNA, 287 bp, Zea mays
  Clone ID: LIB3067-039-Q1-K1-E2
attgcttctgaagacgatactaatatggatgttgatgttgtggctttgatttcaatcaaagattgatgtttagacacagttcgttacttacaacaagccaacaaatggaaacagattgatcaaattgtctccactacttattgaaagggaaatgtgcccttgggctatttctaagtattttggtgattaagtgtccaacacaagtgcctaagtgttaaattataccaaggactcaagaagtgaaaatcaacataaaggtatttttctaagacttagtactttgtttt

SEQ ID NO: 52127 - DNA, 350 bp, Zea mays
  Clone ID: LIB3067-039-Q1-K1-E3
gatcgtagcgttgcgtccctaggagggaggggtccggcaactcggtgggaacatgtggaagacgcctgtgcggatgaatgcggtcgtgtactcgctgtcgccctttcagcttaaggttatgcccgggctgtggaaggacatcaccaccaagatccaccacaaggtcaccttttacctggatctccgtcacgctcctactcaccctcgtcttttgcacctactaatacgccttgtggtacaaggagcatgagaagctttcccacagatattaaatgcgctttccttgacagacagcactcgtagttttcatgattggtttcataatcctcccatgatgatttaacatttgt

SEQ ID NO: 52128 - DNA, 441 bp, Zea mays
  Clone ID: LIB3067-039-Q1-K1-E7
gctgttcaactcttcagtcaacctaaaagaaccagtggtggaagcattgataaggaatcaatccatatggatgtgacatgtgaaacatctccacagctgaacctgcccccaatatttgcaaagctttttccaaaacaatctgttccagtaaataaaccatctactctgcgtactgaagatgatcaacagtcagcagatggggagctggtatttgaattttttgaatatgaacagccatactcacggcgacaattatttgacaaggtaaatgagctgattgccggtgcgaaaccgtcaaattgccaaatatctggggacccaaagaatctggaggccagcctgcatgatctccatccagcgtcttggtattgtgttgcatggtatcccatataccggatacctgatggaaaattccaagctacattcttgacatatcactct

SEQ ID NO: 52129 - DNA, 439 bp, Zea mays
  Clone ID: LIB3067-039-Q1-K1-E8
gagcacccctcgagatctctccctccccgcgccgccatggacgcagttgactcggtggtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgtaaacctcaggctagtggctgcaggagtggacaatggcgtcactaccttggaggcagcaccgttttcagctctgatttccgcaaagcaattcctttaggacttgtgttgttaaagggcaactcccttatcttttcctctcttgaggtcgtgtggtagatctggaactcttttgtacctggtgtcgaata

SEQ ID NO: 52130 - DNA, 406 bp, Zea mays
  Clone ID: LIB3067-039-Q1-K1-E9
tcttctccaatccatactattctcaatctgctgctactccgaacccagacgatactgggaccatatctctcctgtactgtagcttactcccctatccagaaccttatatctcaacctgcaaattggcagatccataccctgctgacccatatctctgctccgaccatgactgaccgccacagcctgagccgtacccttctgacccatatctctcattcacctacgatctcattccatatccagagccgtatctatactcctactgcttcttcctcccatacccggatccgaatccagatccatagccaccatacctcctacgcaacaggctcgttcctgaatccgtaacctcttccgtaagaccgcttttgatactgctttgatcagaacccatatttggacttta

SEQ ID NO: 52131 - DNA, 423 bp, Zea mays
  Clone ID: LIB3067-039-Q1-K1-F10
gaagaaaaagggaagaattatcaatatatcatcggttgttggtcttactggtaatgctggacaagctaattatgctgctgccaaggctggggttattgggttcacaaaaacagttgctagggagtatgccagcagaaatattaatgcaaacgttatcgctcctggatttattgcttcagatatgactgctgaacttggtgaagagttagagaagaaaattctgtcaactattcctttagggcgctatggtcggccagaggatgtagcggtcctggtggaattcttagccctcagccctgctgcaagctacatcactggacaggtcctcaccatcgatggaggaatggtaatgtaaggcttcgaatctgtgccgctggcctctaatgtgtcgcagaaaaaaatgtaattcagttttttgagtgt

SEQ ID NO: 52132 - DNA, 425 bp, Zea mays
  Clone ID: LIB3067-039-Q1-K1-F11
cgattgggtgccggtttgccaaggacatggaggatgcgagcggcagctcgtcgtctccagccgtcctacggaacaagtattgggtcctccgccacggccgcagcgtccccaacgagcgcggtctcatcgtctcatctctggagaacggcacgaagccggagttcgggctggccccgcagggggtcgagcaggcgcgcgtggccggcgaaaagttccggaaggagcttgacgagattggtgtgccggtgggttccgtcaagattcgttactcgccgttctcacggaccaccgagacggctagagtggtcgccggtgtgctcggcatcccctttgaagctcctagttgcgaagcggtgctgggacttcgtgagcgctactttgggccatcatatgagttactttcacatgataagtatgcagacata

SEQ ID NO: 52133 - DNA, 272 bp, Zea mays
  Clone ID: LIB3067-039-Q1-K1-F12
tggtgaaaatcggaagaactattgatgcaattaatttatcgtacctgttggatcttactgaacactttgaaccagtgcaactgcttaaagcatatctgacggatgttaataaactgtcacatgccaagaatgtcaaaatttctactggagcacacaatgagatgaatgatcgtgagttgtgtgcactgaaatctgtcattaagtgcatttaagatcataaacttgatgagctacaccctgtgtacccacttcaaaaataggtttttcaacta

SEQ ID NO: 52134 - DNA, 375 bp, Zea mays
  Clone ID: LIB3067-039-Q1-K1-F3
ccacgcgtgcgctgggtagtagggtactagtagcactaggggcttaagcaagctaagctgagtgcgcctcatcagaatcacagtagctcgcaccgcactctctggcttctcgtcgatcgtcttcgtcgtcctcgctcctccgacccacatgatggctagctctccatgtgccgcttctcctctcgcacgtgccgcttctcctcttgtgttcgatatgttgtattgtttccatgtaaatttagtcggtggcctggatcgagttggctagctctctctacaggcaagagacaaccgaccgaccactactatcttagagcaaattgattatcgtcatgatggtgtactgttcaagcttttattaacgacttttaattt

SEQ ID NO: 52135 - DNA, 458 bp, Zea mays
  unsure at all n locations
  Clone ID: LIB3067-039-Q1-K1-F4
cagggcgatccagagggcgaactgcttccacgtggaggggcacggggacccctgcaacatgtccggcacgccctacatgatcatcttcggcgtcgtgcagattttcttctcgcagatcccggacttcgaccagatatcgtggctctccatcctcgccgccgtcatgtccttcacctactccaccatcggcctgggcctgggcatcgcgcaggtggtgtccaacaagggcgtgcagggcagcctgacggggatcagcgtcggcgcggtcaccccggtcgacaagatgtggcgcagcctgcaggcgttcggcgacatcgccttcgcctactcctactccctcatcctcatcgagatccaggacaccatccgcgcgccgncgncgtccgagtccaaggtcatgcggcgcgccaccgtcgtcagcgtggccgtcaccacgttcttctacatgctgtgcgggt

SEQ ID NO: 52136 - DNA, 400 bp, Zea mays
  Clone ID: LIB3067-039-Q1-K1-F5
caccacccgaagctcatccaagagagatcgacggacagcctcaattccaagtacctgaatcgcttcaatcagatggttacttgttgtccttgtagcatcaacatcctcgtgacacatgacagctaaaagattcacaccttctgtatcaagcatccattcattagctgctttgaaaccgtcatcttgatagaaggtattgaccttcccttctttgatgaacactttgttgatatctggaatgcctcgaagcgccatctctgtcaacatattgccctctatcttttttaggaagacatcatcctcagcagactcatcttgtatttctcctttttggagcttcatcatttgtgatgcggatactgaggataagcttatccccattatcaataattgaaatgca

SEQ ID NO: 52137 - DNA, 432 bp, Zea mays
  Clone ID: LIB3067-039-Q1-K1-F7
cccacgcgtccgcacctccccgtcgctctcacgctcttcgtgcccgccgcctcccctcttcgcctccacctcactcctgccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggccttgatgagcacttcgacattagcgtggaggagtccaacgcgcatacaattg

SEQ ID NO: 52138 - DNA, 291 bp, Zea mays
  Clone ID: LIB3067-039-Q1-K1-D5
aaaaaaaaaaaaaaaaaaaaaaaaaaaaaattataaaaaaaaaaaaaaaaaaaaaaaggggggagaaaaaaaaaacgagcgggagcaaacaaaaaaaaaaaaaaaaaaaaaaaaaaaccaaaagggcaatcactttaaaggaccaaaacaacgctttgactggtaaaacccttaacgatactaatctgaatccccaaaaatcaaatcacggtttcaccatttaaaactataacgatgagaaacccaccgatttcccaaactaacatttgctcaaccataaaccgctaatgg

SEQ ID NO: 52139 - DNA, 441 bp, Zea mays
  Clone ID: LIB3067-039-Q1-K1-C1
caacttcagctgcgcctcgactcgtagcccgaaccctagccaccaagccggaggcgagagagcaggcatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgttggcgtctccgtcgacctctacaaccagggatccgcgactgcctatgatgtgtccattaatgacgactcttggccaacagaagtgtttgagcttgtcactggagaaaaaatcgaagacattggaaaggcttgaccctggtgccactgcttcacacacatatgttctggagacaaaacacaggcatgtttcagggttcaccagctatcattacataccgtgttcccacaaagacagct

SEQ ID NO: 52140 - DNA, 427 bp, Zea mays
  Clone ID: LIB3067-039-Q1-K1-C11
cccacgcgttcgcccactcgtccgcccactcgttcgcccacgcgtccgcgcactcgtcggcaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcatttggagggactgtttcatgggaaggagaaggagctccatttaaagaaatagacgaagatatcactcaccaggttgattccatttgcaataatttattacaccaaagtttaactatatagacggagacattgtgtaccatccctaaagtaagatgccactctaagtaccacgacagcaatgccatactagggcaatagttactaca

SEQ ID NO: 52141 - DNA, 425 bp, Zea mays
  Clone ID: LIB3067-039-Q1-K1-C12
cccactcgtccgcccactcgtccggcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttgtttctggtcctagtgtatgcatgc

SEQ ID NO: 52142 - DNA, 305 bp, Zea mays
  Clone ID: LIB3067-039-Q1-K1-C2
aagaagcctcagttttggcatccagaagcaactggccatggaaagcagtgggatcggcagggtgggcccccttgaggccgtccgcttcgacatcgacggcaccatggccatctccgacccgttccaccaccgggccacctcggagatgctcctcaaggtgggctacaacaactgcgtgcccatcacgcccgagttctgcatggcgaacatggccggccggagcaacgagcagatcggccgcttcctgttcccggactgggaccagcgccgtctctacgccttcttcgcctagaaggatgctctct

SEQ ID NO: 52143 - DNA, 383 bp, Zea mays
  Clone ID: LIB3067-039-Q1-K1-C3
cacatccaatcagaatcggcacacctatgataagcccgtaaaaatttataattgagaaacgggtcggcaaagttcaatccattggcaaaggcgtcgacaacagcatgcccaaggtgatacgacgcttcaaacagaaaaatctggtatagtatttgcctgtgctgaggcctgcaagcccaccaatgctgcttccaaccttcattgttccaagcaaccaagcatgtgtttggtttttcttcgtcgtgtcgagtatgacggcccctgacagggtaagtgtttgcttagtttgtagagcaaagctagcacataagaaaaaatattttggtatgggtggggggcatgtatacaggattgtagccgattctgattgctgaatttgcacc

SEQ ID NO: 52144 - DNA, 392 bp, Zea mays
  Clone ID: LIB3067-039-Q1-K1-C5
gcataccttcgaccagaagaggctcaagcatccactctaccgtcacccatgggagggtgtgctgtacaccaagtgagggagccattctttgcaaggcataataaagtattattatcgcctatagcttacagttgcctagcttccagatgcctgtacacttcattaaatcgagcacttgcaaaaaagaaagccagagagaggaagacgaacatcactagtcagcactagattgtgtgttttatgttgagttgcaaattcatgtcctgatttttgtcctgccatgaaccgttaggcgatattgtattggaaaggatgcttccgctattgtttcacgatataccgcctcagagtagaagtttccagttaaaatgaactctgattagttcgtcgat

SEQ ID NO: 52145 - DNA, 385 bp, Zea mays
  Clone ID: LIB3067-039-Q1-K1-C6
cgagtttttcgctagccgtcaactcgtaacaatattttcagcccctaactactgtggagagttcgacaacgctggtgcgatgatgagtgtagatgatacattgatgtgctcgttccaaatattgaagcctgcaaggaagatgatgggtggttcaactaataacaaatctggcttcaagtcattcatgggatggtgacaacggcctgatggtgggcacgctgcgttcgacagggggtacatcttacagcggctgcaactaacaggcatatgcattttcgcggaaacctgcttgggccttggaagggcaaagcagatgtagaactgtgcatcttccatgttggattaacacttgatgtaatgtattgttatcggtttttaataaaaa

SEQ ID NO: 52146 - DNA, 450 bp, Zea mays
  Clone ID: LIB3067-039-Q1-K1-C7
accatgaatgcctgcagtttgcttgcgtccatttcgctgtcactctgctgcactgtcgccgtaccatgtagtattatgatgcatggtgctccagtttgtcattagtccatgacaaggggctcggttagtccacagccctagaggctgcagctgcacacttcccttctctgttttcgccggttaaactttccccacttgttgctggccttcgaatctgcggtttgtttgagcttagcagggaagcgaagaacagggaagcaaggacatggatgctttcagtgcagtgatggacaaggtaaagagccacccagaaatgatggagaaggtaagtgcagtgatggacaaggtgaagaagagccacccagaagcggtggaaaaagtcaaggaccaggtgaagagccttgctgacgctcttcacctgcggagacatggatccaaagataaagaacc

SEQ ID NO: 52147 - DNA, 431 bp, Zea mays
  Clone ID: LIB3067-039-Q1-K1-C8
acagaagatgtggatggtactgccgaggacatatcagcaacttctggaatgaagcgtaaggtgaacgaaatattagagacaaaggagaactttgatgctctcgaaaatctttcgggtgttgattccagcagcgctcaagttgttgaagatgacaatgacgatgaccttgttatgtttgatgaggacccaaggcaaagtaagaagaagagattgcagtagcatcctgctgcggcgataacagctcttgactcccggcatcgtggctaacacattgttcgatcgtaacatctttgataacttatttatgcggttatgtaccaagttgatgttgaaacattagtaacaatgcccagggcaccttttggcctcagatagtcagataccctgtagggttgtaatttgtaggaattaggaacaagagcaactaatgc

SEQ ID NO: 52148 - DNA, 325 bp, Zea mays
  Clone ID: LIB3067-039-Q1-K1-C9
cccactcgtccgaaaaaaaaaaaaaaaataaaaaaaaaaaaaaaaaaaaaggaaaaaaaagaaaaaaaaaaaaaaaaaaaaaaaaaaaaaaaaaaaaaaaacaaacaatataaaaaaaaaatagataacgcaatccaaaattacaacgatttacaactcctaaacaggaaccaaaactgaattaaccgaacctcttaaaaaaacatcacatactggaaaaaaccaaatctttaccaaactaaaaaccctggcaaaaaacaccttaattaccagctttaaaaaaaccaaaaagacccatacccatattcataacaaacattaacca

SEQ ID NO: 52149 - DNA, 295 bp, Zea mays
  Clone ID: LIB3067-039-Q1-K1-D1
tagactgttcaatgcttgtcatggatgatgcatactttctattagctccatagttccatccgtctgtggaatcacttatgtgaggtccttccacctattctgcatctttttatgttatcatcatcctctcctgtaactttcattgaattcatagataaatatactcctataccttattttattaatctaatgtatttactttttcttttttttttcacactttttttttctttttttaataaatgcattaatttcattgtctgaatactctttttttataactttaattttattc

SEQ ID NO: 52150 - DNA, 409 bp, Zea mays
  Clone ID: LIB3067-039-Q1-K1-D10
attggatacaggtctcgtatgtccttgacactgaagacttctcgtcccggcttcctaagagaaggaaaatacttcggagtggaactgtgtctgacagtctctcagatttcaacagtatatgctgcaaaagtgcaccgcttcaatatgttcctatccaaagcataagatcattagtcctacaaactgtcatcatcattgtatctaaacctggagatattgctgagaccccagctgctttgcttcttcaaccataatattcagcagttggcagatggtgactccatcgacattcagtctcataacgccctttttgaataacaaatggagagatctatagggtaaatacagcacaacgaatcgagcatgtaagccacaacactcatctctgatgtgcggatagatgtgtata

SEQ ID NO: 52151 - DNA, 415 bp, Zea mays
  Clone ID: LIB3067-039-Q1-K1-D11
aataagcccagattcgttgcgcttggttggaatgcgaactgcttcgatgggctttgaggtcccatattgcagggcacatgggactggaaagtgggagtggaaattcgagaacaagccggtaaacatatactatgaggaacatgagcaggaggttgctgagaatatgaagaacattctcatgatccctacgatctctgatgtgagcactgtggaggagtggagggtggttgccaaagatattgttgggcggaaaggagaacttggctaccgtgttacaattgtcgattggcctggtcttggttattcagataggccatcactgaactacaatgctgatgtgatggagagctttctggttgaactaatgaattcaccaaacagtccagtcgcaaatgcagatgatgaactgatcatt

SEQ ID NO: 52152 - DNA, 456 bp, Zea mays
  unsure at all n locations
  Clone ID: LIB3067-039-Q1-K1-D2
cgcgagaagcgccggctgtcgaaccgcgagtcggcgcggcggtcccggctccggaagcaggagcgcctggacgagctggtgcaggaggtggcgcgcctgcaggccgacaacgcgcgcgtggcggcccgcgccgccgacatcgcgtcccagtacacccgcgtcgagcaggagaacaccgtgctccgggcccgcgccgccgagctcggcgaccgccttcgctccgtcaacgaggtgctccgcctcgtcgaggagttcagcggcgtcgccatggacatccaggaggagatgccggcggacgacccgctgctgcgtccctggcagctgccctacccggctgccgccatgcccatcggcgccccgcacatgctccactactgatgattgcctccaccaaccacaccaccatacatctgatgctgtcagctggngctggttggcaacaagacaagaagaatt

SEQ ID NO: 52153 - DNA, 422 bp, Zea mays
  Clone ID: LIB3067-039-Q1-K1-B9
agcgaccggtccagcactttcacgctcagctccagcaatggctgcctcgaccatggcagtctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttca

SEQ ID NO: 52154 - DNA, 336 bp, Zea mays
  Clone ID: LIB3067-026-Q1-K1-A11
aacagacatacacacacacttacagggcgatataatcccgagcctggagatccccgacaaggtacgccatcatgcatctggtcacgttgcgaccatggagctcaacaccgaccaaatctaccgagactacatgctcgattccgaagataactggaattgccagctcgaaaacattaccttcaccgccaaatatggaaacgttccacagatccatgcacgtcttcatcaaactatgcctagtcatatttatgattatacctgatatgctcaagaacgctaccatgttcaagctcttggaaactacaattaatcgcaaatgatcacctattacaattt

SEQ ID NO: 52155 - DNA, 436 bp, Zea mays
  Clone ID: LIB3067-026-Q1-K1-A12
ccaggctgattctgctgcgctacggcttgctgctatagcctggcatgatgaactcgcccctgggcctaagccgttgctaattgtcaacattgggggccccaccaggaattgtaaatatggtgtagatcttgccaggcagctcataacttctctgtataatgtgctagatagctgtgggagtgtcagaatctcattctctccgagaacaccatggaaggttgctgatactatatttaaagaatttgctggacatcccaaggtctatatttggaatggtgaagaacctaaccctcacatgggacatcttgcatgggctgatgcttttgtcataacagcagactcgataagtatgttaagtgaggcaggtagcacagggaaacctggttatgttattgggaccgaacacttgtaatggaagttttcggcttttcacaag

SEQ ID NO: 52156 - DNA, 308 bp, Zea mays
  Clone ID: LIB3067-026-Q1-K1-A2
tcccactcttcctcccactcttccttccactctttcgaaaaaaaaaaaaaaaaaaaaaaaaaagaaaatgagaaaataaaaaaaaaaaaaaaaaaaaataaataaaaaaaaaaacaataaaaaaaaaaaaaaaaaaaaaatataataaaaaaaaataaaaaaccaaaaaaaaaaaaaaaaaggaccccctttttaaaaaaacaaatttttattacccttgaatccaattttaaaattttttttttgggaaccaaaatttaaattaatttgcccgttttttaaaaaatccaactttaaaaaacctttat

SEQ ID NO: 52157 - DNA, 427 bp, Zea mays
  Clone ID: LIB3067-026-Q1-K1-A3
cgcaactggtcgacgacgacttcctcgtctctctcctccggcctcgagtcgcctccgatccggccgagaaaacaaaacaaaccgaaagaagaaaggcgacgaggaagagaaggctctccgcgagatctgggggagctcccattctcaagatgcacgacttctgcttcaccatcccctacgggttcgccgtgctggccggcggcgtgctgggctacctccgccgcggcagcaccgtctccctggcggtgggcgccggcgccggcgcgctgctcctcctcgcgggcttcgtcagcctgaaggccttcgagaagagacgcaactcctacgtcgccctcgcgctcgagacgctttgtgcattagccttaactttcgttatggggcaaagattcctcgagacttcgaagattatgccaactggtgtcgttgc

SEQ ID NO: 52158 - DNA, 414 bp, Zea mays
  Clone ID: LIB3067-026-Q1-K1-A4
ggttggcttctctcccctccggtcgggttcgggttcgagaggttctccggggttcgggtcggggtgagcggatcgagatggcggcgtcggatgttgagtaccgtgttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaagcggcggctacggcggtggcgggcgccgtgat

SEQ ID NO: 52159 - DNA, 102 bp, Zea mays
  Clone ID: LIB3067-026-Q1-K1-A5
ggcttgtgttactgccgccactgttgtgaccggcgctgttactagtgcactgcagagatgcgagtttcttgcgaacatggctttataggtctagcttcatgc

SEQ ID NO: 52160 - DNA, 269 bp, Zea mays
  Clone ID: LIB3067-026-Q1-K1-A6
gcgatcccactcccgatcagcagctgatcgctcactcttgcagcgcggtgattctttagctgctctagctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgccccggccgccaaggccaaggggaccaacccagttgcc

SEQ ID NO: 52161 - DNA, 451 bp, Zea mays
  Clone ID: LIB3067-026-Q1-K1-A7
ggggagctcaagtcctggtccttctaccgctcgggcatcgccgagttcgtcgccaggttccgcttcctctacatcaccatcctcaccgtcatgggcgtctccaagtccacctccaagtgcgccaccgtcggtatccagggcatcgcctggtccttcggaggaatgatcttcgcgctcgtctactgcaccgacggcatctccggaggacacatcaacccagctgtgactttcgggctgttcttagccaggaagctgtccctgactagggccctcttctacattatcatgcaatgcctgggtgccatctgtggagctggagtggtgaacggcttccagcagggactttacatgggcaacggtggtggcgccaatgttgtcgcacctggctacaccaagggtgatggccttggcgctgagattgttggcaccttcatcctagtctacaccgtct

SEQ ID NO: 52162 - DNA, 368 bp, Zea mays
  Clone ID: LIB3067-026-Q1-K1-A8
cggacgcgtggatcagacagggacattgtggcgctctccggcggccatactctggggagagcgcatcgagagaggacagggtttgatggcccatggactagggatcctctgaaatttgacaactcttatttccttgagcttctgaaaggcgactctgaagggctcttgaaactccctactgacaaggttcttgtggaagatcctgaattccgtcagcatgtccaactatatgccaaggatgaagatgcatttttcagggactacgcggagtcacacaagaagctgtcaaagctaggctttaccccccctcgctcttgtctctcatccagatctgcgaataaacacaagtcgttgctggtgcaagctgc

SEQ ID NO: 52163 - DNA, 466 bp, Zea mays
  unsure at all n locations
  Clone ID: LIB3067-026-Q1-K1-A9
aagagagagagagagagacggaaagggggagatgagccggagcctggggatcccggtgaaggtgctccatgaggcagcgggtcacgtggtgacggtggagctcaagaccggcgaagtgtaccgggggtccatggtcgagtgcgaggataactggaattgccagctcgagaacattaccttcaccgccaaggatgggaaggtttcgcagctggagcacgtcttcatcagaggaagcagagtgagatttatgattatacctgatatgctcaagaacgctcccatgttcaagcgcttggaagcgagaattaggggcaaaggatcagctattggagttgggcgtggacgtgcagttgcaatgcgttgctcggctgcttctggtcgtggtggtggtcctgttgggcgaggcagcgcgccttctgtgaggaggtagattttatggtgtcatggngcttttcttggctggctg

SEQ ID NO: 52164 - DNA, 411 bp, Zea mays
  Clone ID: LIB3067-026-Q1-K1-B1
gcatcggcgccctttttttttttgtttatctttttttttagctagcaagcagaattagaagaaactagtcatagttattccagtaataattctcaaagcaagggaagaaaataacagaaagggcgcattaagttgaccagtactagggtttccatctgcagatcgaaagttaggaccaaccaaaagctaggaaacacatcaagctgcgcgtctcgccatacacaaattcatcacccaaaaaccaaaaccttcaccgtctgatctggctgtctgatccgatgtgtgggagcaagatcggtcggatcggatcggatcacgcggaagccgctgccgttcggtagcggttgagcttgccgaagatgtggaggtcggtgacgaagccgatgaagcatagggacatgacgagcacca

SEQ ID NO: 52165 - DNA, 466 bp, Zea mays
  unsure at all n locations
  Clone ID: LIB3067-026-Q1-K1-B10
ctcagcttcaaccctgcaaaagacataacaaacagttgatgaggttcgcgccacagtcactgaacttcagaatgccattagagttttcagtctgttatctgttgcatcaacgtaccactcccatggttttgatgagaggaaaatagaaactcatgttgagtactgtaaacatttacttgatgctgctaaagttcatcgtgatgcaactgagcaagctgaacagcagaataagcaaaaaatggaagttgctcgtcagattgctttggcagaagaagctcgccgaagggcagaagagcagagaaaatttcagttagaaaggaggaaggaagaggatgaactcaagcaagtaaaacaacaggaggaacacttccagcgtgtgaaggaacaatggaaaacattcagcaacacccctggcaagagaaaagatcgatctaagactgangatgaagaggtgggaaataaaaag

SEQ ID NO: 52166 - DNA, 319 bp, Zea mays
  Clone ID: LIB3067-026-Q1-K1-B11
cccacgcgtccgagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtcatcgcattcaaaaaaaaagacaagaaacaaaaaaaataaaaaataaaacaca

SEQ ID NO: 52167 - DNA, 431 bp, Zea mays
  unsure at all n locations
  Clone ID: LIB3067-026-Q1-K1-B12
cccacgcgtccgcggacgcgtgggattcatttcatctgctccatctccctctttgttcgccggcgtataataagcttcccctttctgcaactgatctgatccgggctgccgtgagctctgctcgctctgatggagttcaagagggatgtatggagcctgctcctcgtgctgctcctcgggcagctcgtcgccttctccatggccgcctcaagcttcgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatctngttgtgaaggcgtaccagtactcatacattaccagtgt

SEQ ID NO: 52168 - DNA, 426 bp, Zea mays
  Clone ID: LIB3067-026-Q1-K1-B2
cccacgcgtccgatccagaggagatgatccaaactgggatatctaccattgatgtgatgaactccattgctcgtgggcaaaaaatccccctattttctgctgctggactccctcacaatgaaattgctgctcagatctgtcgtcaggctggccttgtgaagacattggagaaaggaaagcatgcagagggtggtgaagatgacaactttgctattgtgtttgctgctatgggagtgaacatggaaacagctcaattcttcaaacgtgattttgaagagaacggttccatggaacgggtcaccctttttctgaatctggctaatgatcccaccattgaacgtattatcacccctcggattgctctaacaacagcagaatatttggcatatgaatgtgggaagcatgtacttgtcatcttgacagata

SEQ ID NO: 52169 - DNA, 424 bp, Zea mays
  Clone ID: LIB3067-026-Q1-K1-B3
ctctctggctctctctcacatgcctgcctactactccctcaagcaagcaagctgcaagaggtcaagacgagcagtgactgtgagtgagcggcgtctggtcactctggtgtgaactgtgaagtgaggacttgttggaggaggacggagcgcgggccgcggagggtcatggcatggtgatggacctgctgctccccctcactttgcccctagtgctctaggcagccttagctagcctcgcagtcctgggaggaggagaaggacaaggtctctgatcagctccagcttgtctggtcaaagctgaggagcctgcttgggctgcctgtgagtccaagctcgacaggaccactgccactgtgaagcacagcggcagcggcgacgagacgaggacgcggaagctgccaagcggatagatctacgcaaaatg

SEQ ID NO: 52170 - DNA, 467 bp, Zea mays
  unsure at all n locations
  Clone ID: LIB3067-026-Q1-K1-A10
cccacgcgtacgcccacgcgtccggcgcaagccagtgccgcgcccagatctccgcgacagatgagtcgttcgtccagctaactgcactgcacgcaatggccaccacggcgaccgaggcgaccaagacgactgcaccggcgcacgagcagcaggccaacggcaacggcaacggcgagcagaagacgcgccactccgaggtcggccacaagagcctgctcaagagcgacgacctctaccagtacatcctggacacgagcgtgtacccgcgggagccggagagcatgaaggagctgcgcgagatcaccgtcaagcacccatggaacctgatgaccacctncgncgacgagggccagttcctcaacatgctcatcaagctcatcggcgccaagaagaccatggagatcggcgtctacaccggctactcgctcctcgacaccgagctcgcactcccggaggacggcacgatc

SEQ ID NO: 52171 - DNA, 361 bp, Zea mays
  Clone ID: LIB3067-025-Q1-K1-G6
acgcccacgcgtatgtcgagacgttaatatcgatctctgctgacactattctctcaatgggactggtgttgtcactgggcagcgtttaacatggtgactttgcagaggagtccgtcaagagcagaacgaacgctaacattgcgagtactgtgacgccgtgcatcgaaagggtgaggatcaatgctcaatgggtcaacaacatgaaggacgaggctgactttggcaatgttctcaagaacctggcttactagcactgatcatagaggctccacttagatttctgggttattgctaatacctttatgtaaccttgttctttggaattagtcgattaataattggcacttttgtatgtttatta

SEQ ID NO: 52172 - DNA, 436 bp, Zea mays
  unsure at all n locations
  Clone ID: LIB3067-025-Q1-K1-G7
ggcgtttgcgatgggcggagaggccacgaatgccggcggcgggggtatccgcgcgcggatggagcactacctttacagtggcgagaagaagcacgtcgtcgccggcatcgccatcttcgctgccgtcttcggcgtcccatggtacttcatgacgcgaggggcaaagcatcaatctcaccaagattacatggaaaaggctaacaaggcgagatcagagaggctttcttctggacagtcatctgcactaaaagaatgaatgttgtattgcctattctggtccctgaccttcagagctggtcatagatcatacactgtattngattgcactcaacggatttgatctgntgntaaataagcagggtatctttctttctaatatcaggtgtggaaacgaagtaccgtcccaagatttttgctactggtgatccttttttgg

SEQ ID NO: 52173 - DNA, 375 bp, Zea mays
  Clone ID: LIB3067-025-Q1-K1-G8
cccacgcgtccggagaggaggtagcaacaccgactgcttaatctcttccttttcctcttcctatctccagcgcatcccaagaggcggaaagggaggatcgtggagcggcgaattattgtttgtttccccaagatgtcttctccaagcaagcgccgggagatggacctcatgaagctgatgatgagcgactacaaggtggagatggtgaacgatgggatgcaggagttctttgttgaatttcgtgggcctaacgaaagcatttatcaaggaggtgtatggaaggttagagtagaattgccagacgcatatccttacaaatccccatcgattggtttcatcaattagatatatcacccaaatgtcgatgaaatgtct

SEQ ID NO: 52174 - DNA, 328 bp, Zea mays
  Clone ID: LIB3067-025-Q1-K1-G9
ctctgctctcccccacctcccggtccggcagcagagagcgggggtgcagagagatcgagatccggaggccgcgagtgggagcgccaccaccagcgtctgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactacgagctctacaaccgcaacgacat

SEQ ID NO: 52175 - DNA, 385 bp, Zea mays
  Clone ID: LIB3067-025-Q1-K1-H1
acaaaaaaacagaaaagaaaaaggaaaaaaaggacacaaatgccagcagaaaaaggtatacacacgcggatggagcactacactttacagaggcgagaagaagcacgtcgtacgccggcatcgccatcttcgctgccgtcttcggcgtcccatggtacttcatgacgcgaggggcaaagcatcaatctcaccaagattacatggaaaaggctaacaaggcgagatcagagaggctttcttctggacagtcatctgcactaaaagaatgtatgtcgtattgcctattctggtccctgaccttcatagcttgtcatagatcatacactgtattgatctgcactcaacggatttgatctcgtgttaaataagccggttatctttcttt

SEQ ID NO: 52176 - DNA, 374 bp, Zea mays
  Clone ID: LIB3067-025-Q1-K1-H10
ggctacatcacaagaatttatgaccactattgctaatcaaacaattgagatcgagaatttaaagaagtcgctagcagaaaataatagccttcttcgtcagatactaagcaccaatcgaggcatgtctcctccttaagattgttgctatagtcgaccatgccaatgttacatccaacaacactggactacttttttattagttgtctatttagtctgatcatattgatactatagtagctgtgtgcagcttgtggcggttgaacatgtcctacttttgcatttaagttatagaaaagttgtgtgtgttcatgttgtttgatgaaattgtatgcacggtttggattgaattcaattatatactgattttattaatt

SEQ ID NO: 52177 - DNA, 399 bp, Zea mays
  Clone ID: LIB3067-025-Q1-K1-H11
cccacgcgtacgcccacgcgtccggaaataagcatataacgaacacagtaaccatcgacttgcatggccaacatgtccaacatgctatgaaccttctcaaaattcacatgatgatttgtatttgcattccatctgtcttactgagggtaattaccggttgtggttcagaaggtacagggaagggaaaaataaagcgctcggttatagagcttgcggagaaggaacatattgagtggcgcgaagagaactctggaactgtagcccttcgacttggtgggccaagagagtatcggttccttgagcatgaaagcgattctgacctagtggggaactttaacatagattaacttctgatctaatctatgtattcccgtatttatgtgttatagctatggatgc

SEQ ID NO: 52178 - DNA, 389 bp, Zea mays
  Clone ID: LIB3067-025-Q1-K1-H12
cccacgcgtccgcccacgcgtccgggagtcggccagaatttgccgtagctctcgcccccgctcgccgtgcgcttctcgtcccattcccccgggatcgtagattctcgagctgagcagagctgagctgagctgagcgatggatcgcgagctcagccccaggggcaatgctccagggagagggagcggcggcgcgtcgtcatcgaagcacaagaacggcggcggcggcaagaagccgatcaaggtgctttacatcgccaaccccatgcgcgtccagaccagcgccgagggtttccgcgccctcgtgcaggagctcaccggccaacacgccgatcccttcaagtactgccccgacgaccttgactccggcgctgccgcacagggtctgagcc

SEQ ID NO: 52179 - DNA, 328 bp, Zea mays
  Clone ID: LIB3067-025-Q1-K1-H3
gtgagaaaaaggccttacctgaaaatgtttcttgagaaggttgctcagatgtttgaggttgtcattttcacagctagtcagagagtctatgctgagcaacttatagataaacttgaccctgatggaaaatatatctcacggcgtatttatcgtgaatcttgtgtattctctgacggttgctatacaaaggacctgacaattctggggatcgacttggcaaaagttgcaatagttgacaatactccacaggttttccagttgcaagtggataacggcataccgattaagagctggtttgatgacccctcagatcaagaactgatcgaag

SEQ ID NO: 52180 - DNA, 405 bp, Zea mays
  Clone ID: LIB3067-025-Q1-K1-H4
aagaatttgtagaactgtgggcgaagcaagacaggctcattaggatgcacgaacaagcgtcagcgatggtcaggtatgagctaagccgaatatcagccgctgtgttcattgcacttggtaaaggaaaagttcagtgtcgtggcaatgtacgaagcctcgtctttcgtggatggttcagcacgatgttgttggattttggctggcttcagcgctgccccaaaggtctagacctaagatcactggaggagaatctagggcgaggcattttaaccctccctctgaggcagcagcaatgtttgtttgaagaatggttccagttctattcgaccaaaggtgctgagtgtccgaaccttattagggctttccaggtatggtggagaaggtctttcgttagatcgtcggtag

SEQ ID NO: 52181 - DNA, 282 bp, Zea mays
  Clone ID: LIB3067-025-Q1-K1-H5
cccacgcgtccgcggacgcgtgggccatttcatggtatggatcataatccccacttttttcagtggtggcgattaacgagtttaggaacagcaaccctggtatcatacgggttattctttttgtagccttttggagagttctatcggttttggattcggtagtttatgaaggcttgttgatgagtttgagctcgaatagcttttgaaacagccggatgatgccatctttaataaaccaaattctgtgactgcattcacatttctgtcagtcacctgagtgag

SEQ ID NO: 52182 - DNA, 291 bp, Zea mays
  Clone ID: LIB3067-025-Q1-K1-H6
aacacgggcgcacaatcggaactcgctgcactgcttggaatccaacgagccaatcattcaaatcctctccggaaccgcgttgagcagggcacggtcgattggatctagattctagggtgagggtccgtcgccgaagaaactcgcaggcggtcacgaggaggcggcgggggagggcggaggagatggcctcggaggagatgacggcgacggaggtggctgcgctgctggacttgaagccgcacccggagggcggcttctacaccgagaccttccgcgacggctccatcacgc

SEQ ID NO: 52183 - DNA, 284 bp, Zea mays
  Clone ID: LIB3067-025-Q1-K1-H7
cggacgcgtgggcggacgcgtgggcggacgcgtgggtacaagtccaagcatgacctgaagggaaaagatcaactgcttgttttgattagaaagttcccagaaggtcttgctgttgtggaagtcaaggatgcatattcaaatgtattggaagatttgcaggctctgaaggctgctggtgaggtttggctgttatcaaacatggactcccaggaggacattgtatacccaaatgatccacaagcatagatcaaggttgatgatgacctgaagcaacttttccgtga

SEQ ID NO: 52184 - DNA, 343 bp, Zea mays
  Clone ID: LIB3067-025-Q1-K1-H8
cccacgcgtccggagcgatccgatccgatccggaactgtgccggccagccatggcgactagggttttgctcaccgccctcctcctcgccttcctcctcgtcgccacccctttcaccgcccgagttgctagagctgattcggaggaagatgctgctgcagctgaggttgttgaaggggctgatctaggtattgtgggtgatgatacacaggtttccagtgatggacctttaagccctgctcctggtgtagagacagtagttgtattccccaaaaatgctggcaaaattgtactagcaggtgaagaaactgaattactagttggtcttgcaaatgagggtgaatc

SEQ ID NO: 52185 - DNA, 432 bp, Zea mays
  Clone ID: LIB3067-025-Q1-K1-H9
aagggatttaggacgtcgtttggtctctttgccttcttcctccttcctccaccctgccttgcccaaagtagtcagtcgtcatcgtctcttccgatcgcctcgagttcattacagttagcgccgctaatcccctccctaatcaccatccatccatccatccggtaggattccccagccatgtcggcgactgcggtgaagtttcccgtggaggcgccgccgaggacagtgaaggtcaccaacgtctctcttagtgcaaccgtgcaagacattaaggagttcttttccttttcaggagatattgaacatgtggagatgcagagtggtgatgagtggtctcaaattgcatatgtcactttcaaagatgcacatagcgcaaaaactgcacttcttctttcgggtgccacaatagttgatctttctgtcatcattgga

SEQ ID NO: 52186 - DNA, 423 bp, Zea mays
  Clone ID: LIB3067-026-Q1-K1-A1
cccagcccggttctttgcgtgcggttgatctcgtcggaggcccggccgcggttccccaatccgccatggaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttatcggtcaatgatgagactgttaagttcgaaatctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaagaaatcagaat

SEQ ID NO: 52187 - DNA, 243 bp, Zea mays
  Clone ID: LIB3067-025-Q1-K1-G5
cccacgcgtccgcccacgcgtacgaggacgcgtaggcggacgcttttgaagaggcgtctaactgtcagaatattatggcttgctgattaccatagatatatataaatgtactgaacatatggatttattgaaatcaggttaatgattaatgaacatcaggatcatttaatacatgaattagctgactaatcattagatatgtaaattgagatattatgaggaagttagtataacacatgatag

SEQ ID NO: 52188 - DNA, 308 bp, Zea mays
  Clone ID: LIB3067-025-Q1-K1-F11
aaaaaaaataaaaaaaaaaaaaaaaataaagcaaaagaaaaaaacaaaagcaaaatggaaaaaccaggacagccggtcttgtggatccagagcttgggacgcgtgtctagagacgcctatctcttctatggcgcatgctagatgactaccactggctgccgtgttccaacttcgggtctgggaaaaccattttcaatgcccagcttattggccttgcagctcatccccatttcgccgagctggtgtaatgcccaagagtccctgaccgttcgtcctttccaacagtttgcgcacctgaatggctaatg

SEQ ID NO: 52189 - DNA, 271 bp, Zea mays
  Clone ID: LIB3067-025-Q1-K1-F2
agaaggcctcagacattgctggaattcttcatcaatgtctatttgtgatcggtatggtagccaagtgctatggtacgcggtcccgcacagaggttgagttctggttggctggaaacttgcgtgcactgcaagctaagacttgaacatgaagcactattgcatgtgtgtgtattctcatttttttattaaccatctttttggtcgggtctatacaagtgtatttaccccattgcttagcagcaaagcattaccaatttggatcaaaacaatt

SEQ ID NO: 52190 - DNA, 309 bp, Zea mays
  Clone ID: LIB3067-025-Q1-K1-F3
ggaacatcaatggtcttttacaaagcatgagccaaattcccggaataatgagcaagatgcccccattgcctatttcggtggatgaaaggctagctagctacatactccctcgtgctcctacggctcaagttcttggcagcagccatttgaaagaagaacgaagagtatggtaggccactgctagacagggaagcagctcaattttcagcagcagtttgaccaaaaatatctgaagagccatgtgcttgggagtctgcatggagaagcataggtgaaagaacgatctggcttttctgatggtctcaaagc

SEQ ID NO: 52191 - DNA, 425 bp, Zea mays
  Clone ID: LIB3067-025-Q1-K1-F5
cccacgcgtccggctcgcggcgcctccgcctatacctgttgcggcaggcaacaaggcagcagcggagcgccttggtgatctacgaagaggatggattccagtatctccctcctctgcgccctcgtcctcgcctcctccctcctgcactgcgccagatccgacggcaatgacgcgcagctcctcaagggcatcaacagctacaggtcctcgctcaaggtcccggcgctggccgagaacaagaacgcggcgtgcctggccgagcagctcgcgagacagttcaaggggcaggagtgcaccaacacgacgggcgccaacaccgtcatcggcaccgagcagcagttcccggactaccccaggtacctggaccgctgccacctcaacgcgtcggtgaccgaggacggccaggtgatgccggcgtgcgtgcc

SEQ ID NO: 52192 - DNA, 304 bp, Zea mays
  Clone ID: LIB3067-025-Q1-K1-F6
cggacgcgtgggcggacgcgtgggctagatcgcgagccgccgccgcgccttggcacccccttcctccgtgtgagaccaagaaccatgggcttgtcctggattagcggtgtctttagttaaaattatcagtgagtagtagctagcttaagcagtgctccgatccgagatcagttcttccagcagacctgtgtaaatgagagtctcgccgccccgccccgccccggtgtaacgcatcgtcatgtgtaaaatctatccggacccgataaagttttgcccttctgtcaaaaaaaaagaacaacgatgc

SEQ ID NO: 52193 - DNA, 279 bp, Zea mays
  Clone ID: LIB3067-025-Q1-K1-F7
cgctcttctccctcccctcgctctcggcggtcgacgtgcgctcccctggtgccatcgcttgtgcccggctcccgccatcgctggctccccgatggacctcgcggctagtgtggggccatggatccccgacggatcgagggtcgcgccgcctcatgagaaaaatcatctttttggctcgaacagaaaatacctgaagcttcaatttgacatcgtgtagcaatgaatgcgtgcaaagaatgctcttttacatgttgagaaatgagaaaaattagatgtcgt

SEQ ID NO: 52194 - DNA, 310 bp, Zea mays
  Clone ID: LIB3067-025-Q1-K1-F8
ccgcgttcaagcagccgcctttcgccatcagcaacgccgtggccagttcgactgtgggttcctatggcggaacaagggatgccgtgaggccaaggaccgcacaactgacgatcttctacgccggttccgtcaatgtgttcaacaaccgtctcagctgagaaggctcaagagctcatggtcctagccagcagaagaagctcagcccccgtggcctggtagccagaagctcctcctactctcgcttcagcgaaagtcacagcgcctgaggttcttctgcctgcgaagcagatgcttgttcaaaaaccacagc

SEQ ID NO: 52195 - DNA, 388 bp, Zea mays
  Clone ID: LIB3067-025-Q1-K1-F9
ggagaccgccagcgccgtccaggcgacggcgacggcatctgggaaggcagctgacgcagccgagaagaccgagcccgtcaaggacgagctgtaaacagccttggcgtggacgctatgggtaatgggacagaggaggggggacaaaagctggcgccaacgtactcgccaagcctccggctttagtttttgcgagggaagagggcaaagtaagagaatgggagggaggggtctgtggcgtgttttgctctggtgcggcatgcctgtgtatcccattgagattctgtacaattgcaaacagagagcggtacctttttagttaattatcagagatgactgtagaaagaaactgattgtggtgaggttgagtggacgaataaatggcgagtct

SEQ ID NO: 52196 - DNA, 327 bp, Zea mays
  Clone ID: LIB3067-025-Q1-K1-G1
ccaaatgcgtttactgtgggttctaccaagaggcttgcccagtcgatgctattgttgaggggcctaactttgagttttttatgtcttgctgctaagccttgatatgcatttaggtactgtttttatgtctctaggaaatcaatctatgttttctcaacttctggatcatttaatacttgaaatagctggctaaccatttgaaaagatatatgagatatcatgaggaagttatcttcacacatgatagagaacagaagtttagaatttttttttctctaaactcagatttgatttcacatgactatagttgctactgcaatcttaggg

SEQ ID NO: 52197 - DNA, 421 bp, Zea mays
  Clone ID: LIB3067-025-Q1-K1-G10
ctcgcttctccctctccccgagtcgatcggtccagtccgagggaagaaggcaagaagctaccggcgcgcgcgcgcaagcgagaggaaatggcgaccagcaacggctcaggggtcgcgcagggggaggaggggaagacgccaccgcctgcggggtcgatcggcgggtacgagtccctgcacaggctcctggaggccaacctttcccccgatctattccaggaagcaagtcgattgctgctgggactgaattgtgcacgacctcttgaggctatctcactgcctgacgccacaaccactcttgcggaaacacacagttttgatttgcaggcattccgttttagtgcagacaaagagtttctgaggcaatcaagagctgttcgagtaggtctaattcagaactcaattgctgttcccactactt

SEQ ID NO: 52198 - DNA, 456 bp, Zea mays
  Clone ID: LIB3067-025-Q1-K1-G12
cccacgcgtccgcagttttctcggaaggcagcctcttcctcgtcgccgccgacgtcacccgccgcggctgtcgggatgccggtcagggtggtcgataccgccacgccttcctcgcagccctccccagggcaagaagcaaatactggacacccatctcctcctagatgttcactcttaagtgctggaagatcttttgctggaactcagaatgtttcaagtctgcagaaggatgaagcatggaaagtgaatgtccgcatccatggttgcgatcttgaacagggttatctatgtggaacgatggaagcgcttaatgttccattagcagatacacctgtagtgacattctgggagggggagatagtggatgctaaaaattacacctttttcactggcaagtgggaggcatcaccagaggatgatataagacattggtccaagttcccatcatttatgcct

SEQ ID NO: 52199 - DNA, 384 bp, Zea mays
  Clone ID: LIB3067-025-Q1-K1-G2
attaactccatcgtttatccctggacgtccattcctctcctggcttactgtaccttgcctgccatctgcctgctcacggggaagtttatcacaccagagcttaccaatgtcgccagtatctggttcatggcacttttcatctgcatctccgtgaccggcatcctggaaatgaggtggagtggcgtggccatcgacgactggtggaggaacgagcagttctgggtcatcggaggcgtttccgcgcatctcttcgcggtgttccagggcctgctgaaggtgttcgccggcatcgacacgagcttcaccgtgacgtcgaaggccggggacgacgaggagttctcggagctgtacacgtttcagtggaccaccctgctgatacccccg

SEQ ID NO: 52200 - DNA, 318 bp, Zea mays
  unsure at all n locations
  Clone ID: LIB3067-025-Q1-K1-G3
aaaaatactacgctttagatagaccatggtattcgaaactgcgttttaccttatacaagcaaacagattttgactttttaaaccatagtattccttcaaaactgtaaaaacagtaagattccaaagagggcctaacagttctagaacgacagacggccaccagaaacttctattcatcatgtttcgggatggaacatcaattcagcacgccgtcacatcggcagctcgccgctatctgctatcacaaccttgctcttcggctccccactctgccggncttcagcttcgaccttgtacacaacatccattccagacaac

SEQ ID NO: 52201 - DNA, 362 bp, Zea mays
  Clone ID: LIB3067-025-Q1-K1-G4
ggaaaactgggattacatattgggagcctactctggaactctgctcacctatttcgtcaacataactgtctcgccactggccaccgatgaacatggtgacgaggcggaggagtttttcaagagcagaaccaaggcgaacatcgcgaggactgtgaggcagagcatcgagagggtgaggatcaatgcccaatgggtcaagaacatcaaggccgaggctgacctcggcaatgttctcaagaagctggcttacaagcactgatcagagacggtccactttcatttctgtgttagtcctagtaccgagatgtaactttgttctctggaataagtggattaataaagggcactttcgtttgtgtgtc

SEQ ID NO: 52202 - DNA, 463 bp, Zea mays
  Clone ID: LIB3067-025-Q1-K1-F10
cccacgcgtccggtgccctcccaactacgcgctgcccaacgacgacggcggctggtgcaacccgccgcggcagcacttcgacatggccgagccggcctggctcaagatcggcatctaccgcggcggcatcgtgcccgtcaactaccaaagggtgccgtgtgtgaagaaaggcggggtgaggttcagcatcaacgggcgcgactacttcgagctggtgctcatctccaacgtgggcggctgcgggtccatccagtcggcgtccatcaaggggtcgcgcaccgggtggatggccatgtcccggaactggggcgtcaactggcagtccaacgcgtacctcaatggccagagcctgtcgttccaggtcaccagcagcgacggccagaccaaaaccttccccgacgtcgcgcccgccagctgggggttcggtcagacgtttgcgacctcgcagcagttctcttagtat

SEQ ID NO: 52203 - DNA, 464 bp, Zea mays
  Clone ID: LIB3067-027-Q1-K1-G9
cccacgcgtccgtcttaccttgccctaatgcctcctcgtccgatccattcctcaaacaataaaatatccccagatagctaggctcggccgggacgtacgcatggaggtggaggaggagctgcctgctagcgctgatcttaccggtggctcaaagcaggcgaccactacgacgcccttctacctcgccttagatcacacagcttccgccaggtcgtctccaccgccggcagaggcgccgccgctgccgcgtgctgctgctgccaacagcgagaggggatccgaaataatcaaggcgaagattatgtcccacccactctatccggctgtcttgagagccttcatagactgccggaaggtcggagcgccgccagagattgtcggccggctttccgccctcgctgatgacgtcgaaatgaattcagacgacagacaagaacagcgacgagcagtagacccagagctcg

SEQ ID NO: 52204 - DNA, 419 bp, Zea mays
  Clone ID: LIB3067-027-Q1-K1-H1
gcaggtcgcagctgagcagcaacaaggccggaaaggatgtcgtggcagacctacgtcgacgagcacctcatgtgcgaggtcgagggccaccaccacctcacctccgccgccatcatcggccacgacggcaccgtctgggcccagagcgccgcattcccgctgttcaagcctgaggagatggccaacgtcatgaaggacttcgacgagcccgggttcctggctccgaccggcctcttcctcggccccaccaagtacatggtcatccagggcgagcccggcgccgtcatccgcgggaagaagggatctggaggcataaccgtgaagaagaccggtgaggcgctggtggtcggcatctacgacgagcccatgacccccgggcagtgcaacatggtggtcgagaggctcggcgactacctcgt

SEQ ID NO: 52205 - DNA, 274 bp, Zea mays
  Clone ID: LIB3067-027-Q1-K1-H10
cccacgcgtccggctgtttgcttagcttagcttagcaatataataataatgctagtcagttctcatccaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaacaaaaaaaatgataaaaatgggatgcctcctaatggattcaacaaattattacttggacattttatcccaaaactattcattagagctacttaaattaatttcat

SEQ ID NO: 52206 - DNA, 384 bp, Zea mays
  Clone ID: LIB3067-027-Q1-K1-H11
cggacgcgtgggatcgatctcgccgaggaagacgctggctcctcgtcccacggctccggctgctcgtccccgtcggtcgaggcggtcgggatccggcgcctggaggaggccatccacggcgtcatggtgcgccgcgccgcgcccgactggctccccttcgtgccgggagggtccttctgggtgcccccgctgcgccgtccgcacggggtcgccgagctcgttggccggatcgcggctgctgggggcacctaatggggcgcctttgccgtttggtgctcgttcgaagtctgattctttatttctctttttgattaagttttcttattttcttttttgttttattttttttttgtatggatttttctttgtattgtcttatttttt

SEQ ID NO: 52207 - DNA, 152 bp, Zea mays
  Clone ID: LIB3067-027-Q1-K1-H12
gcgccgcggaagacaccggcaccacgacccagcgcgccggcggcgagtccacgacgggcgaggcggacgggaaccggcgcctggaggaggccatccacggcgacagggagcgccgcgccgcgcccgaccggctccccgtcgtgccgggaggg

SEQ ID NO: 52208 - DNA, 388 bp, Zea mays
  Clone ID: LIB3067-027-Q1-K1-H2
gcgacgtcgtcttcgaggagcactttgtgtcgattctcaacttctcttggcctcaggttacttgtgtgactcagtgccgcatcagaggtagcagggtggtattcgtgagcttctgtgataagtctaaacagatccagaagtttgctgtacgtttcccacagccctgtgacgcagattcgttcttaagttgtgtggaatgctcatgctgtagcagcgtatccatggacatcataccatttggaaatgattatgtgtgtgaagatccatcagcatctgaatatattgcttctaatggacttcatcacaggctggatgatgcttcaaaccttgaggagcaatgttctgatcacacaatagatgaaccaccaatgaactaccactaggaaac

SEQ ID NO: 52209 - DNA, 307 bp, Zea mays
  Clone ID: LIB3067-027-Q1-K1-H6
tcgcccacgcgtccgcggacgcgtgggcattgaggtgggtcgtagctgcattatactttctccgcaagacatgagcatggattttgttttagcaacagattatttgtactcttgattctttggttccatgctctcttcggccatctccatgtcaatttgctttgcaaacaatataatatcagcgtgccgtgcccttgtagatttccaaatggttatatgcatatgtactattgaaattgtcattttagtttgcaaacaataccaacgtgcctttgtagatttcaaaatggatatatatgttgtattc

SEQ ID NO: 52210 - DNA, 437 bp, Zea mays
  unsure at all n locations
  Clone ID: LIB3067-027-Q1-K1-H7
aatttgacgaagagccaaattatgccaagcttatctctctttttgatggtttgattgaagcgcctgcttcgagacaaatcagaattgatggggctctcaaggttggacagaaacgtggaagattggttgcagatctagaagaagatgaacaacctaaaaagaaggttagattagggagcccagcggctcaatggatttcagtttataatgctaggcggcccatgaagcagaggtaccattacaatgtggctgactcgaggctaagccaacatatagaaaagggcaacgatgatgggctttacattagcagcgtggcttcctcggcaaacctttgggcactcatcatggacgcatgaactggtttctggtctcaggtttatgagctctcaccagttttccttcacaaggactggattatggagcantgggagaaaagc

SEQ ID NO: 52211 - DNA, 450 bp, Zea mays
  Clone ID: LIB3067-028-Q1-K1-A10
gttcaacgagcttgttccatttaggctgacacgcaacttgcaagctttcttctcgaattttggtgttgaaggtctcattgtgtctgccatgtgctctgctgcccagtcagtggtttctcctaaacaaagccagcacatttggcatcatttggctatgtttttccgagatgaactgttatcttggtcgtggaggcggcctctgggcattccatcagtccctgtcgctgctggaatgatcaacccatcagatttccaacagaaggtggtaaacaatgtggagcatgtcatcagtcgtatcaagtcaatatcgccacattgtctggctgaggaggaggagaatgcaaccgagccacctcagtcggtacaaagaggcgtcaccgagctggtggaagcggcattgtcgtccaggaacctgtgcatgatggatccgacgtggcacccatggttctg

SEQ ID NO: 52212 - DNA, 346 bp, Zea mays
  Clone ID: LIB3067-028-Q1-K1-A11
gttcaacgagctagttccattcacgctgacaacgcatcttgcatgctctcttctctaatcggggtgttgaaaggctcgtggtgtctgccatgtgctctgctgtccagccagtggtttctcctaaacaaagccaacgcatttggcatcatttggctatgagcttcccagatgaactgttatcttcttcgtgaaagcggcctccgggcatttcatcagtccctgccgctgatggaatgatcaacccatcacatgaccaacagatggtggcaaacaactgtgcacatgtcatcagtcgtatcatgataatctcggcacattgtctggctgacgaagatgataatgcaac

SEQ ID NO: 52213 - DNA, 451 bp, Zea mays
  Clone ID: LIB3067-028-Q1-K1-A12
acggttcaacgagcttgtgccatttaggctgacacgcaacttgcaagctttcttctcgaatttgagggttgaaagtctcagtgtgtctgccatgtgctctgctgcccagtcagtggtttctcctaaacaaagccagcacatttggcatcatttggctatgtttttccgagatgaactgttatcttggtcgtggaggcggcctctgggcattccatcagtccctgtcgctgctggaatgatcaacccatcagatttccaacagaaggtggtaaacaatgtggagcatgtcatcagtcgtatcaagtcaatatcgccacattgtctggctgacgaggaggagaatgcaaccgagccacctcagtcggtacaaagaggcgtcaccgagctggtggaagcggcattgtcgtccacgaacctgtgcatgatggatccgacgtggcacccatggttc

SEQ ID NO: 52214 - DNA, 415 bp, Zea mays
  Clone ID: LIB3067-028-Q1-K1-A2
cccacgcgtccgcccacgcgtccgcccacgcgtccgcccacgcgtccggcagcagccaagtcgctcgagttcagatcgagcgcgcgccaagcaagtcttccggccggccgcgaagagagcaatcaagcaagacaagatggtgaagctcgccttcggaagcgtcggcgactccttcagcgtcacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggc

SEQ ID NO: 52215 - DNA, 456 bp, Zea mays
  Clone ID: LIB3067-028-Q1-K1-A3
gacccacgcgtccgcccacgcgtccgcccacgcgtccgcccacgcgtccgttcatctcgtggagatgctgaaggaattgaaaagcttgcttctttggcaaaagaacatggaaaaaacaatgttgctttcctctgcctttttatgcttggtaaagtggaagattgcatacagttgcttgtagacagtagccgtatacctgaagctgcactaatggcgcgatcgtatcttcctagcaaagtaccagaaatagtagcaatttggagaaacgacctcagtaaaattaatccaaaagctgcagagtctctggcagatccttctgaatatccaaatttatttgaagactggcaggttgctctaactgtagaaaaaagcgttgcttctcagagggatcattatcctcctgctgaccaatacttgaatcatgctgagaagtcagacatgattcttgtggaagct

SEQ ID NO: 52216 - DNA, 382 bp, Zea mays
  Clone ID: LIB3067-027-Q1-K1-G8
gcgactcgtgggccgacgcgtggtctgactcgtgggcaggtcggaaaggttctgtggcgacgtgtcgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtacgcgtcaaatgctcctccggtcagcgcctcggatccgcggggctctgtcgcgccaccgacaactgcggtctcggcgcctcagggctctgtcgcggcaccgacgacagctgcggcctcggcaccgtaggcttctgtagcgccaccgatgacaacggcggactcggcgccgcatgcctt

SEQ ID NO: 52217 - DNA, 481 bp, Zea mays
  unsure at all n locations
  Clone ID: LIB3067-027-Q1-K1-F3
cccactcgtccgggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgatgccatgcttcaccagaccggaggcagcgttcctagcaccacctaaaagcatcagtcgcggagcttcgttttgctctccgccctgcgtagtagtaaacaaaagggaaaaagtctttttaaggaacttgtgatgctctggctccttgtgccattgctgagggacattcctaggnncttgttagtagtatggtttggtacccttgtctgtcatcactcgtttatctatccctaatac

SEQ ID NO: 52218 - DNA, 400 bp, Zea mays
  Clone ID: LIB3067-027-Q1-K1-F4
cggacgcgtggggtcgtggcaggcgtacgtcgactagcacctgatgtgcgagatcgagggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtactaagtacatggtgatccatggtgaacctggagttgtcatccgaggaatgaagggcactgggggcattactatcaagaaaaccggcatgtcctcgattatcggtgtctacgactagccaatgactccagtgcaatgcaacatggtggtggacaggctaggcgattacctgtttgagcagggc

SEQ ID NO: 52219 - DNA, 447 bp, Zea mays
  unsure at all n locations
  Clone ID: LIB3067-027-Q1-K1-F6
cccaacatcaatttaatgctcgtgagagtgattggggtttcacatcttttatgcctttgagtgagctctatgatgcaagtagaggttacctcgtgaatgatactgttgttgtggaggccgaggttgctgtccgcagaatggttgactattggacatatgactcaaaaaaaggaaactggttatgtgggcctgaaaaaccaaggagctacctgttatatgaactcccttctacagacactataccatataccctacttcaggaaggctgtatatcatatgccaaccactgaaaatgacataccatcaggaagcattcccttggcgctgcagagccttttctacaagctccagtacagtgacagtagtgtagctacaaaagagcttgacaaatcttttggttgggacacatnatgatctttcatgcagcatgatgtacaagagctcaac

SEQ ID NO: 52220 - DNA, 413 bp, Zea mays
  Clone ID: LIB3067-027-Q1-K1-F7
cggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaggcggtggacgctggagcctggtccggttgggttgggaagccccttaaactggtgtcgc

SEQ ID NO: 52221 - DNA, 406 bp, Zea mays
  Clone ID: LIB3067-027-Q1-K1-F8
tcggcccaagatgatgaggcttagaaccagaaaaattggcagaggaatatagttgccgactgtggggaggcctatacgagcccatgaatgccacgtctacacttacagcgcgatactgctgttgtctaattgcttattctagaggctttgcttgcaagcaaccaagcatgtgtgttggatttatcatcctgtctagtatgatggaccctgcttggatagtatgactaatatgtagagcaaagctagtacctaaaccaagatttttggtaaggggcatgtatacaggattatagccgatactgattgctgccggttgctgctgctggaacaatggcagagaatgtataatcgggctgttattggttcctaaatttcgtgatgtggagaaatgtaagacgagaaccgc

SEQ ID NO: 52222 - DNA, 380 bp, Zea mays
  Clone ID: LIB3067-027-Q1-K1-G10
cccacgcgtccgcaatcaactagatatccccaacataaacataatcagtatataaatgtttggtctgggcactcccttagaccttagtacacatgttgaatttgtttggctgagttctatgggtgctttggataagttctttaggatttcgtatgtgttaacatgacatgttatctgacccttgttttaagcagtcgtaaatactacttatgtttccttttctgtggtagctttctgacttctgagtattgatgggttgatgtactatggacatatcttcacacagagcttgagatggactcccccaagatctctgaaaatgaagatgttgggcatctgatcacaccctaagaagcctgcatccgcatagcataggtagt

SEQ ID NO: 52223 - DNA, 459 bp, Zea mays
  Clone ID: LIB3067-027-Q1-K1-G11
acaggttttcaataacagtccagatgagacagcttatttcaggatgttactcaatcgcgagagtatcactaactcggttgccatgatccagccttccttgatatcattttcctttgattcacctccatctccggtgtttctagatgtggcatcattagcggcagatcgtatactgctacttgatgcgtactttagtgttgtcattttccatggcatgacaattgctcagtggagaaacatgggttatcagaaccaacctgagcatgagcaatttgcacaactattacaagcaccacacgaggatgcgcagatgataataaaaggtcgatttccagttccaagactagttgtctgtgaccaacatggctcacaggcaaggtttttgttggctaagctgaatccatcggccacatataactcagctcatgatgttgctccaggttccgacatcattttcac

SEQ ID NO: 52224 - DNA, 145 bp, Zea mays
  Clone ID: LIB3067-027-Q1-K1-G12
agtaattatgaggtttccataagggaggggaggagagaggagacgatagggacttcgtacggggtcgttcgcttgtgggttcttcttccctcctggcttcataaaggtggactaatggtagaacaatgttgtcaatctcagtcgt

SEQ ID NO: 52225 - DNA, 464 bp, Zea mays
  unsure at all n locations
  Clone ID: LIB3067-027-Q1-K1-G2
cacaatccgtatagtgcttggatttatgctcattgcattgatctggcaatacgatttgtcccccttcatggtccttatcatcgccattctcaacgacggcactatcatgaccatctctaaggacagagttaagccgtctccgttgcccgacagctggaagctgaaggagatctttgccacgggtatcgtgcttggaagctacctcgctctgatgactgtcattttcttctgggctatgcacaagaccgacttcttctcggacaaattcggtgtgaggtcgatcagggacagcgagcatgagatgatgtccgcgctgtacctncaagtgagtatcgtgagccaggctctgatcttcgtcacccggtcccggagctggtccttcgtggagcgccctggcctgctcctggtcaccgcgttcctgctcgcccagcttgtcgcgaccttnctcgctgtctacgccaact

SEQ ID NO: 52226 - DNA, 329 bp, Zea mays
  Clone ID: LIB3067-027-Q1-K1-G3
aacagagcaagcagagcgagcgagctgtccggccaaaccctcacggccgcctccacagggccgcgccatctcgcgctgctcctgcccctgctcctgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggctggcgggtgggtggcgtggggcctgaaccctacgggcgaaggcatggccggcgc

SEQ ID NO: 52227 - DNA, 416 bp, Zea mays
  Clone ID: LIB3067-027-Q1-K1-G4
cggacgcgtgggcggacgcgtgggctgacgcgtgggcaggtcggaaagtttctgtgcgggactgccgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtccgcgtcaaatgctcctccggtcagcgcctcggctccgcggggctctgtcgcgccaccgacaacggcggtctcggcgccgcagggctctgtcgcggcaccgacgacagctgcggcctcggcgccgcaggcttctgtagcgccaccgatgacaacggcggcctcggcgccgcatgcctctgtcgcggcaccgacaacggcagcctcggcgccg

SEQ ID NO: 52228 - DNA, 444 bp, Zea mays
  unsure at all n locations
  Clone ID: LIB3067-027-Q1-K1-G5
cactcactcactcactcacagtcgccgccgctgcccagtgcccactgctcgccgctagaggaatctgagagagagaggggaaagggcgaaggaggcgcatgcaggcatgggctccccttcctccctccccgccgcggcggcgctcgtgctcctggccctgctcgccggagcccagtgccgcgaggcccagttcgacgccgcggacgccggcgcggagaacttcaacaccagcgaggccgccgtgtactggggcccctggcagaaggcccgggccacctggtacggccagcccaacggcgccggcccggacgacaacggtggtgcgtgcggcttcaagcacaccaaccagtaccccttcatgtccatgggctcctgcggaaaccagccatngttcaaggacggcaagggatgctgctcctgctacaagattcggtgcaggaagga

SEQ ID NO: 52229 - DNA, 385 bp, Zea mays
  Clone ID: LIB3067-027-Q1-K1-G6
tcgacgcatgcgtacagaagactcgtggtcggactcgtgggcagtactcgtgggcagagtcggaaagtttctgtggcgactgcctaacgagaacgagaagacaagaggaagccaaaaggagaaccgtgttcgggagggagcggatggcaatggctctgcttccgctattgctctcggtcctcatcgtctactgcgtcgcgcagtcgccggcctcgtcgccgtccgcgtcaaatgctcctacggtcagcgcctcggctccgaggggctctgtcgtgccaccgacaacggctgtctcggcgccgcagggctctgtcgcggcaccgacgacagctgctgcctcggcgccgcaggcttctgtagcgccaccgatgacaactgcagtctc

SEQ ID NO: 52230 - DNA, 402 bp, Zea mays
  Clone ID: LIB3067-027-Q1-K1-G7
aattcaacagagaatcatgggcgtgaggtttacctgacaggacgtcgactccaacctacatggacgggctccttatgtgctaggtcgagggccaccaccacctcaccttcgccgtcatcatcggccacgacggcaccgtctgggcccatagcgccgcattcccgctgttcaagcctgaggagatggccaacgtcatgaaggacttcgacgagcccgggttcctggctccgaccggcctcttcctcggccccaccaagttcatggtcatccagggcgagcccggcgccgtcatccgcgggaagaagggatctggatgcataaccgtgaagaagaccggtgaggcgctggtggtcggcatttacgacgagcccatgacccccgggcagtgcaacatggtggtcg

SEQ ID NO: 52231 - DNA, 440 bp, Zea mays
  unsure at all n locations
  Clone ID: LIB3067-027-Q1-K1-F2
attctaaattggtggaggacaaatgcaaacaaatacccggtgctttcagctatggcgcgtgatattttagcaatacctttgagcactgttccttcggagtttgcgttcagcgctggtggtcgtattcttgatgataatcgaagcacaatgacaccagaaacacttgaatgctttgtatgctgtaaggattggttatatgaatacccaaatattcaagcttagttgatctgacttccttcaaacatgttcaacagtacggcattcaagggagatttatgcatcattcggtgggctcctgtagctgcttagggatgacccttccactgctgctagcttcaagctagatcagatactctntctactgatacgcatggtgtaaaactgccgtgttatgtggtagatcggtgtgtgtactggtttccttatgtgtaaaactgact

SEQ ID NO: 52232 - DNA, 285 bp, Zea mays
  Clone ID: LIB3067-027-Q1-K1-D6
tcgcctgagaacagatttggatcgttgagaggagctgctgagatcaagcagcaccccttcttggaaggcttgaattgggctctgattcggtctgctgctccaccagagacacaaccttgcaacatcgtgactcttgccaaagagcggaaatagtgctaaactgtaccagaacgaaactaaggaacttaacactcaaggtcctctcagtcgcttctgaacttcaagcacttgcatacaatctgccgttatttcgaaagagtcaggatgtatcccggttgcgaacat

SEQ ID NO: 52233 - DNA, 378 bp, Zea mays
  unsure at all n locations
  Clone ID: LIB3067-027-Q1-K1-D7
tcgagactaccgaccgggctccggtccagttatcgagtggaacgaagcaagacaagagggaggccgagccgtctaggttagtcccgtccggtctcctgcgtccggcgacggactgcctggcgccggcgaatcgatgggctactggtggcaccgcgtcgtgctgccggtgcggcgggcgtggctcggcgtcgcgtcccgcttcggggttcgccaaaccgggctgtggaggctgcggcaggaggtgagcacgtgcgagtacgaggacgtgcacgtgatgtgggagatgctgagccgnaccacggcgccggcgccggcgcccgcgcccactaggcggcagcacagccggttccggccgcagccgctgccgtggtgcgacag

SEQ ID NO: 52234 - DNA, 227 bp, Zea mays
  Clone ID: LIB3067-027-Q1-K1-E1
ttcctcccactcttccgcccactcttcctaaataataaaacaaaacaaaaaaaaaaaaaaaagcgaggcaaaataaaaaaaatcccaaacaaactactacataacaacaacaaactaactaacaccaacaaaatccatactctactaatgtcaaccaaacaattctacctcttcaagctatccaatctcgtcatctcttcccgcttctaatttctccaaacctatct

SEQ ID NO: 52235 - DNA, 163 bp, Zea mays
  Clone ID: LIB3067-027-Q1-K1-E11
gtgcctggaattaagtctttaattggcttaactttgtgaaataatcactactcttttacttgccatgcacaactacagataacgatagagttacaattgcttacccatattgcatcatatatttgcgaacgttcaacatggtatgtctttatttgtgtgactt

SEQ ID NO: 52236 - DNA, 367 bp, Zea mays
  Clone ID: LIB3067-027-Q1-K1-E12
ctttatatagctgaggattgtcaattgtgcttgtatatatagctgactagctgaggatgggggacctctcatcttcaattgtgcttgtttataactttatatagctgaggattgtcaattgtgcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaacactaaaataaaaaaaaaattaattttaaaaaaacacattaaattacaaaaaaacaaaataatatctctcattttttatataatcaacacctattattctcctatttctctatatttttta

SEQ ID NO: 52237 - DNA, 456 bp, Zea mays
  Clone ID: LIB3067-027-Q1-K1-E3
tcgcacgtgccgtgcccgtgtgcatcgggggaaaaacagcagcaggggccgaatcggagcgccgtcgccggcagatctgcgccggccggtctgctccgcccagcggacatggaccgcgacggccgcccggggtggctaccgtcgctgggattcgccttcctcagcttcaactgcgggatggccgtctaccgctcctgggacgacccctacgccgtcgccttcgtcctcgccgcgtacgccgccctcgtcctcctcttccgctgcctccaccttctggagcgccgtcgggaccagcgcctcaagctcgccgtctggggcctctccacgctcctcacactcatgttctcgtacaagatcgccgccgtgatgccgtcctgggcccagctgctcgtctggggcatggggatcctcaccgtcgttgcgggattctacgccttcttcgtcgcccgcccggag

SEQ ID NO: 52238 - DNA, 351 bp, Zea mays
  Clone ID: LIB3067-027-Q1-K1-E4
cacgcgtccgcccactcgttcgcccacacgtccgtatagtctaagattacacatggggaggctacatgaagcatgtgacgacatgtgcttcagaaccgataacctatatattacgatctgtcgctacgagctcagttgtattggactacttcattaccgcgccaaaatgctcgtgcgtatgtctgcaatctacctcctgtaactgatgaaaatatgttggctgaatatcttgccaccatatgcttgctaaagaaggacaaatggactgggcgtccataaatctggatatacagggacaaagtttactaatgaaccaaagggtgatgcaacagtcacctattaggattcaca

SEQ ID NO: 52239 - DNA, 315 bp, Zea mays
  Clone ID: LIB3067-027-Q1-K1-E5
cggacgcgtgggcgactgaagtgaagtgccgggagcacgccgaggctaagcatcccaagacggacgtgtaccagtgtttcccccatctgaagaagtgaaaggcctgaacttagcaaccagcgctggtttggtcactacgatcgggccagggggcgttccttgtgttgagggtgttcattccgtgttatcttcccgtcagtcatgcgtcctgtcctatgttaacctacataagaaagtgatgtggtgtccacttttagtgaaactactgtctgctgttaaaacctggttggtctcagaacgatgattttcgtgtgc

SEQ ID NO: 52240 - DNA, 348 bp, Zea mays
  Clone ID: LIB3067-027-Q1-K1-E6
tcgtccacgcgttcgtccacgcgttcgatcgcggagaggcaatcaccacgtacgtatacacacgggcacgtaactagctagctagctagcagtcgtagaatgacgatgaggggtctctctgttgcggtcgctctggtcgtggtggtggccgcggcctgccttgccgggccctcggggcgcggacggcgcgggcgagtgctgtgcgacgccgtcggacacggtggcgctgaggctggcgccgtgcgcgtcggcggcggaggaccccggctccgcgccgtccggctcctgctgcatcgcggtgcacgccatcgggaagcagaaccccaggtgcctctgcgccgtcatgct

SEQ ID NO: 52241 - DNA, 463 bp, Zea mays
  Clone ID: LIB3067-027-Q1-K1-E8
aaacatcctgccgtttcccgttcacccagcgtgcgctccatcttggcgaggccgcgagggcgaccgctacagcagcagccgtcgtcgtcgtcgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggcttgctaaagaaggacaaaaggactgggcgtccaaaaatttggatatacagggacaaagttactaatgaaccaaagggtgatgcaacagtcacctatgaggatccacatgctgcttcagctgctgtggaatgggtcgataaccaggatttccatgggagcactattcaggttcacatagctgagtcaaaaagcaaagatgcattccataaccccacg

SEQ ID NO: 52242 - DNA, 441 bp, Zea mays
  Clone ID: LIB3067-027-Q1-K1-E9
cccacgcgtccgatttctaaaccaatgtctgaaggtaataagcactccttgttggattaatggccactaccacatgttcagtgtctatgtttggtaatgcttgctgttgattacagggctgcttccgagggtccactcaagggtatcatgggttatgtggaggaggatctggtttctaccgacttccttggtgacagcaggtcgagcatcttcgacgccaaggccgggatcgctctgaacgaccacttcgtcaagcttgtctcgtggtacgacaacgagtggggctacagcaaccgcgtcgtcgacctgatccggcacatgttcaagacccagtagagggttttccccctgcttctcatggatggttgctgcttgtgtatgccgagaataaatgtggatgtcgccaggttcatgctgagtctggacatgttttgcactttt

SEQ ID NO: 52243 - DNA, 340 bp, Zea mays
  Clone ID: LIB3067-027-Q1-K1-F1
cctcaacaagcttagcgtcgacaagaacctcgtcgaggtgttctgcaaaggcgtcgacaaagaccatgtgttgctgttggctgcaagggcttcaaggactgagaaccaggacgccatcgatgctgccatggttggcatgcttgctgatccgaaggaggccagggctggtatcagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgac

SEQ ID NO: 52244 - DNA, 422 bp, Zea mays
  unsure at all n locations
  Clone ID: LIB3067-027-Q1-K1-F10
catttctctgcacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacataccggccggccgagatctgggcatgcaagcttgcatggccatgtcttggtcagtcagatctgcanacaaccaaactgtataaaagaactggagcctgtcttgtaaatcatggaac

SEQ ID NO: 52245 - DNA, 258 bp, Zea mays
  Clone ID: LIB3067-027-Q1-K1-F11
cccacgcgtccggagagaggagagggagggtttcctcaaagagaacccgaacccaaacgcaagcagaaaacactagcgtttcctcaccagggcgtccatcccagcagccatggctatggcgtacaagatggcgacggaggggatgaacgtgaaggaggagtgccagcgctggttcatggagatgaagtggaagaaggtgcaccgatttgtggtgtacaagatcgatcagcggtctgtcgctttgctggtggacatggt

SEQ ID NO: 52246 - DNA, 424 bp, Zea mays
  Clone ID: LIB3067-027-Q1-K1-F12
aagaagacctcttctagaaaagccagaaaacaagaaggtctgaagcaacaatataatggagaggaagaccaaaatggtgggagcaatgcaactactggaggtgctcggaaaaaaaagggtgggcatgtaagacaatcaagtgctactcatgatgccattgataaaaattatagtggcagttcagctgaaggtttaaggaacaagagacagaagtctgctgctcaaagcgcttcggtaggcagaagggaagggttgaggcaacgatctgatgccaagcaacatccagatgcagccgagggcagtacagaaccactcgctgatgtacctggaagcgatggtgcagctcaaggttcaatgcaacatggaacttcggctcctcataccgaaataaaagcgatggtcaggaacatactgttcaaggaca

SEQ ID NO: 52247 - DNA, 191 bp, Zea mays
  Clone ID: LIB3067-027-Q1-K1-D5
gcttcccattgcgtcaagagattcttctgcccctgtcgttcaaactgttgttcttaatgttgtcatccactgccatggcttcaataagaatgtcctgaaagttctcaagggcatccaatgctttcatgacgtgactgttgactcctcgcaacacaatgtgactgtgactgtcaccgtggactcctacactc

SEQ ID NO: 52248 - DNA, 396 bp, Zea mays
  unsure at all n locations
  Clone ID: LIB3067-005-Q1-K1-G3
tcgcccacgcgtccgcccacgcgtccggcgggctggcggctggctttgggcgtgcagcaggtgtgggctagccgctttgggcgtgcggcggcacagcggcaccgacgcaccgtggtgggctggtgggcggtggcactgcggcagctgggcgcaggcactgcggtctgcggcagccgggcgctggcactgcggtctgcggcggccgggcgccgacaggagcagccgagcccttcggtcctctgcgtctcctccggttgcttcagagtctgcctttagtgctgctggccgggttgttgatccatatcgcaatcgncttgaccctgagatggtacaagcacttatatgcactaaaaattggattcgtgcatcaagaaaagattcagtaattattcattc

SEQ ID NO: 52249 - DNA, 392 bp, Zea mays
  Clone ID: LIB3067-005-Q1-K1-G4
ctccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaaggcggaggtgagcaagtcccagaagacgcagacaaagggtgcggtccagaagggttccaagggccccaagttgggcggcggtggtgggaagcgctgaaagaacttagtgtcgtttctcgacattgcagtcgttccttaaccaaagccactttcgtagaacctgtgttgaatttgcaagacttattcaagcgttgcttgtgcgtgctaaataccatggcaagaagacggatttatatttatgcctg

SEQ ID NO: 52250 - DNA, 410 bp, Zea mays
  Clone ID: LIB3067-005-Q1-K1-G5
gcaacaatcagattagggtgcttcctgattcttttggaaacctgcagcgtctccgtgtgctccgcgcagaagagaaccctctccaagtgccaccaagagatgtagctttaaagggagctcaggccgctgttcaatacatggctgaatatgttgccaagaaagccacaaggtcacaaccgatgaagacaaagaagacctgggctcagttttgctttttctcccggcctaacaaaagaaagcacgaccgaatagacaccgcgtcgtgattcactgtgagactgaactgcttgttcctcaactctacacttctgaagagaactatcgggtgcatcgccttcgatcgctaccattgtgttgtatgggtcaacaagatgtgatgcccagaagcttttccttggacaatgctgcag

SEQ ID NO: 52251 - DNA, 393 bp, Zea mays
  Clone ID: LIB3067-005-Q1-K1-G6
tcggccacgccttccggcttggatgacattgagaagatcaagggccagcttgaagcttccaacaaggctgtctcgaagattggacagcacatgtctggtggtggctctggcggctcgcaatcaggatctggacctcagggtggcggcgaccaggcgccggaggcagagtatgaggaggttaagaagtgaggctgccggagttcaagggaattgtaacggcttgtttagaagtagctcgcttttttttgggaacgcacatagtcagatgtctcagatgaggtgttacccgtgttgcaataatctatgaactttcacctcttgtgttctcctgcagtgaaacacgggtcacaacattgtcataggtcttattgcgcatataaccccttgtgcccc

SEQ ID NO: 52252 - DNA, 316 bp, Zea mays
  Clone ID: LIB3067-005-Q1-K1-G9
cccacgcgtccgcaacagggcgggcagacagggctcccacagaccatcaccacaacacacgaagacagctcagagctcacacacaggctcctctcccccgttgcgcaacgcgctttcccccacttcacccgcctcggcgccatggctaagctcgcgctggcgctggcgctcctcctcctgctggccgtggcgtcgtccgcgtcggccagcagcgggagccacctggatctcgacctgggcttcctcttctctggggaccgccggaaggagtgccgcgggacggtggccgagtgcctcgccgaggagtccgatgaag

SEQ ID NO: 52253 - DNA, 81 bp, Zea mays
  Clone ID: LIB3067-005-Q1-K1-H1
acaaggtgtaccactaccgggcgtacaacttcaccatcaacatgttctggtcgcccgttctggtgcgcggcccggagcccg

SEQ ID NO: 52254 - DNA, 428 bp, Zea mays
  Clone ID: LIB3067-005-Q1-K1-H10
caggaatcacattgcagtaaacaataacatgacttccacgacaatttcatggcatatccccacgtgcgcgagacattacaaggaacctgatgaccttagggtactgcaaagaaaataactcgattatccgatcgaacacacaaggccacaagggactaacagcaattatagagcaccacggcgctggcacagatggacgtatccagtcacacgggccattgctgctgatatacgacacgagacacgagaggatagcagggccctgacaagacccaaatgggaccatgtcgaattattgccgcatgcacagaaaagctctagttttcctgggcaccttcattagccacggcttccttctcaaccaccgacccgcttggcttctcttcggttgtcggcgccttctcagcctcagtggtgctcgcggtgct

SEQ ID NO: 52255 - DNA, 435 bp, Zea mays
  Clone ID: LIB3067-005-Q1-K1-H11
ctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagcccggacaagtactggagcccccaccccaagaccggcgtgttcggcccggcggcggtggaccccaagctggccgctggtggcgcgccggacgccggcgcggatgctgcaagaggcacggtgctggaccagaaggtgtggttccgcccgctcgaggacgtcgagaagccggccc

SEQ ID NO: 52256 - DNA, 250 bp, Zea mays
  Clone ID: LIB3067-005-Q1-K1-H12
atcagtcttgtgcatggaggctgctgtttgttctctgtatcgtaggtgtctacgtttgcgaggaaattgtatccggtgtttctctttcttcaaattaaaccacgcacatgcagctgccgtactttttggaccattgaagtgtttcgtccgtgaaaaaggctccttttaccttaaaaaaaaaaaaaaaaaaaaaaaaaaaaaaaaaaaaaaaaaaaaaaaaaaaaagggcaaacaatttaaaagatcaaaa

SEQ ID NO: 52257 - DNA, 208 bp, Zea mays
  Clone ID: LIB3067-005-Q1-K1-H2
acctcttcaattgagtcaggtagatcctatagtggcatcattttcaggtggcgcagttggtgttatctcagctttaatgttggtcgaagtgagaaatgtcaggcagcaagagaagaaaagatgcacatattgccatgggactgggtacttgccatgtgctcgctgtcctgctagtggaatgttatggaccacaaagcacttttaatta

SEQ ID NO: 52258 - DNA, 287 bp, Zea mays
  unsure at all n locations
  Clone ID: LIB3067-005-Q1-K1-H3
cccacgcgtccggtcagcgaggaagctgcctgcttttcagatagttattaagatggcgttgcttcggctgcttgccttctccctgctcttcgcagtggccactcctgtcagggacatcgccgatgatgcctgctcgtcacaagtgaagggtttccagcacctgaacaacagctcggggctccacctgacgctgcaccacccgcagagcccctgctccccggcgccgcttgccgtcgacctncccttcttcgcggtgctcgcccacgacggcgcgcgcatcgcgtcgc

SEQ ID NO: 52259 - DNA, 286 bp, Zea mays
  Clone ID: LIB3067-005-Q1-K1-H4
cggggtccaccgcggcggtcagggagcatggtgggcggcgggaggcggggcggagcggcggaggaggtcaagctcaacaccggcaacgtgttcgcggcgctcgagtccctcaagaagaagaagaagggcgacaaaggcaaggcggccgggtcttccttcaggaagaagcacggcgagggggccgcgcagcggcaagagccaccgcagaaagagctgttctgggcgcccgcgccacttaccaccaagtcctgggccgacgtcgaggacgacgaccatgacgactact

SEQ ID NO: 52260 - DNA, 399 bp, Zea mays
  Clone ID: LIB3067-005-Q1-K1-H5
gcatgagaagtctgaagatgacacaatgtcggaagaggtctctgttatggagagcaattggcttaatgacgctagaaatttgctaaactattgtagttttgcaagagttccaacaagaccacgaacagtgcttgcaaacaggaatgttggaccatgtcaaagagaaattactgtgtctgaacagctcaatttggttacttctgaagaaatatccaatatggcaatggatggagaagctaacactaatttcataactagcatctaggaaggcagtaaagttgagcttgttggccaagaccaagaacatgctgaacaaagcgctatctgcaatcaagtggcagaatcagtggcattccatgaaaaggaaactcgaggtgaaactgaacaaaaaaagaacaa

SEQ ID NO: 52261 - DNA, 316 bp, Zea mays
  Clone ID: LIB3067-005-Q1-K1-H6
gatggatctcatgatccgattcgctcggttctgaacccagtgtactccaaatgtgtgagccaacccttacacgtttggtggcaaaattggttaattccttgcctttgacttgatctggtagtaccaaggaaataagcacgggaaagatgcaagctttgtgtcgaacatgtgaaaaaaaatatatatgtatgagcaatttttgtcttttttttggggccagttgtagctgttactaccattaaacagtaagcaaaactgtttgcattttaaaaaaaaaaaaataaatttttaattaaaatttataatatttttatat

SEQ ID NO: 52262 - DNA, 174 bp, Zea mays
  Clone ID: LIB3067-005-Q1-K1-H7
catatactacggcggaacgggacggttgtttgccgcggccgtcggtccttgaaaaggtgggggcttttttggtcaatgggatcggttcccttggcattggtcttggagtccatgcttcccttaatggcaacccgccaagggggaaaaaacccacctaaccctttgggaaaattg

SEQ ID NO: 52263 - DNA, 428 bp, Zea mays
  Clone ID: LIB3067-005-Q1-K1-G12
cccacgcgtccgcggacgcgtggggtggttgtgtgcctttcggctggtgtagcattgagaggaggcgctgttccagttccagttccaggatgagcaaggaggatgtgctcaaggtgcagactttgatgctgagagtgaacatacactgtgacgggtgcgagaagaaggtcaagaagaccctccacaagatcgacggtgtctatcagagcagcatcgacgcggaacaggggaaggtgacggtgtccggcctgctggatccggacaccatcatcaggaagctcaacaaggccggcaagccggcccagctgtggggctccaagcctggcgtccctcagaacggccatggcggcggcaaaggccagcctaaggacgccggcggtggcaagggccattccaaggatgccggcggtggcaaggcccaaaagggc

SEQ ID NO: 52264 - DNA, 238 bp, Zea mays
  unsure at all n locations
  Clone ID: LIB3067-005-Q1-K1-H8
ctcctcaccgctcgtgctctctctctctctctcggcgccgactcggctaccgncgncggcttacggaagcttcccaggtcttcgtcaggcttttctccggcaacgagcaccctgcacagatcgtgaacctccacacctcaacgatagatggcggggttcagaagccttgcacccaagaccaggaacctggtggtggccgggggactgtctggcttcgtgctcggggtctactacttca

SEQ ID NO: 52265 - DNA, 440 bp, Zea mays
  Clone ID: LIB3067-005-Q1-K1-H9
cttgttctgtaccattttgtggataacatggggcaacatgtttttcttcattgctgggcataccaaagatccatctgaaggtgttacaggtttgctaaaattcagcttttaaggaattcgatccgcatacttgtacctggtctattgtcaggacttatggaaaatcaccggtttctcgcggaggtcagacagtgactcttgttggaacaacactagttttgttcggtggtgaagatgcaaaacggtgcctcttgaatgacttgcacattcttgatcttgaaaccatgacatgggatgatgtggatgcaatgtaagtacaagaatcttgattcttaatgcacacctaatgagaagataaggccattatttgtttcgtgaatctttgctatgtgagcttaaaatgtatctttttaaaagctcctagatttggttggcgcact

SEQ ID NO: 52266 - DNA, 67 bp, Zea mays
  Clone ID: LIB3067-006-Q1-K1-A1
tcggttctagatcgcgggcgggcgctcgcgatctagaactaccagtcaatcgccagcggtcgtgggc

SEQ ID NO: 52267 - DNA, 398 bp, Zea mays
  Clone ID: LIB3067-005-Q1-K1-E5
cggtcgcggaattcgcgcggcgcgacaccacgcgtgcgcggacgcatgggcaaaaacgcattgacgacacgcttctggctcgatgtatatcctgtcaaaaaatttggctcgctgcatgaacatatatagtgcgtcactggatagctatgcacacgatgatatatcagtaggttcatggatgatgggactgaatgcaacttacgtggatgatgaccggttgtgctgcagcaggtccagacaagagaaaatctgttgcaatgcttgagcggaaggcgtggctgctggcctgtagctgtacatcctgatgaagatagtgcacacctgtcattttgtatacactgctttcgtgaaccggaaaaggctactatccagatagaaacggcttgcaccaaaaatta

SEQ ID NO: 52268 - DNA, 401 bp, Zea mays
  Clone ID: LIB3067-005-Q1-K1-E6
gtcatcatttttccccatctctgttggattttctgcatcgagtactttcagtgatctgaaggttactggaatccttcctctgaaggaaggcaaccctccgaagttttcccagcgggctcgtttgctcacagctaactatcaagttgtttaatggttgtaccgttgtccgagtgttgatccacttaaatatattcgaatagcatatttttgtgacatggtatgctactggcatgaacttttgcaagtcatgggatggaagatcattttgggttttgaaaatctttactatgtgcttctcattggtagcatgttgcacaaatgttctgatgtgttgctaccagagaaataagtaatgttcttgcctttcgtttgcctgcattttgtacccgttctttcccctt

SEQ ID NO: 52269 - DNA, 63 bp, Zea mays
  Clone ID: LIB3067-005-Q1-K1-E7
cggacgcgtgggcggactcgtgggaaaaaaaaaaataaaaaaaataataataagattataggg

SEQ ID NO: 52270 - DNA, 251 bp, Zea mays
  Clone ID: LIB3067-005-Q1-K1-E8
cggacgcgtgggccaaatgtgaaccagaaattcaagaggttagcccaatgaccgatatatgcctcgaaaagaaagccaaggcatactcgaacaaaagccctaaagatgaaagcgacactgaagatggcagcagctgggagacaataagccacgaagatgtccagggttcaagcggttcacctgatggaagcgagccttcggtcagcaacaaggtctgcgacggaagcattccttggaagagcagaaatggt

SEQ ID NO: 52271 - DNA, 429 bp, Zea mays
  Clone ID: LIB3067-005-Q1-K1-E9
cccacgcgtccgagcagccaaaggacaagacaagagacacaacgaaaggaaaggaaccaagagaaagatcgagaagagaggagccttcgcttttggacttgcaccgtcgtgatctgtcccgcgaccacatgaggatccacccagcatcccccaccgccggcggcaagaaggacctccggcgcctgccgcacgtgtacagcaaggtgctggagctgccgctcccggcggacaccgacgtccaggtgttcgaaggcccagacgccttccacttcgtcgcggcgccggccgccggtgcgcgtgccgccgccaccgtgcgggtgcgcaccgtcaggatccaccccggggtcaccaaggtcgtggtgcatgccggagccgccgaacgggccgcttacgacgacgccgtcagcgacagcatggagctcgacaggt

SEQ ID NO: 52272 - DNA, 205 bp, Zea mays
  Clone ID: LIB3067-005-Q1-K1-F1
tttcagaggtttagggaaaaggagaaagaaagggattgagatcataaccgcagaagggagatcctgaagcaggaagattagagcgatgaccaggataataggaaaaggaaacgaaggagtattagctcacttgaagataggaagaggaagaggcaacgtgaaaaggaagaagatttggcagataaaataagggaagaagaggaaa

SEQ ID NO: 52273 - DNA, 362 bp, Zea mays
  Clone ID: LIB3067-005-Q1-K1-F10
atccaagctatggtctatctgtagtcaaatttcactcatcgctggacctagtcaacattgcgccttatgcaaccaaatgggtgaaagcttactctaagtagacatctacagaagatgacactaccaatataaactcataggaagcttactatgataaaccttactagtcctataaaagcccaaaaatctatgcacagactctagacattcaattctactaatagaaatttagttcatgtatctgattaacgatatatgagataacactatatagtcaacgtttcatctaacaattgctattatttactaatcatatattttgaccatttagtttaacattacttgttcactatttcatttta

SEQ ID NO: 52274 - DNA, 434 bp, Zea mays
  Clone ID: LIB3067-005-Q1-K1-F11
cccacgcgtccgcggacgcgtgggaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggctgttttaaaggatcaaagtttatttacgtttgattgcaacgttatagtttttttatagggtaatctaatttaaattaattggccgtgtttttaaaacttgttatttggaaaaaccttgggtttcccaaatttaatggctttgaagaaattccctttttagcaagttggctaatttgcaaaagggctctaacgtttcgcttttccaaaaattttctaagtttaattggcaattgggaccctccttttaggggcttttaaaccccgtcgtttttggtgtt

SEQ ID NO: 52275 - DNA, 335 bp, Zea mays
  unsure at all n locations
  Clone ID: LIB3067-005-Q1-K1-F2
tcggaatgctcggncttgagacctaccctggcgtcaagcgcatcaccatcaagccccagactgaccgctgggtgttccccgagaccaacactggcatcattgtccttgctgagggtcgcctgatgaaccttgggtgtgctactggccattctagctttgtcatgtcctgctcattcactaaccaggtcattgcccaacttgaactgtggaaggagaagagctctggcaagtatgataagaaggtgtatgtgcttcccaagcaccttgattagaaaggtgctgctcttcacttgggcaagcttggtgcccagcttaccaagcttaccaagtcttaa

SEQ ID NO: 52276 - DNA, 393 bp, Zea mays
  unsure at all n locations
  Clone ID: LIB3067-005-Q1-K1-F3
ntcgccacgcgtncgccacgaggcacttcaggaggctcttccgggtgacaatgttggcttcaacgtgaagaatgttgctgtcaaggatctcaagcgtgggtttgtggcctccaactccaaggatgaccctgccaaggaggctgccagcttcaccttccaggtcatcatcatgaaccaccctgggcagattggcaacggctatgcccctgtgctggactgccacaccttccacatcgctgtcaagtttgctgagctcattaccaagatcgacaggcgctctggcaaggagcttgagaaagagccaaagttcctgaagaacggtgatgctggtatggtgaagatgatacccaccaagcccatggtggtggagacattcttagcgtattctcccct

SEQ ID NO: 52277 - DNA, 412 bp, Zea mays
  Clone ID: LIB3067-005-Q1-K1-F4
tcgggagaagaagaaggcccgacgccctcgccgctgccaccaaaatcgcacgcgagccccaaagatccccaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcacccacgccgtcctcgccgtcgtcaacaagcccgccttcgagctctccttctaccagcggaaggtgttccgcgtcgctgaccacgccggggtcgcgctcgccggccttaccgtcgacggccgcgttctctcgcgctttcttc

SEQ ID NO: 52278 - DNA, 319 bp, Zea mays
  Clone ID: LIB3067-005-Q1-K1-F5
cggacgcgtgggctaattgtgactggttgcaacaatatgaaggtgcaggtagtgtggtccatgaggtggcgtgcagttggtagacgcagatggttctgtttaggatggtcacatgatagcagtttagccaccatccctctattcattttcatgctagtgcgtctggtagtcagctttgggttcctatagtaattgaggtttgagagagacatgaggattaggcatgcgcaagggcgacagacgctcatgactcatgagtttgatgtgcccatgtgcaattgacgggctgaggaagatcttagttgatcagttggtgaat

SEQ ID NO: 52279 - DNA, 316 bp, Zea mays
  Clone ID: LIB3067-005-Q1-K1-F9
atccaaggtatggtttatctgtggccgaatttcactcatcgcaggtccaagtcagcgttgcgcctgaggctgccaaatggctgaaggctgcctccgagtagacctctgcagaagaatatactactgatagagactcatgggtggctttgcatgctgtaccatactaggtctatagaagcccaaaaatctaggcacagactgtggacagtcaaaagtgctaatacaatttagtctcatgttagctgtacacgacatcatgagctatcaactagatagacaagggtgcatctaacacttgctcttggttgctaatcat

SEQ ID NO: 52280 - DNA, 442 bp, Zea mays
  unsure at all n locations
  Clone ID: LIB3067-005-Q1-K1-G10
cccacgcgtccgcccacgcgtccgcccacgcgtccgtccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgncaagctggcgcgctataacangaagcccaccg

SEQ ID NO: 52281 - DNA, 374 bp, Zea mays
  Clone ID: LIB3067-005-Q1-K1-E4
ccagactcgagagggagaggaggagggagtccgaggggagagacccaattagctgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgccttcctcaccctaattcgcgagcgcgcaaagctcaaggcagaggtgctgcgtgctctgggtggcgtgaaagcttcagcgtcgctcttaagggtccctcttgggcacaacttattctttttacaagggcctgcatttggttcttcacgcataccggaaggcattt

SEQ ID NO: 52282 - DNA, 441 bp, Zea mays
  Clone ID: LIB3067-005-Q1-K1-G11
cccacgcgtccgcccacgcgtccgcccacgcgtccgcccacgcgtccgcccacgcgtccggcaagatcaacgtcgtcgttcaagccagccagcggtagagccggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccattgtgctcgccgacgccatcgtctttcacgtggcgaacaggtgcccgttcccggtgtggccggcgtccgcccctaacaccggccacccagtgctcgccggcggcggcttctacgtcccgcagggcaagtcgaggcgcgtcgtcgcgccggccaactggaacgggcgcttctgggctcgcaccgggtgcaacttc

SEQ ID NO: 52283 - DNA, 385 bp, Zea mays
  Clone ID: LIB3067-005-Q1-K1-C4
agcagctgcctcagagaaagcaatctacatacttgatggggagacacaacatgcttgtagaagccccttgcaggggcacaataagaatattcaatcgctttgttgggactctgctggtgaatatctggcttctgtcagtgaagactcggtcagaatatggtcattcagttctggacgtgatggtgaatttgtgcacgaattgaatcgcagtggaaatcagttccactcatgtgttttccacccaacttatcaatccttggtagtgattggttgttaccagtccttggaactttgggacataaaggagaagaacaccatgacctttaacaatgcccattaccggttggttgcagcccttgcaacattcaatgcaacaaggaaaggt

SEQ ID NO: 52284 - DNA, 383 bp, Zea mays
  Clone ID: LIB3067-005-Q1-K1-C5
cagaaacaccaaagccccaaaggcccaaactcaccacctcccaatggagaacggcgacgaaaccctcgcctcccccacggccgccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaggagggcggtgcccacaccaccgcgaagtcctacgcagctgtcgccgcccaagccgagatcgaggacctccgcgccgtcaagctcgacctggaggagaagctcgctgaggcccgccgtgagaacaagttcctcgccgaggagacgcaccgcaacgaggggatcttcacgc

SEQ ID NO: 52285 - DNA, 339 bp, Zea mays
  Clone ID: LIB3067-005-Q1-K1-C7
agcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaagggcggcgtgaagcgcatttcggggcttatctacgaggagacccgcggcgtcctcaagatctttctcgagaacgtcatccgcgacgccgtcacctacaccgagcacgcacgccggaagactgttacccgcatggacgtcgtct

SEQ ID NO: 52286 - DNA, 410 bp, Zea mays
  Clone ID: LIB3067-005-Q1-K1-C8
acctgatttgtttaccccccgaaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggcggtatggcggcgccgccggcgagggcccgggccgactacgactaccttatcaagctgctcctcattggagacagcggtgggtgctgctagatctctctgtctcagtaaacgggtgtgtaagggcgtacgctctacacccgctcgcgttcgtgggatcggagttggattccggtgttggcaagagttgccttctgttgcggttctctgatggttccttcactacaagctttattaccacaattgg

SEQ ID NO: 52287 - DNA, 201 bp, Zea mays
  Clone ID: LIB3067-005-Q1-K1-C9
cacgcgttcgatggtgcgccctaattcggatgactccaaatactggatgaagcgtctacaatgtcggccaggttgtcatctcatctggtgctaaaggctgttcgtctaatgaacccgaagcgttgtgtgtgcggcatgggtagcctatgatccacttgactttatctgtcataggttgcctgtgctttcagactttgctgc

SEQ ID NO: 52288 - DNA, 324 bp, Zea mays
  Clone ID: LIB3067-005-Q1-K1-D1
ttcccagatttcaaccaagggggggaccattatggcctttacaagtgaacccaccgtttcggcctatgcctaacccaacggcaatgcatgggtcacagagtcagatgatgccccaaatgccacagcacatgatggggctaaatcagatgcatgctggttctgggccttctggtactgtacccccaatgggtgggttcccaagtgggatgggaaacattcaatgagcatcaagttcgtctggcgtacaaaattttcctatgggtggcatgtattatccgccttaaggacaaatggcttcacaagggcaaatgacattcatttctg

SEQ ID NO: 52289 - DNA, 340 bp, Zea mays
  Clone ID: LIB3067-005-Q1-K1-D10
aagatgcgtacggactgttgtatggaacctatggctaattggcatgctatctgagagcgaggttctacactggatagctagagctcatgcgaccgaatagatggtggatgcattgatggtagagaggacatgtcccaatatgtgaggctgagcatcactgagacaactcgatcactcataccagttatcaaggagaatgttaagagtattacaaattgacgagccaccataaatctcagctgtgacctacttgttcatgattgatgctaacctgaccaagcattccatgcgttggatgaagttgatttagctaactgattcttgatatgaggtctatgct

SEQ ID NO: 52290 - DNA, 336 bp, Zea mays
  Clone ID: LIB3067-005-Q1-K1-D11
gcgcgcggcggcgggcgtagccatgctccacaagttcgcgctcgcggtcaagaccaagaccatcgagttcttcgccgaggaggaggaggacgaggacgaggacgccgaccggtccgcgcgctctccgttgccgggggcggacggggtacttgccgggcagcgggttgtcgtgctgaagcccgacccggcgaaccctaaccctagcgcggatggggacgggaaggcggcgtccgggcaggaggccgccgtcgccgcggcgctcgcgacggcctcgtcgttccaggcggcgtacctgcacctgcaggccgcccacgcgccgttcctgccggacgcggc

SEQ ID NO: 52291 - DNA, 421 bp, Zea mays
  unsure at all n locations
  Clone ID: LIB3067-005-Q1-K1-D12
cccacgcgtccgagcgcattcctcttcgctgtcagagattaacaggcccccttcaagaacatccaaaggcattttatgatgcatttgttcttgcgatgtatgatatatttgccggaagcatcaccacatatatgttggggctttggttagtctcctcgttttttttcaaaggaggttgcatagggtacatagtgtaatcttttctatttcgttcctagatttgtcaagagatggcaattatttgttggagaaagctcgttgccacattctagtcattcttttcttagtggtttcactgctcatctggtttctgtaatttttcaattgaaggccaaatgagcaaagtagtaattggagatagaaatatgttactactgtcctatctatcgatctccaataaattagcgttgcaatgtanaat

SEQ ID NO: 52292 - DNA, 263 bp, Zea mays
  unsure at all n locations
  Clone ID: LIB3067-005-Q1-K1-D2
tcgcccacgcgtncgcgacgacgacgaccggcggcgagcgcgtccggacgacgttccccgaagacagcggcaggggtcgggcgcccaccgacgtgccgggtgccaccgaggaagagaggggaggcgccggaggagacctcgagggcgttcggccgtacccggaaaacggcagcggcaggggccgtccgccgtggtactacacgggcttccaccgcggcaggcagcaagagcaagaacagcgggacttcgggatgagcgacacg

SEQ ID NO: 52293 - DNA, 409 bp, Zea mays
  Clone ID: LIB3067-005-Q1-K1-D3
tcggctctgtgaaacaagccattgaacctcttaaaaaatgtggggtcagtgatggagagatatgcatgatagcaaacattgggcctgagaccgttgaagaggtttatgcactagtgccatctctcaaggctaataggtcagctatcgaaggttcagtcactgaggttcttaccgccctcgcaaacataaaagctgctaagtgaatctccaatggaactagaccgacaataaatcggaagcagctgtcttgttgatcgaggagcgcggaatctgcaaactggcccttcggtgttttggatgtgctgcggaaacgtgttatgatgtgtatattaaaaacgtagcatgtgctgcatgaacttctgtaggatgtctaactactgaagtgcaaattcagccttaactagtctac

SEQ ID NO: 52294 - DNA, 65 bp, Zea mays
  Clone ID: LIB3067-005-Q1-K1-D4
aaatacaaataatcggtacacggtccactttatgggccccaagaatgaaaaaaggggctagtggg

SEQ ID NO: 52295 - DNA, 340 bp, Zea mays
  Clone ID: LIB3067-005-Q1-K1-D5
cggacgcgtgggcggacgcgtgggcggacgcgtggggctgagcttgctgcagcagctgcacaacctcttcctgatgacgatgatgatctgattgagtagaaaggatcatgagtcttgaacttgagcatgagttgcgccttgcatgttataagttgttctagggtgaactctctagttctcattggctggatcatctgcatctccttggatgtgtacgcatgatatgagtgtggaaatggatggtacttctagacatgaattcgctggctactttatacattggtgtgtcactctgtttgatgataaactttgttgaggcaatcctcttagtgctgatata

SEQ ID NO: 52296 - DNA, 378 bp, Zea mays
  Clone ID: LIB3067-005-Q1-K1-D7
gacccacgcgtccgcccacgcgtccgcggacgcgtgggtcccagcgcacagctctcctcatcggcgcacccgagctcgccctctccttcctcatcgaggcccgagtcctgctctgatggcgaccgacgtggctgagactcccgcgccgttggtggatgcggcccctgaggcgcccgcggacaccccggcggcgcctgctgttgacgcgaagccggccaaggccaagaaggccacagcgccgaagaagcgcgccagcccgacccatccgccgtacgccgagatggtctcggaagcgatcgcgtcgctcaaggagaggacgggggccagcagctttgctattgccaagttcttggagggcaagcacaaggacaagcttcc

SEQ ID NO: 52297 - DNA, 411 bp, Zea mays
  Clone ID: LIB3067-005-Q1-K1-D8
ctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaagaggaacagccgtggattcaaggtttaaaacaaattgtggccctccgtgttgccatcagcatagtgcaaccgttgtgtttgatcaatcgacagtaattagtcatcactctgtaccgagattagtagcacaatttgttgtcctggtttgaattttggaagatatttgatgtcgtctccttattatctactcgttactggttgagcacgaagattgttttgtgatactcctacatgatttaagacggttcccgacgttccat

SEQ ID NO: 52298 - DNA, 447 bp, Zea mays
  unsure at all n locations
  Clone ID: LIB3067-005-Q1-K1-D9
aagataaacaacccacattatctgtatcggatgaccactttgcaagctatttctttgctagctcctgtcatgggtcctgatatcacatgccaacagttgctccctgtcgtcattgcttcttcaaaggacagggttccgaacatgaaattcaatgtcgctaaagtcctgcaatcacttgtaccaatccttgatcaatctgttgtggagaagacagtgaaaccatgcttagttgagctcagtgaggacccagatgtagatgtaagatactacgcacaccaagcccttcgggcgtgtgaccaaatggtgatatctagttgactagcctgtccaggaattaacaaatgagatacatattggtctattctttttgaacattttaaagtgttatgtagtcttaaaaatattgtaccaccaatgacgttgatgcatctttntattaattatgtg

SEQ ID NO: 52299 - DNA, 438 bp, Zea mays
  Clone ID: LIB3067-005-Q1-K1-E10
gatgaattctagcccggactgtgacttcgcccgattctgcgaccgcaagtacagacagctgatccatccaggcatcgagtcctcactgttcgggaactcggagtgcgggacactgccggtggtgagcgtggccggcccactctacgagctgttcgtggcaatggcaagctcgatctggacactccacaggttagcatgggcatacgaccccgcagtcggcatattccaggtcggccggggcgcagagttctcgacggtgtacatggagaacattgtccggtcgaagaagcgttttgcggggagcaaggagccccggaagccggtgcggccgaaggtcgggttcacggtggtgccgggcttccggctcggagggacagtgatccagtgtacggtgtatctggatcacgggaagagggaagaagacattacagattcggt

SEQ ID NO: 52300 - DNA, 221 bp, Zea mays
  Clone ID: LIB3067-005-Q1-K1-C12
cccacgcgtccggacgaggcacccttcagctacgggcagaggggtaaccttgacaggaacataggtcgtagggccctcgccgtcgctattttcttctcgtttgtgtcttgctgctctcgtggtgaactcgctactccagtgctctgcaatattaagcagaagctattgtattgtttgggtcgtttgtcagctaaattgaaatgcgatggacatttactagt

SEQ ID NO: 52301 - DNA, 157 bp, Zea mays
  Clone ID: LIB3067-005-Q1-K1-E11
cccacgcgtccggtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 52302 - DNA, 397 bp, Zea mays
  unsure at all n locations
  Clone ID: LIB3067-005-Q1-K1-E2
nccacgcgtccggagcatcttcggccgtttccttctgcacgtctaccccggtgaaacgttgtgcactgagatgtggcttgacggccagaaggtgcactaccaaacgaaggccaaggagcggaatcgcgctgtcctctctggatatgtgttgctccagcacatcccctcgtcattgtaagtaaaagttttggttcttaaaattggtgcccgctgaaagcatttggcttggctgggataaattgagcacgaagtgggctgccactgtaatgatagccatgtatgggtctgcacataacacattcgtaccggattgattagaagcacgtaccacttaaaaaaaaacaatattgtttttaataaaaattatatatttaatacaactacaatattttataaa

SEQ ID NO: 52303 - DNA, 427 bp, Zea mays
  Clone ID: LIB3067-038-Q1-K1-H9
gcgcccacgcgtacggcatcttggacgatgttgtctacccagctgagattgtggggtagcgtgtcagatgcgcgtctggatggttccaagattatcaagattttcttggacccaaaggagaggtacaacactgaatacaagctggagacctgcactgcggtctaccgcaagctgtgtgggaaagatgtggtctttgagtaccctatgaccgaaaatgcataaatatgatgccctatggatatctgcactctatttcggtgattctgaatgttatgttgggtctccctatgtacttcaaaaaacatagttttgatgctaaagttgcctaagaatttggtacggggaagtggcagtggacgtgaacaatgtttagttttgagcatttaaatcaaacctttgccctgaaaaaaaaaataacatttttatt

SEQ ID NO: 52304 - DNA, 378 bp, Zea mays
  Clone ID: LIB3067-039-Q1-K1-A10
taaaaaaaaaaaaaaaaaaaaaaaaaaaaataaaaaaaaaaaaaaaaaaaaaaaaaaaaaagaaaaaaaaaaaaaaaaaaaaaaaaaaaaaaaaaaaaaaaaaaaaaaaaaaaaaaaaataaaaaaaaaaaaagtctactataattaaaagataaaaacaattcatagcccttctattttaacaaataaattactttataaaaccctcaaattacaaaacataaccccctttaaaaaaattcccttttttaaaaaaaccttaatatcaaaaattaaatcacctttaaaaatatccaacttttacaaaatctcaatttaaaaaaaaaccccccatatatcacctcatcaaaaataatcacatcaaaaatatcaattaaa

SEQ ID NO: 52305 - DNA, 422 bp, Zea mays
  Clone ID: LIB3067-039-Q1-K1-A12
cccactcgtccgctctaaccctacagcgacgacgagagcgaggctatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgagatgattcaagtcattggcaaaggaagcggtggtgttgtccagctagtgaggcacaaatgggtgggcacattgtttgccttaaagggtattcaaatgaacattcaggagtcagttcgtaaacaaatagtacaggagctcaaaataaaccaagcatcacagag

SEQ ID NO: 52306 - DNA, 429 bp, Zea mays
  Clone ID: LIB3067-039-Q1-K1-A3
cgctggacgtctgcgtggaggacgagacgatgcggtacctgaaccggaaggacgtgcagcaggccgtgcacgcgcgcctcgacggcgtgcagaggtggacggtctgcagcagcgttctggagtacaagcagctggacctccagatcccgaccgtgaacaccgtgggcgcgctcgtgaaagcgggcattcccgcgctggtgtacagcggcgaccaggactcggtgatcccgctgacgggcagcaggacgctggtggggcggctggcggccaggcttcggcttaacgccacggcgccgtaccgtgcctggttccaggggaagcaggtgtgcgggtggacgcaggtgttcggcggcggcgcgctgtcctttgccacggtgcgcggcgcgttccacgaggcgcccttttcgcagcccgagcgctcgctcggcc

SEQ ID NO: 52307 - DNA, 402 bp, Zea mays
  Clone ID: LIB3067-039-Q1-K1-A4
gtctcatgtggccttcaagttccaaacgactgcaccaaagagttgcttcatgaggcctccgggcggcgtgcttgctccaggggaaagcatcatagcaacagttttcaagtttgtggagcatccggagaacaacgagaagccgatggacaagtgcaaggttaagttcaagattgtcagcctgaaagtcaaagggccggtggagtacgtccctgaactgtttgatgagcagaaggaccaggtcgcggttgagcaaatattgcgggtagttcttggatgctgagcgcccaagcccacaaatggacaaactcaagcgccagctagctgaagcagaagcagcccttgaggcacgcatgagaccttcagaggacaatggtccccgtattgttggtgaaggccttgtga

SEQ ID NO: 52308 - DNA, 411 bp, Zea mays
  Clone ID: LIB3067-039-Q1-K1-A5
cggacgcgtgggccgcttccttacaatgtaaaactggaggaagtcgaatctttttttgctgagtgtgtcaaggtaaatagtgtgaggctacctcgacatgtttctgacaaaaggcatttctgtggcactgctttagttgaattttcagaagaagatgaggcaaaaggcgtttttgagaaaaatctcatttttgctggggcagacctggaaataagaccaaagaaagaatttgatactgaaagagaggcaaagaaagaagcatatgagaagtcacatcctaataagagcagtcatggtgaaggctatccaaaaggtctgattctggccttcaagctgaagaaaactgcagatgatggtgagacacgaaaaagtggtggtggcaaagtagatgacactgaccttactaataat

SEQ ID NO: 52309 - DNA, 441 bp, Zea mays
  Clone ID: LIB3067-039-Q1-K1-A6
gacaagcgaggcggcggccccgcgttctccgtctccgtctccgtctccgtccgcccggcgtgaagaaaagcctctctcaccacagccgccacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctccaccgtcgaggaattctgggggctttacaataacattaatcaccctagcaaattgatcgtgggagctgatttccattgcttcaagaacaagatcgagccaaaatgggaagaccctattt

SEQ ID NO: 52310 - DNA, 425 bp, Zea mays
  Clone ID: LIB3067-039-Q1-K1-B1
cccacgcgtgcgtccacgcgtgcgcccacgcgtccgctcgctacccctctccctcgaggccgtttgcggcgaagagcgcccaggcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgctgcagctgcccctgctgctggcggcgctcctgcagctgaggcgaagaaagaagagaaggtggaggagaatgaagaaagtgatgacgacatgggctttaacctcttc

SEQ ID NO: 52311 - DNA, 429 bp, Zea mays
  Clone ID: LIB3067-039-Q1-K1-B11
gccgcttcacagtcgacgggtaaagaagctggtcgttctaaagagccacggtggctttgagtggtcttgaaggtccatctatgctggtcacatggtatcctatggatcaatccgaaggctagcttctggagatgcctgaagaaggtggacttctggaaactctttcggagccattcttcaagcttcccagaaggcttgattttacaatgtaacaaaacacacatgctgctcatgacatttcgagcatgtacctctggatgtttgtaggctcagaaaaggtcctggtcttaggctctgaaaacctcatctggcgaccatacgttatttaccttgtatgggcgctcctcttgctggtgagacacggtgttacgagttacgactcgatgaacatgtaataaagcttttcagagaaaaaaaatatatatattt

SEQ ID NO: 52312 - DNA, 408 bp, Zea mays
  unsure at all n locations
  Clone ID: LIB3067-039-Q1-K1-B12
cggacgcgtgggttgaactgacgggcgcggaccgcccgggcctcctctgggaggtgtgggccgtgctcgccgccctgagctgcaacatcgtgaaggccgaggtgtggacgcacgacgggcgcaccgtcgccgtgatccaggtcaccgacgaggccaccgggcgcgccgtccacgacgcgggccggctgtccagggtgcaggagcttctccgcgacgtgatgcggggcgacggcacgtgcaaccacggcggcacgggaatctccgcggagaggcgcctgcatacgctgatgctggacagcgtcngcggcggcggtgccgatgaagctggtggcggcggtgacgagaggggtggatgtggcgtggcgaagcccaaggtcgtggtgatggactgcgcggagaggcggtaca

SEQ ID NO: 52313 - DNA, 357 bp, Zea mays
  Clone ID: LIB3067-039-Q1-K1-B2
tcgcggacgcgtggggtcgatgggcatcttctgatgactcttatggtagtcagggatatggtgggaagagatcaactgatagtttgaagaacagcagcttcggcaaccaggccgggggtggttcaagctttcactcgagcttccataacagctctagtggcaatcagttcggtgatactacaagctttcatgccagctatggtaacagcagccagaacaatcagacgggtgacaatccgagcttcccacccagcttcagcaacaatcagtccggggatggtctcagttttcatgaaaggttctatggatcacgcggaagggacgagagcagatcatacaatgatggatttcgtgcta

SEQ ID NO: 52314 - DNA, 231 bp, Zea mays
  Clone ID: LIB3067-039-Q1-K1-B4
acgtccacgcgtgcgcgcaagtacaaccaggacatagattatctgccgcaaatgctattcacgagggcggcctaattctgtcagctgccgcaagaagaaatgtggtcacagcaaccagctgagggccaagaagaatatcaagatctgaagtgctgatcctagtcactttcatggacaatgttacgctttattgctgtgtggtttatgaacagggtttggttacccaacatt

SEQ ID NO: 52315 - DNA, 297 bp, Zea mays
  Clone ID: LIB3067-039-Q1-K1-B5
aaaaaaaaaaaaaaaaaaaaaaaaaattaaataaaaaaaaaaaaaaaaaaaaaaaaaagaaagaaaaaataaaaaaaaaaaaaaaaaaaaaaaaaaaaaaaaaaaaaaaaaaaaaaaaaaaaaaaaaaaagggcgccctttttaaagaatcaaattttactaccccttcattccaatataaaatcttttttatagtgaaaccaaaattaaattaattttcctttttttaaaaatataattattggaaaaaccctttttttaccaatttaaatctcttttattaaaatcccttttttt

SEQ ID NO: 52316 - DNA, 414 bp, Zea mays
  unsure at all n locations
  Clone ID: LIB3067-039-Q1-K1-B7
cggacgcgtgggcggcaagaagtctaagcttggtttcactgtgtacccatccccccgagtggcgacctcagtggttgagccatacaacagtgtcctgtccacccactccctcctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagtttcagaccaacttggtgccctacccgaggatccacttcatgctttcctnctatgctccagtcatctttgctgagaaggcctaccacgagcagctgtctgtggccgagatcaccaacagcgc

SEQ ID NO: 52317 - DNA, 455 bp, Zea mays
  unsure at all n locations
  Clone ID: LIB3067-039-Q1-K1-B8
aaaaccgagaagagaccaggccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctntgtgccatttcctcattagaagtatatcattcgatccattgnggatctgtgaaccatgtacctgtttatgtaactggttaccagtgttat

SEQ ID NO: 52318 - DNA, 308 bp, Zea mays
  Clone ID: LIB3067-038-Q1-K1-H8
cggacgcgtggggccagctaatgctggttgcaaggatggagcgaatggtagacaaggctggggtgtcatcaagagatgcaagctagagaccactgaaagctgaatggagacgttgacgctgctaatcaaatccaaatcctccatttgattagcgtgaccgattgggtggatggatcgcccttgcagtttgctcggatttgatatgttagtgatgtaaaaaaaatgatgtcgtcatcgtctgcgagatgaatgaaccgactttgttgtgatgaatccactgacagtcaacttatttattatagggtttt

SEQ ID NO: 52319 - DNA, 387 bp, Zea mays
  Clone ID: LIB3067-038-Q1-K1-G10
gcgcccacgcgtccgcatcagatacgcagcactcctgttcatacgaccatggcgtcgtccaggaagcagagcgctgtggtggccgccgtctccatcgccctgctcctcacttcgcatctcgcagtcgcagctggagcagaagaagcagaagcggaaggaatagcgccgttgaacacatgcgaaacgccgatcgcctgggctccctgcttcggcaagacctgggtctgcgttcccctctgcattggactgcgctacaccggcggtttctgccagcagcagcaggtgatcgagggagacgccggcgccgagcctgctataatcggaggcgccatctgcgtgtgcaccaagcagtgcctgcttgtggatgtggaggcggatcaaggtgca

SEQ ID NO: 52320 - DNA, 434 bp, Zea mays
  Clone ID: LIB3067-038-Q1-K1-G11
gcggctgcctctgaaaacacatccagcggcgaactccccgctggctcaggcccgagtttctgcgatttcgtggacaatgcgaagaagacagtgatggacgtggtccataacataaccgacttcttcaaggacttgttcgacgactcagccaagacccagactggggcaggcccttcagcagctgagaagggcccttctacggcagatatggctgtcggcggatccttcatggctctggccatagcggtcatcctagttgttatgttcaagagggcatgatatagccatgagtatcttctgggatccacggtgctttaaatctgtcgaaaattactcgtctatcgtttggtcaagaactcctgactgtaatgtaatgtacagcttgtgtccttgtccttggaaacagtacactaaaaggctatctatgatataca

SEQ ID NO: 52321 - DNA, 278 bp, Zea mays
  Clone ID: LIB3067-038-Q1-K1-G12
tcgcggactcttggtcggactcgtgggcggtctcgtgggctgactcgtgggctcttcttaagattgttgtgagagtaggtttggcatcccttactgaggccttctttaactgggctggattttggagtgcaatggcttcaaatgtaaccttccagtcaaggaatgttctaagcaagaaacttatggtgcacaaagaggaatctctctacaacattaacctattctcgatcattacagacatgtcattctttctgtacatcatagtaaccttacttaca

SEQ ID NO: 52322 - DNA, 367 bp, Zea mays
  Clone ID: LIB3067-038-Q1-K1-G3
gttccgtgtccgcgtccagtgtgtccgctccccctcagtcctagcggtagcgtgcgcgcgggggacgtagatggcggcttcggcggcggcggcggcgacaccggtggcgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatg

SEQ ID NO: 52323 - DNA, 148 bp, Zea mays
  Clone ID: LIB3067-038-Q1-K1-G5
cccactcttacttccacgcctcctcaccaacaatatcgatttttttaccctcaagatagtgttctcacccttgacgatcataacacggtttctgggggcgccgtcaacaacaccatcaaccaccaaaacggacaccaacaatattttt

SEQ ID NO: 52324 - DNA, 401 bp, Zea mays
  Clone ID: LIB3067-038-Q1-K1-G6
cccacgcgtccgcggacgcgtgggcggacgcttgggcttttccatgctgggataggagcaggcctgatgctctacgttctcttctggatcaagttggaccttttcacaactctcaagtacctcggcttcctcggcatcttccttgtgtttgtgggccatagggctctatcctacctttcctcggtgtcgacaaaacagaagacggcatgagtggacagagttttttccgaccatccatttcttgagggggggccattgcaggcccttgggtgtcttatgagggagggcttcggttatttcagttggctttgcagaatactgataactagataaagtagtatgacctcaccttcgtgtattatgatgatgcacatacaattttcttagtagaatggatgttg

SEQ ID NO: 52325 - DNA, 338 bp, Zea mays
  Clone ID: LIB3067-038-Q1-K1-G7
gccacgcgttcggagcactctgcaaggtttgacgcttgccctgacttgtggagagaaacgggggcacggaccactgctttagaagctgctttcatggagtcggagctggtggaggagctgctgcaaaacctgttggtgcgcgcgactgatcctgaggatcttgccaggtacacaggtgacgggtcaggtgactctagaggaaagcctatcacaaagcatagcacagcgaactggagagcatgtgcattgattacaggtaagacaacagtctgagctatgtgctaagcattgacacactcatatgagttctagaacgataaccagactagtcatgtcac

SEQ ID NO: 52326 - DNA, 387 bp, Zea mays
  Clone ID: LIB3067-038-Q1-K1-G8
cccacgcgtccgcacgcgtccgcccacgcgtccgcccacgcgtccgcccacgcgtccggcagcattttatgatccatcaaaatcaaggaaaatatgcactgccccgcagcttgtgagtgagaatgaaccacaaaagtatcgggatgtaatttatggtgactatgtctcatcttggtatagcaaaggtccagagggcaagcgaaacatcgacgccctcctgattcagcactagagccataggtatgccttaaaacagggttgggccactcatctgtttcctaaacttctaatgcatgtacaatatatcagtttccaactttaaacaatcaggataaggaaaccaacttgtatactggatgcagtgcaataaagtaccttttcattgtc

SEQ ID NO: 52327 - DNA, 375 bp, Zea mays
  Clone ID: LIB3067-038-Q1-K1-H1
cccacgcgtccgcccacgcgttcgcccacgcgttcgtccacgcgtgcgtcacctacacctgcgcgtacatctccacctaccgaacatgagacccctacagctaccttgccgacgcatgaacgagaagacgggttatactttgtcgaaaccctcttcgctagtggaggtatcgaacccgatggtgatcggcgatcgtgagcattcatgttaagtgttctaatacttgagacttttattatgactatgtatgagatattgtctcttattagtactggatgagatgtgccttattatgattatggattagactttttgtgatgaaattgatgaggactatggatttaaatattgttatgtgaatgtgtgtaagatggt

SEQ ID NO: 52328 - DNA, 433 bp, Zea mays
  Clone ID: LIB3067-038-Q1-K1-H11
gaggccttcgatggagaaggcagatggtttggacggtataactccagccaagaggcatgagcagagcacagatgaagtgatggacgcaaactggattctacgcaagttgggcaaggatgcgatcggaaagaggattgaggtccatctaacttctgatggcaaatggcatcaagggatggtgtctaatgtcatgggtggcacgctgtgtattcagttagataatggcaggtctgagaacgtggagctggggaagcaggccatccgcttgattgcttcaagatcgaagggcgggaagcgatgaaaccttttccccataatatgcagcttaggacctgttctcgctcaatacattgcgccatgattatggcaggtagagtcctcccccctcaggtttgacatccgctggagcagagcctctcagcctttgctgact

SEQ ID NO: 52329 - DNA, 425 bp, Zea mays
  Clone ID: LIB3067-038-Q1-K1-H12
gttcttggcttgaatcccgagaccaggaagtttatctctgaaaatgttgaggagcaaagtgagcaggtgatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtaccggataagtgatgtgtgtgtgtgtgagtg

SEQ ID NO: 52330 - DNA, 378 bp, Zea mays
  Clone ID: LIB3067-038-Q1-K1-H2
caacaaagcagctcacttgagttcaattcagccatgaggagccaggtcgcagcagtagccaggtggttgctcctcctggccttgggtgctgaggccgacctctgcgtcacgcgtagcaggaccttcaaagggtggtgccaccagagcgagaactgcatcaccgtctgcaagagcgagggcaataccggcgggttctgcaagctcggggcttgcatgtgcaccaaagagtgtgtccgaagtactgacgctgctggtgctaataaagccccacagcagcatttgagttgatgagtagtaaagaagaacgcttttgttatgccaacgcatgctctagaattcgaggccgaaatgaccaaaaataaatgaattttgtactct

SEQ ID NO: 52331 - DNA, 240 bp, Zea mays
  Clone ID: LIB3067-038-Q1-K1-H3
ggatgtagtgattgtagtcctgctcctgttcggttccacgcgcgcacgtatgcgcttgtactactggttgctgctcgatcgatcgatgattccatgtacatatttgttagggggatgctgcggtccaggctatagagtttgagggtgatatacttgctcatcagatcagtttgctgcctgtaagactggttttggttttggttttgctataatcgtgatatatatattccgatgtacagt

SEQ ID NO: 52332 - DNA, 175 bp, Zea mays
  unsure at all n locations
  Clone ID: LIB3067-038-Q1-K1-H4
cccacgcgtccgcggacgcgtggtcggcaacttgtaaaggagcacgatttggcacataaactgatngttgaagatgaaattgcagaagcaatgctgcggcctttatagttgcaacatgcagcagatgaagcagttgtattagaggctgctctaattgctcagcttattacactta

SEQ ID NO: 52333 - DNA, 349 bp, Zea mays
  Clone ID: LIB3067-038-Q1-K1-G1
caggcgcgtatgatgtaatcctaatcgcggttattgtgatggatctgtacttgtacttctggagtagatagactcacaaataccaggagaagcctccccgcaagtcgttcaggtatctgtctgcaggaactctcggtctgaatggtgcttttagcaaggttgccaattttgtgtagtattttgtcaaaactgaaggcctttggattagtttgtgctggtcagctagaaacctggaaacaacaaacttgttgagtagcgatgtttacaagaaatgtagcctttatgggctcttgtaaccctttctctcttatcatattttgttaaagaagcaaaatatccaccaaaactc

SEQ ID NO: 52334 - DNA, 282 bp, Zea mays
  Clone ID: LIB3067-038-Q1-K1-H6
cggacgcgtgggcggccacagagcatgataataccattgccccttgaaggctgtctcgagagcgagcttctacgccctctatgattgccttgcctgcttgcctctactcgtccggcccagccatggccaccatcctggagaccatacagaaggcgaggctcctgcactcacaggccgctcaaggacgagctgccaaccttatgcggcggcggcagacaggagagccacctcacaggcctgcggaagctgctgaccgccttctccggcaagatccagcccatc

SEQ ID NO: 52335 - DNA, 455 bp, Zea mays
  unsure at all n locations
  Clone ID: LIB3067-038-Q1-K1-H7
cagaactccaagaaacagttgcacacttgaggcaagaaatcagtaatttatcgaaggctgcagaaagcgaggatagttttgctagcgtgcagtctagtgaaccatcaacagcaagcactgatactagggatcaaacaaatgaaatctcaaaccgtgcaaatatgtcctctagaacaacggacttaaatgagtcaggatttatatctcaagtgctcaagcaggcttcagaaattgaaagtttgaaacaagaaaatctgaggttggtggaagagaaggatggactggaaattcatagtcaaaagttggcggaggaatcatcctatgctaaagaattggcttctgctgctgcaattgaacttaagaaattggcagaagaagtcactaggctntcttatgaaaacgcanagctgaatgcagacttagctgcggcaagagagctaaatgcatcgatgtca

SEQ ID NO: 52336 - DNA, 420 bp, Zea mays
  Clone ID: LIB3067-038-Q1-K1-E11
tcgcccactcgttcgcccacgcgttcgcccactcgtccgcccacgcgttcgcccactcgttggtccactcggtgcttatgagcttcgtgatgagaagcataagctgaaattggagaaggagagtttagaacaccagatgaagctgatgacatcgactccaacctacatgcctcatccgaccttgatgctggcgcctttccctcaggcacccctagcgtcgttccatgcccaggggcaagctgcatggcagaagctgatgatgccctttgtcagctatccggggtacccaatgtggcagttccatgccggcttcagaggtcgacacctcgaagaacagtgaagcgtgccctcctgttgcataattgcttcgactagcggctggtcctgctcacaccatgcgaattagtcgcaactgaatcc

SEQ ID NO: 52337 - DNA, 450 bp, Zea mays
  Clone ID: LIB3067-038-Q1-K1-E2
gaactcaaggaaaccttgcaggatatccttggggaaaacaaaactattttggttgaacagaagagtgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctgtccttttgaataaaatgtttcctctaataagtgaagggcactgtttttattgtctcgtgggccacagatgcctgctgaacaatttatgttcatttcttcttttcttaaaaaagcatgcactaagaacatgaatgatgcatgtcatgaaaagttttgaaagtcattgaacctatgagcttctatgc

SEQ ID NO: 52338 - DNA, 374 bp, Zea mays
  unsure at all n locations
  Clone ID: LIB3067-038-Q1-K1-E4
cggacgcgtgggcggacgcgtggggtcgcactagccaatcgtgcagcagctttgaatgctgggggggtctctatcaaagaaaccatcaccgctgccatcataccgaatgcatggtctgcactgaatgttggtgcaccccattgtaaagggtatggaatgcttatcctaagagagtggaaagttacatgaaaaatgtaaaaacattgatgttaaaattagtcaatgatacatagggaagtctccaaaccattgtgatgaagatatgagattggcacggtctgtccgacagttgatctgggtgacaagtgctgtgtgcttgtatgcaccacttgctgtgaggatgtgggcatataaccatacangagtgatgcaca

SEQ ID NO: 52339 - DNA, 457 bp, Zea mays
  Clone ID: LIB3067-038-Q1-K1-E5
ctctcgtcgccgtcctctcccgttcgcaacgccacgctccccaccgctgaaatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggctgagaatgaaggaaaaactgttgaatccaagaaaccaattgttgtgaagtatggccttaaccatgtga

SEQ ID NO: 52340 - DNA, 383 bp, Zea mays
  Clone ID: LIB3067-038-Q1-K1-E6
cgactcatggactccagaccagctgaagatgatggcattcggaggcaacaaccgggcacatgctttcttcaagcagcatggatggaccgatggcgggaaggttgaggcaaaatacacatcaagagccgctgaactgtacaggcagatgcttaccaaggaggtcgctaagagcgccacgaccgataatgccctgccatcctcacctgtcgcatctgaggcttccaagccgccatccgatgacttccctgaattcaaactcccagatgtggcagcaccaccggcagagaatctgaatgggaagcatgagcccaagtcccccaaagctgctcctcgttcaccaaaggccgctactcattccacctttgccacttctgtgaagaagc

SEQ ID NO: 52341 - DNA, 353 bp, Zea mays
  Clone ID: LIB3067-038-Q1-K1-E7
gagattggtatcatgtcgcagtgttgcttgtataaaaatgttagaagtgcacgccctgcgtggtttgctaatcttgctattaagatcaatgccaagtttggaggaagaaacttagaatttgctaatcccaaataaagcttaccgggtgttacaattgaaccaacaattatatttggtgctgatgtcacacaccctgccgttctagatgataccgccccttccattgcttccgttgttgcctcccaagactggcccaaggtggctaactataatgggattgtccgtgcacatggtcatcgtaaagagctcatcaatggcctggaagacattgtcaaggaactcctacttgcatt

SEQ ID NO: 52342 - DNA, 349 bp, Zea mays
  Clone ID: LIB3067-038-Q1-K1-E8
cccacgcgtccgtggagccgagagcgagcgtgtataaaaggccggcgcttggtcctccgaagcctgaaccttgaagcgccccgtagtgcagtgcagtgcagcagtgtgctaccctcctcagtcctctcactccatcacaaacgctagtcttcctctaaagagatctttggcaacgaccgacagctcggagcgagtctcagaagcgatggcgtcaaagaggctgctgctggcggcgctgtgcgtggtggctgctgcgctgctcgccgtgcggtcggagtcccacggcctgtaggacttcgcaagcagcgacgcgacgccggagatgcataccttcttcaagcccgaggcc

SEQ ID NO: 52343 - DNA, 416 bp, Zea mays
  Clone ID: LIB3067-038-Q1-K1-E9
gatgagataaatacagcattagttcgaccacttgctcatggagttaaacttcatgcactgattgatgcgtgtcatagtgggactgcacttgatttgccttatctctgcagaatgaacaggattgggcaatatgtatgggaagatcaccgaccgcgatctggtgtctggaaaggcactagtggtggggaagctatttcctttagtggttgcgatgatgatcagacctctgcagatacctatgctttatcaaagatcacttcgactggtgcaatgacattctgcttcatccaagctattgaacgtggacagggcaccacctacggtagtatcctgaactctatgcgttccacaatacgcaacacaggtgactcaacgggtgtaagtggctgtactgttacatcactaattacaatgct

SEQ ID NO: 52344 - DNA, 423 bp, Zea mays
  Clone ID: LIB3067-038-Q1-K1-F10
ggagttctacaagtgggagggcaatctctcccagctgctgcagaacgtccgcaacaagggtaaccaaggcgcttcgagctggtcttgggaggagaaggaccactgcctggaggagacggagaagtcgttctcttactcaggaggcctcctccgccatatattcacctgatctatcgttgctggttgatccagtctcaaacgctgtaaatacatagtcctttgactgttaaaactttattactggtgagggggatctcctcccccaggtacggtttacctgcattcaagttgcccagtgtcttactggattgctggtgtttggtgtttctgtgatgcaatctgtattctgtaggtcatttcatgactaatagagtcgaccccttccaatgccgtcaatggcaagagctcttccaatcaacatgc

SEQ ID NO: 52345 - DNA, 312 bp, Zea mays
  Clone ID: LIB3067-038-Q1-K1-F11
tcatacgcggactcatatgaaaaaaaaaaaaaaatttaaaaaaaaaaaaaaaaaaaaaaaaaaaaaagaaaaaaaagaaaaaaaaaaaaaacaaaaaaaaaaaaaaaaaaacaaaaaaaaaaacaaaaaaaaaaaaaaaaaacaaaaaaaaataatatacctaaaacaaaaccaaaacctcaaaatataaaaaactaataaaactgaaaaaacatttaacataccaaaaataaaaataactaaaaaaaatcataaaaaaaaacaaaacacttaaaaatcaaataaaacacaaaaaaaaaaccctatcaaaca

SEQ ID NO: 52346 - DNA, 433 bp, Zea mays
  Clone ID: LIB3067-038-Q1-K1-F12
gcgcccactcgttcgtccactcgtccgcccactcgtccgcccactcgttcgcccacgcgtcgggctcgtggaggagtcaattcatgccattgtattaggggttttctcagtggcaattatgtctgaagatattaagttcaaattcaaatggaaaagtgatggaggaaaatttgtgagcctcacagataaaaaacatgtgattgaaagaggaacaatgataaggttttctgtcaaaagggtggatacagaaatgagttgtcatattactggatctttaatcccacctcacactggatgcatgcgttggttgtcagtacatgatcctaaatatgcatcagaactcaaaagtggtgaaagtagatcaagggatacaagcatcaaaattgagcagaatgaacaagaacatagaatactcaagaatgaagatggtatg

SEQ ID NO: 52347 - DNA, 302 bp, Zea mays
  Clone ID: LIB3067-038-Q1-K1-F4
cccacgcgtccgaagactctgatttggtccctggaaaatatgaaggtgggttgaagctgtggggaggttcattagacttggtgaaagccctgaattctgatatcaaagaagataaatttcatctggaaggcaaacgcgtattggagcttggatgtggacatggtctccctggcatttttgccggtctcaagggtgctgacctgattcatttccaagatttcaatgcctacgtgcttaggtgcttgactataccaaatgtacaagtcaatcttttcaaggattcaccacaaggaacatgtaca

SEQ ID NO: 52348 - DNA, 445 bp, Zea mays
  Clone ID: LIB3067-038-Q1-K1-F5
ggttcttgtttttgtctcagttcagcacgcgacgcaactatcctctagagagagagaggaggcccgtcgttctggaagtttccacgctccgcgcctccgccccctggtctcctctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtattgctaccaaaatctgctgttaagtttgagagatatctgatgggtgagattctatcgatcggtgctgaagtcagtgaagttgaggctgtgaagaaggttctcttctcagacatcaatgct

SEQ ID NO: 52349 - DNA, 416 bp, Zea mays
  unsure at all n locations
  Clone ID: LIB3067-038-Q1-K1-F6
cccacgcgtccgcccacgcgtccgcccacgcgtccgcccacgcgtccgcccacgcgtccgggcgacgcgtccgacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcggnggcggacctcaagtgcctgtgcggctacaagaactcgccgtggatgggcgtctacaacatcgaccctcagcgcgccatggagcttt

SEQ ID NO: 52350 - DNA, 412 bp, Zea mays
  Clone ID: LIB3067-038-Q1-K1-E10
cccactcgtccgcccactcgtccgctaaatggtactggccaaaaggtgcatagcttagttgattctgagaaaccaagcaatcagagctttgccatgattgtgaaatctcacacattaaggctccctgtcggtaatccggatgggacaatcattataagaaccgaccagtacaacagagatgatctccgagttgactatatgtatgcaaagttctttgttatcaagtcaattggtgaggcagatgtgcacaaatcgataaagtatggtgtatggtcaagttcctccaatggaaacatcaagctagatagcgcattcagggatgctgacaggatatcaaggaggcattctactaagtgtccagtattcttgttcttctctgtgaatgggagtgggcacttctgtggcatggctg

SEQ ID NO: 52351 - DNA, 404 bp, Zea mays
  unsure at all n locations
  Clone ID: LIB3067-023-Q1-K1-G5
cccacgcgtccgaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaaggtgactgttttggaatcgagagatcgtattggcgggcgcattcatactgataactcgtttggatgcccaattgatatgggagcctcatggctacacngcgtgtg

SEQ ID NO: 52352 - DNA, 446 bp, Zea mays
  Clone ID: LIB3067-023-Q1-K1-G6
ggcgcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaagctaaccagtacaccgctgcactgaatcccatcctcttccaggtcctcatcagtccgatg

SEQ ID NO: 52353 - DNA, 275 bp, Zea mays
  Clone ID: LIB3067-023-Q1-K1-G7
cggacgcgtgggcggacgcgtgggcaagcagaaaactttagttgacatggcggtcgaccgcggatgctacatcgaccaaagccagagcctcaatgtccacatggagcaagcaaactttgggaagctgacgtctcttcacttccatgcttggtccaagggcctgaaaactggaatgtactatctacgcacacgagctgctgctgatgcgatcaagttcacagtggataccacgcttctgaaggagaatgggaacggggttagcgatggaaagcccg

SEQ ID NO: 52354 - DNA, 407 bp, Zea mays
  Clone ID: LIB3067-023-Q1-K1-G9
aatgcccctcgttgaaccgcaagaaaggaagtctcgctggtatcagtcttaatagcaaaatatatgctattggtgggggagatggaaatgaaactttttcagaagttgagatgtttgatccataccttgggaaatggttatgtggtccatctatgctgatttctcgatttgctcttgctgtggctgaattgaatggaacaatctacgccaccggtgggtatgatggaagcatgtacttacaatcagcagaacggtatgaccaaagggagggtgtctgggtccgtcttccaagcatgaacacaaagaggggatgtcatgcccttactgtcctgggagaaagcctatatgcaatgggcggatacaatggagacaagatggtttctagcgttgagatcttcgaccctcgg

SEQ ID NO: 52355 - DNA, 401 bp, Zea mays
  unsure at all n locations
  Clone ID: LIB3067-023-Q1-K1-H1
cccacgcgtccggtgggcttctaccgcggtcttcgcaggccacgcgctagggtcccgctggatgcgccggcttctgcgtagccaccatcgaaggtccaactacctccgcacataaacagttgcgccaccacactcccagaatttctcccccacagcagtactaggtgcagagaacccccttcctccactcgacgtccagccatggcgcacgtcacacaagtctacttcatgttcgagctcctccatggacgcagggatcttccgcggttcagggagttttatggccgaaggcttctgctgtgtcaccacgggtcaaacagcgagggaaaacgcagagagagaggaaggagatggagccggatgtcgctgccgcgtnccacacggagagatccagaagaaga

SEQ ID NO: 52356 - DNA, 253 bp, Zea mays
  Clone ID: LIB3067-023-Q1-K1-H10
cagcgggttcggccagtaccacggcaagtactcgtttgacatgttcagccacaagaaggcggtgctcaagaggagcttcctcgtcgagttcatgttccgctacccgccgtgggacgagaccaagatcggaatgctcaggcgcgtctaccgcttcgactacgtctcgctcttcctcgcgctcatcggcctcaggagatgaatcagacggcagatagtgcgttgaacaattgagcctacataatctgtacttcac

SEQ ID NO: 52357 - DNA, 405 bp, Zea mays
  Clone ID: LIB3067-023-Q1-K1-H11
gggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggggaatcggattaattgtaatttttttagctggaatcgaagcaggcaa

SEQ ID NO: 52358 - DNA, 424 bp, Zea mays
  unsure at all n locations
  Clone ID: LIB3067-023-Q1-K1-H12
gcgaatcgacgcgcctatctcagcttgctgcactgcactgcactgccctgccatcatatcgtacgtgagcccggccgagagcgagggagaggcatggctgctccgaagctcgcgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgngctgcccagcaagtgcggcgtcgccctgccgt

SEQ ID NO: 52359 - DNA, 409 bp, Zea mays
  Clone ID: LIB3067-023-Q1-K1-H2
gatgcccatttattgacggaggcttctaatggcttttgacctttttgttcataggcttgtggtgtattcttttgaccccatatctcatttcttgcacccatccattttgcagcatttcaaatttagcaaaatctcaacctgcagtggagttgcaagttgcacatagttatcatcgcataggcatgcatggcagggtgtatttcttgttgataaccggggaatgagaagacagcgatagtgaaatactcctagagttgatgaccaccacctagtttttttcttctttggtctacatgtataattatgccgcctgataccttttgggtttcagtgtatcatatataccagtgtacaggttcggacctgaacattaatttgattgatagtggtctactgatctttatgtttt

SEQ ID NO: 52360 - DNA, 413 bp, Zea mays
  Clone ID: LIB3067-023-Q1-K1-H3
cccacgcgtccgcccacgcgtccgccgtcacccaatacttgcaagcagggacttcttcagcgttgtgccgccggcagagaaggacgactacgatgatctgttcaaggtgcccctgtgttccctgccaagccctacaactacaagaagatagctgatctacttcgtgccgattgagctaacaaaggtgaagggacggcaagtcaatgccacggtctgcctccctgatgaatctgcgtccgtcttttgccgcatccgagaccaaaagggagagtccctggtatatgggctccactccatctcgtggcttctatagctagtgaaagtactacgccggcgagctcatgcgcagcatcgaccgcgccgaccagccgtcgggtgacatgtcgtcgagggcgatgactagcgccatggac

SEQ ID NO: 52361 - DNA, 435 bp, Zea mays
  unsure at all n locations
  Clone ID: LIB3067-023-Q1-K1-H4
ggaggagatcctatactcctgatgatataaatgatcgccgaggtgcagacaatggtcgtgatgagaggaagaggtccccagcaggcgaggaggatgaggagcctcggcgcggtcatcataggtcaccccgtccagcgtccatgtcacctcctgggtcacggtcaaggtcggcgtcgcctgctatcagcgactgatgaatgtggcggcgatggaactgttggccccatgattggggcggtttgtcagactcttgttatatctgctgctaggctctgttttgattttcctccgtggattgtttgtgtatgtggggctaagtccggtagttggtttgctcggaatgaaatgagttggtggttcgtttgtcggtggagactctgcttgtaacctggtatggtatcagtggcattntgtgcttgctgtttaggatgatga

SEQ ID NO: 52362 - DNA, 234 bp, Zea mays
  Clone ID: LIB3067-023-Q1-K1-H5
ctcaagaaaaagattgctggaacggcggaataagcgctagctctcgtggaaagctttagaaccaacgacgagaggggccgtttcttctttgcaaattaagatatatatcaaccgaggaacgtaccaatgcagctactgtcgcccatgtgttgtgtgtgatgcatagcataccttaccttctgtatccataacgaaatttaagaggagagaattttgccttgccagccgtttctc

SEQ ID NO: 52363 - DNA, 380 bp, Zea mays
  Clone ID: LIB3067-023-Q1-K1-H7
aatcaattgccaattacagaacttccaagctgaagaatatatgacctgggtgagtgagatgcattgaaaaaaatttgtgtttgcttaagtatgatttttgaatgatttatctgttaggtcgagattgtggtgcaagttaatattagatagcatgtttcaatggtggactgttacggtttgagcattagtatcgattgcggaagaatttcttcctgacatgtttatatagcccctcaaccaatagactttaagccccttttccctattcttgtaccccagctgccacatggtgaatggccgcggttgcacacctcaaaatcagtggctcgattctttgtgcgaaggtttagaaccacagacagaaagcacggatatttttg

SEQ ID NO: 52364 - DNA, 425 bp, Zea mays
  Clone ID: LIB3067-025-Q1-K1-A10
ctcaaaaccaagcaacaccgtgccgacgcaagactaccagagatgaagaccggcgtcgtggcactacagctactcaccatcaccatgtttctcgtgctgtcgtcggctgcagatagcacggcggccaggattgggccagactacttccaggacacctgctcggcgaggatttctccgggggcacggtgccagcctcgcaagtgcgccgcggactgcaccaggcaattcaggggcggcgtgggcggctgtgaccgctcggggtgtacgtgcgtctacacctgccctgcggtcccgccactggcaaagaatgaatcgatcgcgtgaccctgactgtctcgatgcacaagtagtgacgtgacggacgggctagtagccgacctgtgacggatttgcccgtctgatgaaaatcgtgaatgagtctgatg

SEQ ID NO: 52365 - DNA, 184 bp, Zea mays
  Clone ID: LIB3067-025-Q1-K1-A11
ggcaatcagtgccagtttatctgttgctccacagttacatatcccacccatggttgaggtggagctgcaaagtccgttggaattatcttgtagcagtttctcggcaagatgagtcgcttcattcactgtacgtcggtgccggctactctgaaacttacatactataagaatctggtcccttact

SEQ ID NO: 52366 - DNA, 271 bp, Zea mays
  Clone ID: LIB3067-025-Q1-K1-A12
cttgcagaatcgcttgaaaaaaatataaatgtcgtgcaaatcacaggcaacaaaagaagctgggcgaagccagcaacacgcatgcactgcgacgtgcagcagttctaagtttaaaccttcgaagtcgcctgatgttgtgtcatgtcatggtaggcctaccgattgatgaattctcaaggaagactatggatgccattgcagaagagctgacttatgagaagacgcttgcttactcatgcatgcagtaaattctaccacatgcagagagcac

SEQ ID NO: 52367 - DNA, 335 bp, Zea mays
  Clone ID: LIB3067-023-Q1-K1-G4
cgagcggccagactttatgagaggttgagggggggacaccatggctgcgatgaatctgtacggttcagtgatgtcttggaacgtgactaggtgctcaacagcgctggacgaggctgaattcgactacaatatcgtgcacataacttcgcaccatcacacaagaccacgacacatcgatggaacttgtttagtcaggttccagctgtacaggatattgaattgtacctgttccaatcaatagcaatctgcaagtacgctggttgcacaaacaagccagagctgattagggaaggaaatctcgaagaggcattaatggttgatgtttggatcgatgt

SEQ ID NO: 52368 - DNA, 291 bp, Zea mays
  Clone ID: LIB3067-023-Q1-K1-F1
cccacgcgtccgcccacgcgtccgcccacgcgtccgcccacgcgtccgcccacgcgtccgcccacgcgtccgcccacgcgtccgcccacgcgtccgcccacgcgtccgggatccacgaaattgtcgctaatggctaaaaacaatggtagtatcttttttttactccttttcttttggctttcatgctacgggaagtttgaggggattcaattaattagagtatatgtaagtttggtttccagtcgaatctatcattcgttgcaccatcattcttccttgacacagtacacc

SEQ ID NO: 52369 - DNA, 414 bp, Zea mays
  Clone ID: LIB3067-023-Q1-K1-F10
gatgggtcccacctcccttgtcgtccaacagaagccctgaacgtgaaaaggaatctacatttgctgctggtagaagcaggcgtgttgaagtggagcgtacattgactgactcacagcgtgatgaatttgaggacatgctgcgagctttgacattagagaggagccaaataaaagacgccatgggatttgccttggataatgctgatgcagctggcgagattgttgaggttcttacagaatccttgacactcaaggagacgtctattccaacaaaggttgctcggcttatgctagtgtctgacatccttcataacagtagcgctcctgtgaagaacgcatctgcattccgaacgaagtttgaagcttctttgccagatgttatggagagctttaatgacttgtatcgcagtatca

SEQ ID NO: 52370 - DNA, 403 bp, Zea mays
  unsure at all n locations
  Clone ID: LIB3067-023-Q1-K1-F11
cccacgcgtccgcgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgncgncgncgncgncgncgnctcgaaggccggttccgacgacgtgggtgccgncttcgncaacagcaccgncgncttcggtgaggacctcaagaactgggatgcggacttcgtcaaggtcgaccaggccacgcttttcg

SEQ ID NO: 52371 - DNA, 301 bp, Zea mays
  Clone ID: LIB3067-023-Q1-K1-F12
cggagaaggcgtacaagatcctcgccgacttcgtcttcgacaactacgtcaagctcatcctcgtctagcttaccattattttcatttcatgagatggatttgatctgctggattatgcattaattgtttgctgctgtatttacatttgcttgtctgattaattgtttgctagctaatcttccggcctctacatctctctatctatctatatttacgtgcatttattacgactctattaattgaattattgtacgtccgtgtcataaattaattaattaatactataataatagttgtatct

SEQ ID NO: 52372 - DNA, 362 bp, Zea mays
  Clone ID: LIB3067-023-Q1-K1-F2
cggacgcgtggggtgtgaaagggctcaattagataagtttgaattaaccgtgcaagaaattcatctctctgtaggttattctagatctcgttggtaaaaggaacaggacacggcaaacggtgtatcgaaacaccagccgtctttggtatttccctgcgtgacagaccttgtatcatctatacatgtgttttagccagtggctgtattgtacaactttatgttgtgtccgtctccataaaaaaaaaaaaaaaaaaaaaaaaaaaaaaaaaaaaaaaaaaaaaaaaggacaaaaaatataaaagatccaaacataacttacacatacattcaacggcataactcttttatagagccacctaaat

SEQ ID NO: 52373 - DNA, 336 bp, Zea mays
  Clone ID: LIB3067-023-Q1-K1-F5
cccacgcgtccgtccacaccacgtcgtctccgtgcacgagggcaactaggacctggtggtcctcgatcgggtggggcgcgaccacctgatgcgggatgaacgacctgtgggtgaagcactgctgcatgtcccacacggagtcgttcaaggacctcggcatgaccgtgctgccgagccaggtgaacccgctccgtcgcgcgccgctgtcgcgccccatcgtcggcgtcgggtgctcgtacacagcggacacctcggtcggactcttcggctactgcgccgtcgttgggatcccggccatagtgtttctacatgacaaccgcatctcgctggagcagc

SEQ ID NO: 52374 - DNA, 421 bp, Zea mays
  Clone ID: LIB3067-023-Q1-K1-F6
ggaagctggaaatgtccccaatggtgacgaggcacatcatccagcagaggctacactggacctcgctagagagcgacataagcttgtgatcgccaacgaaatcgatcaagtgaatgagaggctacaggcccttgaggcagacagggagtacataaaacagtgcgtgagggccttgaaaaggggaggcgaagggttcgatcttctccaggagatattgcagcatcttcgggacctaagaaggatcgagcagcgcggaaggaactctggggagctttcgcctcattacctacatctttacacggactgaagatcagctgcaaagtctcgtgcccaatattgcttgaagatggaaaccataagacaatgataatggggggggggggggaggattgtcgactaataactagcattggcattggag

SEQ ID NO: 52375 - DNA, 340 bp, Zea mays
  Clone ID: LIB3067-023-Q1-K1-F7
tcccagacatcgagctctaccacatcgactccgtgcacgagctcaactcgtccggtgggctcgacgggtgggcactacacctcactgcatgaacgacctgacagtgaagcactgctgcatgtgccacacggagtctttcaatgaccttcctaatgaccgcctgttgacccagaccaactctgctgcgtcacgcgccaatagtcgctccccatcgccggcgtctgatactcgtccacgggatacacctctgccgcactctctccctactgcgacgccgaggacatccatgacatcgattttcttcctgacaaccgcatctagctcgagcaggtcattcatc

SEQ ID NO: 52376 - DNA, 432 bp, Zea mays
  Clone ID: LIB3067-023-Q1-K1-F8
aggccatctacaccatcgacgactactgcttcgttgccaaggacccatcaggcaaggagatcaatgctcttgagcagcacatcaagaacctcctcagcccgtccacaccgttcttcttcaacaccctgtacgacccctaccgtgagggtgctgactttgtgcgtggataccccttcagcctcagggagggtgcccacactgctgtctcccacggcctgtggctgaacatccctgactatgatgcacccacccagctggtcaagcctaaggagaggaacgaaaggtacgttgatgctgtcatgacaatccccaagggaaccttgttccccatgtgcggcatgaaccttgccttcgacagggatctcattggccctgccatgtacttcggtctcatgggtgatggccagcccattggtcgctacgacgacatgt

SEQ ID NO: 52377 - DNA, 54 bp, Zea mays
  Clone ID: LIB3067-023-Q1-K1-F9
cccacgcgtccgcccacgcgtccgcccacgcgtccgactagttctagatcgcga

SEQ ID NO: 52378 - DNA, 392 bp, Zea mays
  unsure at all n locations
  Clone ID: LIB3067-023-Q1-K1-G1
cccacgcgtccgccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggacgatgatgaccttgatctttttggtgatgaaactgaggaggacaagaaggcagctgatgagcgtgccgncgctgccaaggcctcttctaaaaagaaagaaagt

SEQ ID NO: 52379 - DNA, 414 bp, Zea mays
  Clone ID: LIB3067-023-Q1-K1-G10
gtgccaatttattgatttttatggtggcaaaatctcaagatggacatcaacaaacagtccaagttggctcgatcgaatattgagcttagagaatattacagatgacatcctggaagatctaggtgctgtatctgacgttgtaaacaagaaccaaagttcatatagttgtaaatataaattggaatcattactgggaagcatgtgtgacctttcacaaaggtcgggcctgatgaaatttctcaaaaatgcgatactgcttctgcttggtgttttccctcgtaatcatatcctggaggaagctgttcttgttactacccaaatgtttactcctcaagagaactcttcctccattcaaactaatgcatcacgggctttggccaaaagtatgttgaagaaagaccgacaggatttttt

SEQ ID NO: 52380 - DNA, 388 bp, Zea mays
  Clone ID: LIB3067-023-Q1-K1-G11
cccacgcgtccgctctgcttgtagaccgccgatgggtcagcttacaagcaggcgaccttagtcatcggagtcaacacgcgtgactgatgacgctagctgttgtctacgctgactgcatgtgtctagtcgataccttatgcctgtacgctaaactgtatagccagatcagatgctgacgaatatgtactgttagctaggacctgtgtgatcgcatgtacagctactagcatatcagctttgtcgcatgtaaaatgcaagcccaaagttgcagaacccggactgctcgtacaagtacatggtgaactactagctacaaggctgtaggcagagtctctgtcgactgtaactgtatgtcatcgattcactccagatgttaacttggcgtatc

SEQ ID NO: 52381 - DNA, 442 bp, Zea mays
  Clone ID: LIB3067-023-Q1-K1-G2
atacggttcgggggaagctctctttcaaacacatgaaaacttggagcatttggctatgatggagaaggtcttagggcctctcccaaagcatatgattgtcagagctgatcggcgtgctgaaaagtacttcaagcgcggagtaaggttggactggccagagggagcggcctcacgagagagcatgaaggcagtctggaaattgcctcgtctgcagaaccttgtgatgcaacatgttgatcattctgctggagatctaattgatcttcttcaaggacttcttcggtatgatcctaatgagcgcctgaaagcacatgaagctctacaacaccctttctttaccagatgcatcagaagatgtggtttctgaggctacactgagattgaaaatgtcaatgctgcatatcttcattttgatgtgtaagaactacaaaaaaagtgagat

SEQ ID NO: 52382 - DNA, 409 bp, Zea mays
  Clone ID: LIB3067-023-Q1-K1-E9
cccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccgttcaccacccgcgtcactggcccggatactcgaacgtgtggcatcaactgctagggaggtggaaggtttgtagaaacagagagataccacgaatgtgccgctgccacaaattgtctgttagtaagttataggcaggtggcgttatttacagctacgtac

SEQ ID NO: 52383 - DNA, 113 bp, Zea mays
  Clone ID: LIB3067-023-Q1-K1-G3
aaaaaaaaaaaaaaaaaaaaaaaaaaaaaaaaaaaaaaaaaaaaaaaaaaaaaaaaaagggaaggaaaaataataaatgaaagaaaaaaataaacatgggtgtccactttcgg

SEQ ID NO: 52384 - DNA, 329 bp, Zea mays
  unsure at all n locations
  Clone ID: LIB3067-023-Q1-K1-D3
cccacgcgtccggcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgncgggctgtccgncgaccccgagaccttcgccaagaaccgcgagct

SEQ ID NO: 52385 - DNA, 431 bp, Zea mays
  Clone ID: LIB3067-023-Q1-K1-D4
attataccaagagttgctcacagaacggtctaattgtttgcaatggcgatatcacaagctcttcatggatatgtgacaatggttcgggttacaggtgctcgacctcggggagaacctgctctccggcgtgctccacccgacgctgttcggtaacctcaccagccttttgaagtgtaagatttgttattctttagttatataatttctagtagagacaacttaagtattacaactatgtgttagggagggttcaggaaaaagaatgaattttgtattcagcatatgtgcataatagggcttcgattctcaagtcctgtaatactggaagtatgcataagtgcataacagagtttattaaagaaagaaaagtcctcacttgctggcagtttatccattgtatttttgtaaattaaggttattaaagaatgaaa

SEQ ID NO: 52386 - DNA, 388 bp, Zea mays
  Clone ID: LIB3067-023-Q1-K1-D5
cccacgcgtccgcccacgcgtccgcccacgcgtccgcggacgcgtgggaactgaaggaacttcaggtccagcacctttcaagcccccatctggtggaagcaccagtgatgttgttgaagcctctggtaccgctaaacccagcgaaaatgttactgcgatggaggggaatgccgctcccaatgtaaatagcactatttcaaggcctatgccacagcggccttggcagcagacaggttatggaaacacctatggagggtatggtggatccaacatgtatagttcatatggtggatttggcaacacttatggtaccggtggactcggaaatagcatgtactcgagttacggaagaagttatggtggtggcatgtacggtggtggcatgtat

SEQ ID NO: 52387 - DNA, 421 bp, Zea mays
  Clone ID: LIB3067-023-Q1-K1-D6
acaatatttacacaaatggttgaaagggaagggactcggtcactctacctgggacttgcaccagcgttggcgagagctgttgtctatggtggccttcggtttggactgtatgagccctgcaagcatgtctgcagttatgcatttggttcaacaaactttgcttttaaatttgcatctggagtcattgctgggggccttgcaactgctttaacaaatcccatggaagttttgaaggtgaggctgcagatgagtaaaagcagtaccagtacaataagagagatgagaaaagttatagcgcacgaagggtttaaagcactttggaaaggagtcggcccagcaatgacaagagcaggttgccttactgcatcacaaatggcgacttacgatgaggccaaacaggccttaatgaagtggacaccac

SEQ ID NO: 52388 - DNA, 395 bp, Zea mays
  Clone ID: LIB3067-023-Q1-K1-D7
ctcagatgtgggctgctggttggcaaaaggctattgcagaagttggacccaatgttggctggtggatcgctgcgcagagcgtgttctatcacttatataaccaggtgtcctacatgtctctcgatcagatctctccattgacgtttagcattggcaatacaatgaaacgtatatcagtgattgtttcatctataattatcttccacacgcctgtccgccctgtcaatgcactgggagctgccattgccatccttggcacattcctgtactctcaggcaaaggcgtgaggctaaagctttggcctaaggatcggagccagtagcaggcactggatccagttttgcttgttggagtggcatgtatatataaggttcggttttcgtgagagagagggt

SEQ ID NO: 52389 - DNA, 424 bp, Zea mays
  Clone ID: LIB3067-023-Q1-K1-D8
aaagctatcaagtgtggacgcatctggcctccttgttgccaactctggcaacgatctgcctgtaattgatttgtctagtgtatcaccagagcttgcctttatggcaaatgatgctgatctggtggtgctcgaaggcatgggaagagcaattgaaactaacctatatgcgcagatgaaatgtgactcgatcaagattggaatggttaagcatcctgaggtcgcccaatttttaggaggaagactttatgattgcgtcttcaagttcaatgaggcctgaactacgagatacatttgataacacaataccggccgcactagtggtggcttagttctccccaagatcagcttgttaggtgttgcactgaacataattttgttagtatcagcaataatttcaatcaaaataagctacgtatatgtggtg

SEQ ID NO: 52390 - DNA, 446 bp, Zea mays
  Clone ID: LIB3067-023-Q1-K1-E1
cccggtggacgcacgcgtccgcccacgcgtccgctgacgcgtggtccttaaggagctgccgggcgcatacgccttcgtgagggacatgcctgtgctgggcgctgtccacatcatgcgtgcaggtggaggacgagcggacgctggcgatcagtggttagcggcgccaggaggagcgcgaggactccaagtacctgctcatggagcggcagctgcgcaagttcatgcgcaagttcgtgctgccggacaactccgacatggacaagatctctgcggtgtgcatggacagcgtgctcaccgtgaccgtcgagaagctgcccccgcccgagcccaagaaacccaagaccatcgaagtcaaggtcgcctgatgtgggactaggtctaccgatcgtggctctgaagatgtgggagcagtgccagcgagttgtgaggacctttacctgtgtgga

SEQ ID NO: 52391 - DNA, 194 bp, Zea mays
  Clone ID: LIB3067-023-Q1-K1-E10
cacactgctactccatagcatattcatctctggtgtcttacgtgatctgtttcgtgcttgggttgactagtcaccaatcgcaacacaggctgtcaaacaatagtctgtgtccttaatcttgttttagctgttatgttagtgtgtgcaactaaaactgggtaattaatgatatcgttttggtcgaccgtttgtgt

SEQ ID NO: 52392 - DNA, 94 bp, Zea mays
  Clone ID: LIB3067-023-Q1-K1-E11
cccacgcgtccgcagagatgtaatatttcacttggtctttgatctttctgtttgcagtatggtacacattgattactcaacaaaacatactatc

SEQ ID NO: 52393 - DNA, 409 bp, Zea mays
  Clone ID: LIB3067-023-Q1-K1-E12
gtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcctgaagtcccgaaagctggtcctggatgtcgtcaactgaggactatcattaccctttttttattgaaatatgttgagccgttaaggagc

SEQ ID NO: 52394 - DNA, 368 bp, Zea mays
  Clone ID: LIB3067-023-Q1-K1-E2
cggggcgtgcatctgttgctaacggggcggtgccggtgccgcatactattgttgtgtagctgatgtttgtcaaggtggctgctggcaaggttagccgaggaagtggagttcaataacaggatgcggaaactgtgccgctccttgccgaacttaagccccgttacgttgtcgcacaaagtttatttcctagcactgtgcttgctgcttatgtttgtttggatgtgccaacctgcagtgaccctcgtggagcctgggtctcacgctcctcttacctagtgtgatgtgcagaaaaagtgtgatgctgtaaaattatgtgattgcctagcagatgtcaaattttcaatcagtagctaactccttttaatggt

SEQ ID NO: 52395 - DNA, 217 bp, Zea mays
  Clone ID: LIB3067-023-Q1-K1-E3
atcaggctgtacggcctaccgacacgggtccgggcgatgctggagaagggtatctgagtagttgcctgcttgatttagaaataaaaacatctgtttcccagtgattgcagacagatgggtgtttggtggggagttcaccatgctgttttaccatccgtttacattgtccaaaccaaaatattatcattgctacatcagctgcttttctcattggttt

SEQ ID NO: 52396 - DNA, 426 bp, Zea mays
  Clone ID: LIB3067-023-Q1-K1-E4
gggagtcggccgccaggtcgcgtgcgaggaagcaggcgtacataatggagctggaagctgaggtggcaaaactcaaggaccagaatgaggagttgcagaaaaagcaggttgaaatgctaaagaagcaaaaggatgaggtcctggagcgaatcaacagccaacatggaccaaaggcaaagaagctttgcctgcgccgcaccctgactggcccatggtagcctgctgaagcttgcacaaaattgaccgaagtcaagatcgtcgggccagatgtgcccgtgtgtatatatcagatgaagtcaagagtactgagtaccccgttacccctgtagaccgccgctacttcagagctgccgttcttgttctgtgacgtgggtagtctgcgcctgacagttcgctgtttaggttcggttgcgcgatccttacatg

SEQ ID NO: 52397 - DNA, 377 bp, Zea mays
  Clone ID: LIB3067-023-Q1-K1-E5
cacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggagggggtggatcgggtggtggcagtggaggcggaggatctggtggaggcggcagcagcggtggaggcggcggatctggtggcggtggaagcggtggcagccgcggatctggcggcggaccgactagc

SEQ ID NO: 52398 - DNA, 390 bp, Zea mays
  Clone ID: LIB3067-023-Q1-K1-E6
cccacgcgtacgcccacgcgtacgcccactcgtccggtggagtaaagttgtgacatgcatcgttaaaaaaaggaggaaaaaaaaatagaaaaaaaaaagaaaaaaatatgataaaaataaaaaataatataattaaaattaaaagacgcaatagaagatgaaagagcgaaaagataactgaaataatacagacagaaaatggctgtagcttttgaagatctgattgtagtggcggtggaagctaagaaggtgggagctgaaaggaatgcactaattgagagcttgtggtcttattacaataaatgtgtaggcggtgtagaataccagttgcatagtatcttgcgcaattttaataaaagacggattccattggatggtgataatggaaaa

SEQ ID NO: 52399 - DNA, 388 bp, Zea mays
  Clone ID: LIB3067-023-Q1-K1-E8
cccacgcgtccgcccacgcgtccggaccttggagacagccttgcatacaatagtctgaagggcttaattctccgcaacacttttagggcacaaaagaacgctgaagatgaaagctgcgtgatagccctcggcaaccttcggtcagaagttatcaagctgagaaatgaagccttggagaaggacaaaattctactttcattggtggatagagtgaaagaagatgaatcaaagttgaacactcaatccgaaacttataaagccgaaattgaagaccttcagaaaaaacttgctgaagctaatgagaactttgcacttgcaaaagctagccaagaaattagtgaatggtcgaaaactagactagagaaaaatgttgaagagcttcgtgaat

SEQ ID NO: 52400 - DNA, 296 bp, Zea mays
  Clone ID: LIB3067-023-Q1-K1-D2
atcatacctacagtcgctcacagaaccttctacatgttcgccgtggcgatatcacatgcttggcacggctacggggcgagtccttcgcttatacaggagctcgacctgggcgagaacctgctctccggcgtgcttcacccgacgcttttcggtcacctaaccaagcttttgaagctgtagattcgatgatctctagtgatctcgtctctagtataaccaactctatccttgcacctatgtgttaggtacggatcagtaaaaacagttgctgttcaattcgacatatgtgcataatt

SEQ ID NO: 52401 - DNA, 425 bp, Zea mays
  Clone ID: LIB3067-019-Q1-K1-B1
gaagtctgctgcgctatcagcctatcaagcatcagatctttctaatgcagcgatctggtaacatttctactgtcctcgtcaaagcaaagccccagttaaactaattccccacgtcttgttgtttggtcagttgagttattgcgcctgcgaccattcaatgtttccccttagatgttggttctggtttggtgtttgtagcatgctctttctttcaccagtttctcaactctttgaatgaacaaaactgtgcattatttgttctttttttttactattatttctgtagtctggcgaagaggccataatactggcacccttccctttccactggacttatctggaacgagaagagcacgtttccgtctacctgctttttttggctataccatgtcaactagcaagtaagggttgttaggttgggtcat

SEQ ID NO: 52402 - DNA, 420 bp, Zea mays
  Clone ID: LIB3067-019-Q1-K1-B10
acgcccacgcgtcggaccacgcgtccggaccaagttaaatttaaaactggtcataggtagcactagctaacggtggcatgtcattgcaccaaggatgactacatagatgctttggcctcctatggagaccagacactctgattattccgctgctacttatgaataatgctgatcattcagtccaagcaagacaagcgcgcactctcgtgtcaaagctcatcaggctaaccccctaaatgcacaggcaaggaggccggcccgaggccgcgcatgcaaatgctgcacccactctcgcaatttatgtagcttttcctccatgctcgcatgcactatctcataccgacactacacctgcatccaccgttcctacttgcgcggtctcttaccgtacacacctcattcgccaatagctagctgatc

SEQ ID NO: 52403 - DNA, 424 bp, Zea mays
  Clone ID: LIB3067-019-Q1-K1-B11
gaagaccagttcccctctcctgatcgtcctgttcctcacagcagcagccatggcggccgagccggataagcaggcggcccccgcggcacatgagacggtcgtgcacatcgtgtacgttgaccgtcccgaggacgccgaccctgaggagttccacattcgcaccctcacccccgtactcggctgcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatcaagaagattgtgtttaatatggct

SEQ ID NO: 52404 - DNA, 166 bp, Zea mays
  Clone ID: LIB3067-019-Q1-K1-B12
aaggaatactcttcaatttttggagctcacttttgggcttttgaagcctatcctggagattgtgttcttttcttacgctgcggcacctaataaatgacttgccttctatgttttcgagaaacttacattattcttttctatataacaataatactgtctattcagt

SEQ ID NO: 52405 - DNA, 400 bp, Zea mays
  Clone ID: LIB3067-019-Q1-K1-B3
tcgaaaggctgttgcgctatcagagcatcaagcttcacatctttctaatgcaacagatctgttggcatttatactgtcctagtctaagctaagccccagtttgcctaatccctcacgtattgatgtttggtcacctgagttattgcccctgcgaccattcaatgttgccccttagatgatggtcctggttaggtgtttgtagcatgctctttctttcaccagtttctcaactctttgtatgaaccaaactgtgcattaagtgttctctacttttactattatttctgtaatctggctaaaaggccattatactggcgccctttcctttacactggacttatctggaacgagaagagcacgtttacgtctacctgcttttttaggctattccatgtgaact

SEQ ID NO: 52406 - DNA, 397 bp, Zea mays
  Clone ID: LIB3067-019-Q1-K1-B4
tcgctagccgccatatctcacggtccactcgagcaccaaaccctggggaagtgaggacaatgggcccggctggtgtcgggcgaaggcggcgcggtcgcgggcaaggaagaaggggtcgggttccttcacgatcgactgcaccaagccagtggaggacaagatcatggaggtcgcctcgctcgagaagttcctgcaagagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtc

SEQ ID NO: 52407 - DNA, 430 bp, Zea mays
  Clone ID: LIB3067-019-Q1-K1-B5
cccacgcgtccgtgacctctctggtaacgaaataattagtggaaagagttgcatatctgccacagaaaaaagctgcagcctggagaccatcgtcattcatgaaggatatgctggactagagaagatctcattggccgggtgtgctcagctagagaatgtactcttgacaggatcattcaatgagctcgtgagccttgatatctcaggatcagctgtgaagaggctggatctcagtgcaatgatagtgctgaaacttgatgagatcattctactagactgcaacatgctgcgtgcaatcctatggcctccggaaggaagaaagaaaagatatcctagcaagctgcgcattcaaacaaaaaaggagagtagcacacccagttatatgtggtggtatatttcagtatacgatgaaaggctgctctggtcactt

SEQ ID NO: 52408 - DNA, 265 bp, Zea mays
  Clone ID: LIB3067-019-Q1-K1-B7
aaaaaacaatcaagacactaaactggttacaaaagaacacaaacaaaaagataaatggatgcgaaaaaaaaaagctatagaactgtagtctataaacattcattggcggtattctggactaaatctgacttgattggtcttcgctctcaggggagaatatactctgcctgttgactgaactggcagtgcgcatcctgctctatcgtcttcgttgaagtggacagcgtatgtgtgatggttcgtgaagatcactggtgtgatcatt

SEQ ID NO: 52409 - DNA, 442 bp, Zea mays
  Clone ID: LIB3067-019-Q1-K1-B8
cccactcgtccgcccactcgttcgaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaacta

SEQ ID NO: 52410 - DNA, 376 bp, Zea mays
  Clone ID: LIB3067-019-Q1-K1-B9
gtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgattgggtgtcccttcccagtcgagatggaataaaataaatcatcaggcgccaataagcaaaaaaaaaaaaaacgaatggcacaatcaaagaaacaatcgaataaaataaatcatcaagccagacaaaa

SEQ ID NO: 52411 - DNA, 390 bp, Zea mays
  Clone ID: LIB3067-019-Q1-K1-C10
aaaaaaaataaaaaaaaaaaaataaaaataaaaattaaaggccggaactccagctggtccagggttgatggcgcctaaagtcgacatgatacccatggcatagaatccgctagatgaggagcccgcggcctagaatgcacacgtcgtgaataagacaacgcggagaatcggatcccaaatggcatgtccgctgacaaggatgtcgccaagggcaatatgggcaagaagaacgtcaagaagagcgtgtagacctaaaagatctacattttcagggtgctgaaccaggtcctgccggacattgttatgtcctccaaggccatgtggatcatgaactcttacattaacgatttctacgagaagttcgctcctgaggccgccaagttttcgcgc

SEQ ID NO: 52412 - DNA, 384 bp, Zea mays
  Clone ID: LIB3067-019-Q1-K1-C11
ggcacgcatcaggcctgaataaagcaggaaaagaagctgggaaccctacggggttcttcagaaagaagagatgccgctcgtgcatccagtctgctcctttcctaccatctgtcgtagttgttgttgtaacccttctgtcagttttttcattctattgttcggttgctccccttcaactgctccagttttcagttcttctagccggggcgggtagctcatgcaaaagtaggagtccagctttctggaagtttcttgtactaggtccgcgatgcataacagagatttctgaatcctgacagaaccttattactttcccttgagggatcaaatttcggcgactgaataattgtttggtttccagcataaaaaaataattattgtacc

SEQ ID NO: 52413 - DNA, 458 bp, Zea mays
  Clone ID: LIB3067-019-Q1-K1-C12
ttcccggtcgaccactcgtctcgcccactcgttcgcccactcgttcgctgacgcttttgctgacgcgtgggaaaacacttaagcggataaggcatacaaggaccggaacaagctaagcagctgaagaagccagcagaggaagagctcctgtcactagaaggcaccctactggaagaagcctaaagctgataagctggtcctctctggcaagtccagctgtcaaggagtacgtcaaggtcaagaggggcaagaagaagggcaaaaacagcgtgtagacctacaagatctacatcttcaaggtgctgaatcacgtgcacccagacattggcatctactccaaggtcatatctatcatgaactccttaattaacgatatcttcgagaagctcgatgctgaggccgtcaagctcgcgcgctataacaagaagcctaccatcacactccttgagatccatacc

SEQ ID NO: 52414 - DNA, 417 bp, Zea mays
  Clone ID: LIB3067-019-Q1-K1-A9
gaatcgacggaccgactccactcattcgaagaccgacctaatagacgtacatgcgcctcaaacaactccactgccaacagcgggtccggcgccttaaaacgtgtaaccatgatcaaactctggaattaaacatttataacgtcgatggccaaggaccatctcgcccaagctaaatcaaaggtttgtcattaggccaacggagaatgaaactatcacttatactttacttatctgaagttcatgagatggttgataaggctcagaggtagatacacctatgacataggacgggagaccataattcctaaaagaatatgtaccatatatacaacatgcatacgtttgccataggtgcatcaagatgcgtactgagaacgctatctaaatctttgataactacactcctagcaaccacag

SEQ ID NO: 52415 - DNA, 263 bp, Zea mays
  Clone ID: LIB3067-018-Q1-K1-H11
caattctgaattcgagggacgacgtacgcgtacgttcacgcgtgcggtcatatcagcctctgactattcaaccacctggaccgagatcgggcgggtgttaacaatccctgggataccaaggatgatggcttttgccggtccttatcctaagatgaatatggacccacttgtgaaggcattggccgaatgccatccgcggagggaacttgctacccttaaattgctattgggtaaccgcaaggctttttccagttggaacaaat

SEQ ID NO: 52416 - DNA, 283 bp, Zea mays
  Clone ID: LIB3067-018-Q1-K1-H12
cagggacacgaggccgcggcggccatggcatgaggcggcggcgatcggagtcgggaggatgatcccttctccgacggcggcaccaccgaaaccgactcggacgagtcctctccgcgtggggtgggggcccgcggtcccggctccacctgcaacccgatcctgacacgcctcgcggtgtcgcggaactcgagcccgctggccgcggccaccgatgccccaggggtatgcctactccgcttcgcctgggagtccgccgcgggctccctcgtaagctccgtcgttg

SEQ ID NO: 52417 - DNA, 356 bp, Zea mays
  Clone ID: LIB3067-018-Q1-K1-H2
accacgcgtccgaccacgcgtccgacacagggcaaccagacaacaattacggacagcatatgactggccatcaggaggaaacagcaataaccaatgctgcaataggacaattttatgggcctaatatacacaatggggttccttattttggtgcacctgagccctcccttcctccagatgcaacaaacaccatttatgttgagggcctccctatcaactgtactagacgggaagttgcgcgtatccttgtgtggatgatgatttctctttctgatcttattatgaaactgagttgtttgctggtctttttccaccgctgaactataatctacattcaggtgctgtcaatccatatg

SEQ ID NO: 52418 - DNA, 323 bp, Zea mays
  Clone ID: LIB3067-018-Q1-K1-H3
aatattatcagaagatgtctttataaaccacatattcattgtactgtacaatattgatgctgatatagggatctacttagcatatttgtgtgtgcatgcaccatgttattcacaatgctgtatccttatcttagttctttcaggacttccctgatcatttgcatgaaagggccgtttactctcagcaaatgtcatgattacgatttttttagtatcctaattgctgttagttgatagctgtaacttaagagtctgaaagaggctgggaaaaaatgatactggtgacttaccagcacctggttggtaataacttattccacttg

SEQ ID NO: 52419 - DNA, 96 bp, Zea mays
  Clone ID: LIB3067-018-Q1-K1-H5
ctccagtacaagaccgatcgagagcccctcaatctggtccacgagcgcatgccggactagagtgcccaacaacatggtcccaaaggctgactaatc

SEQ ID NO: 52420 - DNA, 60 bp, Zea mays
  Clone ID: LIB3067-018-Q1-K1-H6
cccacgcgtccgcccacgcgtccgccaaacgcggcccccttgccctctactacttctcct

SEQ ID NO: 52421 - DNA, 70 bp, Zea mays
  Clone ID: LIB3067-018-Q1-K1-H7
cccacgcgtccgaaaaaaaaaaaaaaaaaaataaaaaaaaaaaaaaaaaaaaaagaaaaaagggaacgga

SEQ ID NO: 52422 - DNA, 391 bp, Zea mays
  unsure at all n locations
  Clone ID: LIB3067-018-Q1-K1-H8
ggctgctgaagaacacaaaagatatgtagcataatacagagcttttctagaatcatgtgacgtcatcaaggcaagtactcagtggagaaaagttcaggaacgtctggaggacgatgaacgttattcccgacttgagaagtttgatcggttggatatttttcaagagtacattcgacacctagagaaagaagaggaagagcagaagcgggtacaaaaggatcaagtgagaagacaagagaggaaaaaccgtgatgggtttcgtaaaatgctggaagaacatgttgctgatggcacacttaatgcaagaactcnttggcgtgattactgtgcacagataaaagattcacagtcctacttggctgtagcgtcaaacacatatggttctacaccg

SEQ ID NO: 52423 - DNA, 458 bp, Zea mays
  Clone ID: LIB3067-019-Q1-K1-A1
acacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaagatgcgtgtccctaagcgtctgctgcgcaagtatcgtgaagcaaagaaaatcgacaaacacatgtaccacgatatgtatatgaaagtaaaaggaacatggtttaaaa

SEQ ID NO: 52424 - DNA, 394 bp, Zea mays
  Clone ID: LIB3067-019-Q1-K1-A10
atctgcaggcaaggccattactgatgagagcgctcgaggatggtgaatatgatgctttggtggatcctcggctcggaaaggacttcaatcctaatgagatggcaagaatgatagcctgtgcggctgcgtgcgtacgccattccgcacgtcgtcggccacgaatgagtcaggtcgttcgggctctggaaggcgacgtgtctttggaggaccttaatgaaggtgttcgacctggccatagccgcttctttgggtcatatagcagctctgattacgattccgggcagtacaacgaggacatgcagaagttcaggaaggcggcgttcaataacaacacctacaccagcagccaatacagcgcgccaaccagtgaatactgccaggtgccgtctggatc

SEQ ID NO: 52425 - DNA, 423 bp, Zea mays
  Clone ID: LIB3067-019-Q1-K1-A11
ctcatggaaagtatccactaaaggcagtcaaggtgatgcacactgtggctctcataacagagtccaggctttataacccaactacttctcctagtcttgttgcatctgcacagggtctacagaatgaggacttctccccaagccagctaagtcaaatgttcggatctcatgcaacgatgatggccaacaccctttgcacaccaatcattgtatttacacagacaggctccatggctgtcctcctgagccattatcgttcctcgtctacactatttgcatttacaaacgaggaacgagtgaagcaacggctagcactctaccagggcgtcatccctattcacatgcagttctctgacgacgcataagaaactttctccagagcaattagcagcttgctgaaagcacaatatgtgaagaaaggag

SEQ ID NO: 52426 - DNA, 433 bp, Zea mays
  Clone ID: LIB3067-019-Q1-K1-A2
cggacgcgtggggcactgggatctgcaagaggtctttcttacttgcatgatcactgcgatcctaagatcatccatcgggatgtcaaagctgcaaatattcttttggatgaggagtttgaggcagtcgtaggtgatttcgggcttgccaagcttatggactacaaggatacccatgtcacaactgctgttcgtggaacaattggacacattgctcccgagtacctatccactggcaagtcctctgaaaagaccgatgtttttggatatgggatcatgcttctggagcttattactggacagagggcatttgatctagctcgtcttgcaaatgatgatgatgttatgcttcttgactgggtgaaaggactgctgaaggagaaaaaggtggagatgttggtggacccagatctacagaatgcctacgaggagatcg

SEQ ID NO: 52427 - DNA, 331 bp, Zea mays
  Clone ID: LIB3067-019-Q1-K1-A3
ctgattagtctgggacggaaactatggttcggatcaccgttggcatgaatgtgaaggctgaccgtgacgagtcgtcaccttacgctgctatgcttgctgctcaagacgtcgcacagcgctgcaaggagcttggcattactgcactgcacattaagctacgcgccaccggaggctacaagaccaagacccctggacctggtgcccagtatgccctcatggcgcttgctcattccgggatgaaaatcggacacattgatgacgttaccccggatcacactgacagcactagccgaaagggccgtaggatgcgaaggaggctgtatgcgtatcg

SEQ ID NO: 52428 - DNA, 450 bp, Zea mays
  Clone ID: LIB3067-019-Q1-K1-A4
cgagctcgctttgttcgaatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgtccgctgtcgccccaccttcctctgaagaagccacagttcagcgcgactttctcaatctcgcatcgtatattcggtgtcgcgttgggagttgccatcgtatctgttcctctcgccaccaagttcagcctaatgtttggtgtctgagagcgatttgctgcgtc

SEQ ID NO: 52429 - DNA, 444 bp, Zea mays
  Clone ID: LIB3067-019-Q1-K1-A5
gtcattgcagtggatgtccttgatgagaagctccagaacgctacaacacttggagcaacccacactgtaaatgcagcaaaagctgatgcagttgaaaggataaaggaaattactgatggtaggggtgtagatgtggctatagaggcacttggtaaggcgttaacattttcccagtgcgccaagagtgtgcgtgatggaggcaaagctgttatgatcgggcttgctgcaacgaacgtaatgggagaggttgatataacccgtcttgtccgacgacaggtgaaaatcattggctcatatggcgcaagggccaggcaagaccttactcagatagtgaagctcgcggagagtggtgccttcaatctccagaacaccatatcaaggaaatgcatattcgaagaggcgaatggcgcctatgaagatcctaatcagggcatgatcgtaaga

SEQ ID NO: 52430 - DNA, 333 bp, Zea mays
  Clone ID: LIB3067-018-Q1-K1-H10
ggcctaccggctggtgctgcacctggtggtccggtggctggagctcaacgtggaccccttcaagtcacgggtgttcttcgtcaccgcttcgccgacgcacactgactgcaaggcgtggggcgacgactactcggagggcagctgcaactgctacaaccagacgtcgccgatcagcgccgcctcgttctaccgtggcggcacgagccaggagatgctgctctcgacagatgaggtgctggccacgtcgcgggtgcccgtctggctggtcaacatcacgcggctgtgcgagtaccgtcgggacgcgcacacgcagacctacaagaagcagtgggt

SEQ ID NO: 52431 - DNA, 394 bp, Zea mays
  Clone ID: LIB3067-019-Q1-K1-A7
gtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcatgaggctcttccgggtgacaatgttggcttcaacgtgaagaacgttgctgtcaaggatctcaagcgtgggtttgtggccttcaacttcaaagatgaccctgccaaggaggctgccagcttcaccttccaggtcatcatcatgaaaccaccctggcagatt

SEQ ID NO: 52432 - DNA, 287 bp, Zea mays
  Clone ID: LIB3067-019-Q1-K1-A8
ccaactcgtctgtgacactattgactatgctggcaactgcaggattcacgcatcgggctgcaggctaggactacggtcttgctgcactcatgactggtgtgcattcaagcaagatccggactacatgatcgaaggggttgaccgttctgaactaccgacacctgaagtatacgccaagcgtacgactagaccgctatagattgttatagcttacgatatgaggaagattgaagtagcgtgctaaatcatgatgaaatagagcatgaagtcactgccacacccgaaac

SEQ ID NO: 52433 - DNA, 440 bp, Zea mays
  Clone ID: LIB3067-018-Q1-K1-F11
cccacgcgtccgcccacgcgttcggccacgcgttcgctcacgcgttcgcggacgcgtgggctgtggctccgaggtgtatagctgtctctcacacatgtcggcaccatgtcaggcgcctgcaccagggcttgtgctctgcaagaacgatctcccctgagatgaggagcaacccagactctgatagccagtacttggccgagctgctcgccgagcaccataagctgggggcattcatgcaagtgctgccgatacgcagccagctgctcaaccaagaaatcatgcgggtgtcaagcatggttcatgaccatggattcagcgatcttgacagacaccggtttagaaagactagccctatgtcttgaccgatggatcgggctgatctacatggaaacggtcgcggaccatggaatgggatgcaccaagagagattgggctttcct

SEQ ID NO: 52434 - DNA, 434 bp, Zea mays
  Clone ID: LIB3067-018-Q1-K1-F12
cggactcgtggggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaagctcaacatgcttgccaacgatcaggtccgtcccctgttgcaggacgtcgccacatccatggccaggctcggttccttgctgccgtccgactttga

SEQ ID NO: 52435 - DNA, 312 bp, Zea mays
  Clone ID: LIB3067-018-Q1-K1-F2
atcctcgcatttcttcccatcccccttcgcaacccaaaccccaactcgccccgcatcgatggcgcccaaggccgagaagaagcccgcggcgaagaagccggcggaggaggagcccgcggtcgttaaggcgcccgccgggaagaagccgaaggcggagaagcgggtccctcctggcaagtccgctgccaaggagggcggcgagggcaataagggcaagtaaaagggcttgaagagcgtttaaacctacaagacctacatattcaaggtgctgaaccacgtgcacccggacattgacatctccttcaaggccat

SEQ ID NO: 52436 - DNA, 339 bp, Zea mays
  Clone ID: LIB3067-018-Q1-K1-F3
gtgaatttgtatcccttttatgacaaagtcacctctggtaacatctcttttgaggatggcattgaaaatattgatattggtgggcccacgatgatcagagctgcagccaagaaccataaggatgttcttattgtggtggatcataatgattatcctgctttactggagtaccttaaaggaaagcgagacgatcagcagttccccaggatgttggcatggaaagccatgcagcatgtcgcctcttatgattctgcagtgtcagaatggttgtggaagcaatcaaataaaggagagatgttcccccaagctttactgtgccactggagctgaagtctacac

SEQ ID NO: 52437 - DNA, 425 bp, Zea mays
  Clone ID: LIB3067-018-Q1-K1-F4
catttggaccgctgctatgtgaagcagtacaaactaccatcgcttagcaacactgctgctacctctttctttgatccagtcttttcctacttcaatgatgaagcaagaacggctcttcttactatgatccaacaagaacgtgatgggatcaggatggattcgagccttcgggatgttatgcatggcatatgttgttctgaagcaaaatccataatgcaaaatgcttttcttgatgaaatatatggctactactcggtgagaagttccgaatggattaagcactactccttgccagattaccttgctaaggttgaggaaagtatggaaatggaaaccaagagggtggcttactatctggaaatttcaagtggggatagctacccgctctgtttgcagggctgtaatgctcctttgatggaaacata

SEQ ID NO: 52438 - DNA, 188 bp, Zea mays
  Clone ID: LIB3067-018-Q1-K1-F5
aatctgtgaaattaaggccaggccccgtttggcaggtctccggctcctcttaaaatggctccggctctggtttcagctccttcgcaggagccggtgttttttttttgtaaattgtttggcaaaacagatccttttgtgtttttgatttggtgtacgagacaagattatggtgaaaaaatattttatgg

SEQ ID NO: 52439 - DNA, 306 bp, Zea mays
  Clone ID: LIB3067-018-Q1-K1-F6
attttagaatccttggataaaggggttagagaaggcaggcatcaagtgcatgcttggctatccctccttgcagcccggtataatcaggccctgagttctgatgtgcgaccgatgtcgagcatagacattgacttctcacagtgcctacagcttcaaacgatacctcagcttgtttttgcattgttgagaagtcctgttcttcgcttgcatgaagaaggcgtgctcccagattacaggatatatctacaatgcctttacagtgcactggagccatcatctgtagctaaagccatatatccggtttta

SEQ ID NO: 52440 - DNA, 453 bp, Zea mays
  Clone ID: LIB3067-018-Q1-K1-F8
agggcttcggatcccacaccgaggaaaggagaagagagggtcggaataatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtcgacgaactgctggaacggcgagacgctcgagagctttgctaccgtcgacgaggacgagctccgggacgccgtcaggaagtacgccggcgctggcactacgacggctcctgcctcggcgtccgcctaattcaggagatgtgatgtgtagcagatagcgcgcgcgcaccagtcgtcaataaataaataaataaataaataaataaa

SEQ ID NO: 52441 - DNA, 433 bp, Zea mays
  Clone ID: LIB3067-018-Q1-K1-F9
cggacgcgtgggcggacgcgtggggtggcgacctccagctccagctccagctccacacgcgggcgccaccaaggagctgagccgagcccggcactgtcggcggccatgtccgcgccgcgtcgccgcatggccactgcctacccgtcgctccgcttcctcggcctgctcaagcaacccgacgacgccagctcccagtcccacggcgtccaggagctggagctcgacgagcgcgacgtcgtctggtcctccggcagcgcgacctcctcgtcctcgacctccgcggcctcctcgccgtccccgaccgcgtccccgaccgccagcctcgggaggccgatttccgcctcgtcccgccacttccccgccggcagcatggggctgtccgcgctcctcgccgacgccgacgaccaccacgcgcccaccgcgcccgtcccgg

SEQ ID NO: 52442 - DNA, 112 bp, Zea mays
  Clone ID: LIB3067-018-Q1-K1-G1
aaaaaaaaaaaaaaaaaaaaaaaataaaaaaaaaaaaaaaaaaagaaaaaaaaataatttaaagggaaaaatagaatacacataaatgcaaaaaaataaactaaaaaataat

SEQ ID NO: 52443 - DNA, 437 bp, Zea mays
  Clone ID: LIB3067-018-Q1-K1-G10
cccacgcgtccgcccacgcgtccgcccacgcgtccgcgaaaccaagtaaaagatggtacctcgacaagttatattttcctcttatcctgcttaaatctaaggatgtcctgtaacatcactaacttaggatatgggtgatggtctgatcccaatggacaatggtctcctactttctcgattcgacgcctgagagacgcctgattccataccatatgcctgtggttgtagtttgtaaaatgctaaaaacttgactttgctagtatatttcctaatgctataacccaatcctgggtaaacagacgcatggggatgaatcttggacggaaccatggacatttgatgtatgtgtttaatgttgcgtacaatctatgtcgaattctgttgtaagtgccgttcgcatagttttatatctttgtgcccgttattacaggtcttaa

SEQ ID NO: 52444 - DNA, 437 bp, Zea mays
  Clone ID: LIB3067-018-Q1-K1-G12
cggacgcgtgggcggacgcgtgggtttcatgccagctatggtaacagcagccagaacaatcggactggtgacaatccgagcttgccacccagctccagcaacaatcagtccggggatggtctcagttttcatgaaaggttctatggatcacgcggaagggacgagagcagatcaaacaatgatggattccgtgctaggagcagaagtcctggcaagcctgtggaagtttccaactggtgattgcatccactaggtgcaatccaatttttgcgatggtgacgaaaccaagtaaaagatggtacctcgacaagttatattttactcttatcctgcttaaatctaaggatgtcctggaacatcactaacttatgatatgggtgatggtctgatcccaatggacaatggtctcctactttcttgatttgacgcctgagaga

SEQ ID NO: 52445 - DNA, 409 bp, Zea mays
  Clone ID: LIB3067-018-Q1-K1-G2
gtgaagttgacaatgaaaagatggaactcctgctgtcccaactgagcggtaaggacatcagcgagctcattgccgcgggcagggagaagtttgcttcagtcccatgtggtggcggcggtgtcgctgttgcggcagctgcacctgctgctggcggagctgctcctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaaggcttgtttatgttggaaagtactggaaagactgctacttgtctttatatttggtgattcagccgtatattgctatgctggttgggatttac

SEQ ID NO: 52446 - DNA, 257 bp, Zea mays
  unsure at all n locations
  Clone ID: LIB3067-018-Q1-K1-G4
cattggtggtgctctcttatttatgaccccattatttactgatataccccagtgtgcattggctgcaattgtgatttctgctgttactggcctggtagattatgaagaggccatcttcttngtggctattgataaaaaagatttcttttatgggcaatcacattaataccaccttaagttttggcattgaaaatggccttcctggtgggggtgcattcttattggcctttgtgaatcatgaatcaacaaattcacat

SEQ ID NO: 52447 - DNA, 444 bp, Zea mays
  Clone ID: LIB3067-018-Q1-K1-G6
cccacgcgtccgcccacgcgtccgcccacgcgtccgcccacgcgtccgtgtccggctaaagcgcctaaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgccttcaaccctttctcctctgccgtcgatgcactcaatcagtgcaacgctatatccgaagggatcatgaccgatgaactgaggagtttcctggagctgaacctgccgaagcccaaggaggggaagaaggccaaatacagcctcggggtcgtcgagcccaaggtcgtgtctcaca

SEQ ID NO: 52448 - DNA, 194 bp, Zea mays
  Clone ID: LIB3067-018-Q1-K1-F1
ggatgtggcactaagagatcaccttagacagaggagagatgatgatgatgatgacatgatggggtttttgctccctatgctacatatattgggttctagttcaaacatagtaacggaaaagaagcgaaggcatacatcaaagttaagtggcgaagaacatgttcaggagttgctccaaggtcatttgaagaact

SEQ ID NO: 52449 - DNA, 104 bp, Zea mays
  Clone ID: LIB3067-018-Q1-K1-G8
aaaaaaaaaaaaaaaaaaaaaaaaaaaaaaataaaaaaaaaaaaaaaaaaaaaaggaaacagggaaaaaaaaaaaaaaaaaaaagacaaaaaaaaaaaaaaaaa

SEQ ID NO: 52450 - DNA, 437 bp, Zea mays
  Clone ID: LIB3067-018-Q1-K1-G9
acgtccacgcgtccgtccacgcgtccgggctactgtagattccattcttttgagggagctccccggtgtagaagatgctgaagctaggcttgcactcaaaagattagttgacatcagcatgggcgtgctggcccccttatcggatcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttgatgatataacaatgttgttacataatgttccatatgttgaggagaagacaggcagggtgcatgctgctaggaagttatttgagtacttacaggccaatggcttgaacttccctgtaattcatcacataaaattgcctg

SEQ ID NO: 52451 - DNA, 411 bp, Zea mays
  Clone ID: LIB3067-040-Q1-K1-H3
gtgcaagcgccgcgggaaccgtgaccccgaccaccggcggcacaatgggaggagcgggaggcccagggaccttgacgcccgccgggacaggcgcaggcacagccggcactaccggcatggggactgcaggcactacgggtaccgggttcggcggcctaggaccagcaggcatggacacagcggcggcggcggcggggggcttgctcctcctcccagaggctgggctgtgcgctgccctcgtcgcgctcctcctctccgccatcgtgctcgcgtgacgccttcacatgacctcggaaacaacaacctactgcctgcatgctagtagtagtagaaagcgctgcccttttgggaggtgtatgtagttcaggagtactctgattatctatggagaaagggtgggaattattgggg

SEQ ID NO: 52452 - DNA, 391 bp, Zea mays
  unsure at all n locations
  Clone ID: LIB3067-040-Q1-K1-H4
ctgaactatgctggaaatacagtcagaagctctttaccgattggagccatgcagtacagtgtactgtgtacacagagactgtagaatcacccaggccccacttggaatgtggggatccatacaatttccactggatagtactgtttctgtgaaatagctgaaaagttcatgggaagttcgtgttaatcttttttatatatatatcttggtgggggcagaacagaagcagtcaaatattttttttgtgcatatgtgaaattccagagttgtgggtggtgagagataggatacaatgctgtatgtatttcaggaacttctgtaacacgagaacattcatcatgtgaaaaaaatgtaactcaatgtgttggccaaaaaaaaaaacnaatataat

SEQ ID NO: 52453 - DNA, 436 bp, Zea mays
  Clone ID: LIB3067-040-Q1-K1-H5
cccacgcgtccgcggacgcgtgggtgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagc

SEQ ID NO: 52454 - DNA, 438 bp, Zea mays
  Clone ID: LIB3067-040-Q1-K1-H6
cccacgcgtccgcggacgcgtgggggggaagcacaaggtggcgcagatggcaagctggaggaagcaaatgtgatgtcggcggacaagatgatggaggaagcaaatgtgacgtcggcagacaagatggaggaagcaaatgccatgtcggcggacaagatggaggaagcaaatgccacgtcggcggataagatggaggaagcagatgccacgtcggcggacaagatggaagaagcagatgccacgacgtcggacaagatggaagaagtagatgccacattgccggaaaagatggaagaaacaaatgtcacgttgccagacaagatggaggaagcaaatgccatgtcgccggacaagatggaggagaaaaattctgatccgaaagacaagatggatgaagagtgacgtggtggtgtaaccagttttgaaatagcgttagac

SEQ ID NO: 52455 - DNA, 430 bp, Zea mays
  Clone ID: LIB3067-040-Q1-K1-H7
cccacgcgtccgcccacgcgtgcgctgtgctctacgggaactccagcataacaccagtaactgccctcttaacgccatccgcgagaagtacaggcatcaaaagtttgaatgcgtagcgaacctaacttcaccggagttccctcggtcgttcttcagctgacacgccaatggcaccgattgatgagcaacgttagcagcagccgtagcagcatgttgcgttaacattattgaagcatacacttttaccccccaatgtatgattgggctgggtgtcgctatcgagctgctgtgtaccggcctggcctttctcgagtcgaaagtgagatgaaaactgacagagagatggctacttggcttttcttcagcatgtttgacgtaaaaggttcacccaggtgtaaacaacactgtgtgtaaggctttttgctagggc

SEQ ID NO: 52456 - DNA, 281 bp, Zea mays
  Clone ID: LIB3067-040-Q1-K1-H8
cggacgcgtgcgctgtcacggaatatgtacatatgtttcacaggggtatgccagcgcgggtaagcatctgtgctctgtgcgagcgatatgctggcatgagcagctgcaatgccttgagaccctatcttgaacgcaaattccttgtccgagctcaagatggctcacgtatatgacacgtcgatgagtaacattgacgtagctcatgccacatgtagcgtcaacatggtagaagcatatacctctacgtcggacaatatgaaagaactggatgtcacaatgcc

SEQ ID NO: 52457 - DNA, 91 bp, Zea mays
  Clone ID: LIB3067-040-Q1-K1-H9
cctaccaccaccgctcacctcggttgggctttctcccctcttccgaacccgcttctcgcgccggattccggattccctctgctctttccct

SEQ ID NO: 52458 - DNA, 241 bp, Zea mays
  Clone ID: LIB3067-042-Q1-K1-A11
ccagcgtcggacctgcccgctcgtaccgcttatttgagccggcggcccacaggggatctacgacccagtagacctaacgcgcgcggcccaggccgcgcggccgggacgcgacgccggcactcacggctcgtccccgccttctaccacccgacgatcgcgcggcggggagagtccgcccaccacgacacagcgggcgtctagagaccaagctacgaccggcagcagcatacctcttaggcac

SEQ ID NO: 52459 - DNA, 191 bp, Zea mays
  Clone ID: LIB3067-042-Q1-K1-A12
gtccgtcagatcgcgagcggctgttcttttctttattctaatacccatctctatctaattatatgaagttttttatcatcaacatagccagctaaactcaaatcacaaattgaattaatcaatacacaaaaaccccaaatggaaccctcatctatctaaaccaataatatataatactacctgaacaagtc

SEQ ID NO: 52460 - DNA, 231 bp, Zea mays
  Clone ID: LIB3067-042-Q1-K1-A2
acccactcgtccggtttttgagtcgcggattctgatggacgtataatcgtagtcatgtttggactttaactttgggttatgttggaaagtacttgaaagacttttcctgtggtaattctaggcgtatgttgctgtgctggttggggtttactggtgaaccagagtttttctatctcccactatgaatttgttacctcaagttacctggatgttcactaattttgttggtac

SEQ ID NO: 52461 - DNA, 435 bp, Zea mays
  Clone ID: LIB3067-042-Q1-K1-A3
accacgcgtccgtccacgcgtccgccctcttccgcacccgcttctcgcttcggattccggattccctctggggtttccctaacgaaggtagccatggcggggagaggtaaggcgatcggctcaggcgccgccaagaaggccacgtccaggagctccaaggctggcctccagttccctgtgggaaggatcgccaggttcctcaaggccggcaagtatgccgagagagtctgcgccggcgcccctgtctacctcgctgccgtgctcgagtatcttgctgctgaggttcttgagctggccggcaatgcggcacgtgacaacaagaagacccgcatcgtatcgtgccacattcagctcggcgtccgcaacgacgaaaagctcttccgctttgctgggacggtgaccatcggtagcgggggtgtaatgcccaacattcat

SEQ ID NO: 52462 - DNA, 158 bp, Zea mays
  Clone ID: LIB3067-042-Q1-K1-A4
cgcgtcgaaacattggatcatgcgatttgactcaaaagtctggtgggggagcaatgtagaagctagctgcactaaacctatcgaacgctctcatggctacgcacagatctcactgaccctgaagactggccgttaacagaactcacggatctacccat

SEQ ID NO: 52463 - DNA, 218 bp, Zea mays
  Clone ID: LIB3067-042-Q1-K1-A5
gctaaagaactacagtgttgtctttatctttcaactattattgtcatatggtgatgtgggcacaaagtgcgctctaaaggatgagcatgtttatgcatcggcaaaatgtcaggcctgaagggagcttataccttttctggcaaatgattggcacatagtactcataattagtcagtggaccaaaatgcttgaccatcatgaatgggcaatggaaatta

SEQ ID NO: 52464 - DNA, 354 bp, Zea mays
  Clone ID: LIB3067-042-Q1-K1-A7
cccacgcgtccgcccacgcgatttcccactcttacgaaaaaaaaaaaaaaaagagaaaaaaaaaaaaaaaaaaaagaaaaaaaaaaaaaaaaaaaaaaaaaaaaaaaaaaaaaaaaaaaaaaaaaaaagtacaacaaaaaaaaaaaaacctaagaaaataacaaatcaaaaaaaaaaaaaaataaaataaaaaaaaaaaccaaaaaaaaaaaaaatgacacctagaaaaaaacgaaaataacagaaaaaacacaaaaataaccaaaaaaaaaaaacataaaataaaaaaaacaaattaaacaaaacacataaaaaacaaaaaaatcaaaaaagaaaaaaaatacaaaaaaataa

SEQ ID NO: 52465 - DNA, 397 bp, Zea mays
  Clone ID: LIB3067-042-Q1-K1-A8
cccacgcgtccgcggactcgtggtttcacttgcaacacagtcctgcttcctttcggccattgacgtccacaatcattattcttatcaggtcatgctacctgaagcaattgcaatagttatggcacctactgacacaagaaaacatggtatatttcatctcacggatccaggtggcatgggcgtgatccatgattgtcaagagagaggtttccatcctcacaaggcaccacttgatgggtcgccaatatatgagcagtgctcccatgtgtacatggacaccgatataaagttcgatatgattgatctgcgacaaagatgacgaagctcacctttgggtttattttgcaacctatacttctcgcagttaaatcaattgctgcccttattttttcttagc

SEQ ID NO: 52466 - DNA, 457 bp, Zea mays
  Clone ID: LIB3067-042-Q1-K1-A9
acccacgcgtccgcccacgcgtccggaaggttattactcttgtcttggggctccttgttgctggaactaaataccgaggagagtttgaagagagactaaagaaacttatggaggaaattaagcaaaatgaagacattattctctttattgatgaagtgcacacactgattggagcaggtgcagcagaaggtgcgattgatgctgctaatattttgaagccagctcttgctagaggtgaacttcagtgcattggtgccacaacactggatgagtataggaagcatatagagaaagatcctgccttggaaagaaggtttcaaccagttaaagttccagagcctactgtggatgaaacaatacagatcttaagaggacttcgtgagagatatgaacttcatcacaaactgagatacacagatgatgctttaattgctgctgcacagctgtcttatcagta

SEQ ID NO: 52467 - DNA, 433 bp, Zea mays
  Clone ID: LIB3067-042-Q1-K1-B10
ccacgcgttcgcccacgcgttcgctcgtcctcttcgtctttatttgggtcgcaatgaggcttatacatgggcggggacatcagagagctaataatgaaacagaagaggcaaggaagaagataagaaaattcaaggaatcagcttggaaatgtgtttatttcctgtctggagagcttttatctttgtctgtcacatataatgagccttggttcaccaataccagatatttttgggtaggaccaggagaacaggtctggcctgaccaaaagataaaattgaaacttaaggctgtatatatgtatgctgctggattctacacatattccatatttgcacttatgttttgggaaacaaggcgttcagactttggagtgtcaatgtctcatcatgttgctactgttgttctgattgttctatcttacgtgttcatatt

SEQ ID NO: 52468 - DNA, 426 bp, Zea mays
  Clone ID: LIB3067-042-Q1-K1-B11
caagcaaccaccgccttcccgatctcgtttagaggaagccccatcccgaaaccgccgccgtattccaatggcgcccaaggccgagaagaagcccgccgccaagaagcctgcggaggaggagccggcggcggagaaggccccggcggggaagaagcccaaggccgagaagcggctccctgcgggcaagtccgcgggcaaggagggtggcgagaagaaggggaagaagaaggcgaagaagtcggtggagacgtacaagatctacatcttcaaggtgctgaagcaggtgcacccggatattggcatctcgtccaaggccatgtccatcatgaactccttcatcaacgacatcttcgagaagctggcggcggaagcggccaaactggcgcggtacaacaagaagcctaccattacgttccgcgagatcca

SEQ ID NO: 52469 - DNA, 427 bp, Zea mays
  Clone ID: LIB3067-040-Q1-K1-H2
ctgatcaaggccaaccatccgccctacggcatggacatgttgaaccacgaggccaccggacgctactccaacggcctcataccaacagacctcattgcgcccagcccagcagctcggcgtgaagcagctgcttccgccctacctgggcgtggacctgagccccgatgaccttctcaccggcgtcagcttcgcgtccggcgccaccggattcgacccgctgactcccgtcgtggtcagcgtcatctcgatggaccagcagctcgcctacttcgacgagtaccggtggaggctggtggacatcgccggcgaggccgagacggcgcggatcatcgagggcgcgctgttcctggtgtgcgccggcaccgacgacgtggccaacacctacttcaccacgccgttccgcaacgccgaatacgacatcccgggc

SEQ ID NO: 52470 - DNA, 390 bp, Zea mays
  unsure at all n locations
  Clone ID: LIB3067-040-Q1-K1-G1
cccacgcgtccgcccacgcgtccgggggctgatcgagctgcgcggcatcgagttccggtgcccgtcgaggcccgacgtgaccgtgttcaagggacttgacctgctgatgaaggctggcaagagcatggcgcttgtcggcatgagcggctccggcaagagtaccgtgctgtcgctcatcctccgcttctacgacccgatcgccggaagagtcttgatcgatgggaaggacatcaagaagcttaagctcaagtgtctcaggaaacacatcggcctggtccagcaagagccggcgctgttcgcgacgacgatctacgacaacatnctgtatggcaaggacggggccacggaagccgaggtcgtcgaggcggccaagctggcgaacgcgcactc

SEQ ID NO: 52471 - DNA, 434 bp, Zea mays
  Clone ID: LIB3067-040-Q1-K1-G11
gtacctgcctactcatgggacccttttgttcttctggatggggttcagggacatccagttggtgtgcatcatacaaattatgctccaagaccaaaatattcttctaataagcatgttgttccttctttgaaagcttcccacagtgcaaaatccacagcagatactgtcaaaggatcatcatcagctctagaaactgtaccaaatgctgccaatagcagcacatcatcaaagggtgcaaataaggcacctggtgcttccataacaaaaggatatcttccatctagcaagtttgtgatgcacagtaataaccaagcaaaaagcagtgtttatcaaagcaaaagcatcaatctgaaagaaagtggtagaagctggcacagcagtgagaagcttaaagccgagaagtagctaaatggacatggcgattctgaatctaa

SEQ ID NO: 52472 - DNA, 438 bp, Zea mays
  Clone ID: LIB3067-040-Q1-K1-G12
cccacgcgttcgatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacatccagccctacgcaatcctgaggaaggcaattgcatgcgctggaaatactgcccctttaattttctatacatactatccataagacactgtagaggtacccatggctctctgggctccaggatgggtgtctcataaaactctggcgtgcatgtatgtatggtgtgagagttgtcggcatacatttgcaaagtggacttctgcttgtaattctaaa

SEQ ID NO: 52473 - DNA, 444 bp, Zea mays
  unsure at all n locations
  Clone ID: LIB3067-040-Q1-K1-G2
aggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacacttgccgcccactgcctncttgaaagagatagaggaggagctgggagcccnccttaacatcctagagaagatcatttgggac

SEQ ID NO: 52474 - DNA, 431 bp, Zea mays
  unsure at all n locations
  Clone ID: LIB3067-040-Q1-K1-G3
ccaatcctttgggcacatttgtcatatggatgcttcttgggtatagcattgctgctgcatattctcgatatgacaaagttactgaagattgcagaaagatggaagagctaaaaacgcaggcagaagctgctgatgttgcaaaatctcagttcctggcaactgtgtcacatgagatcagaacacctatgaatggcgtccttggaatgctggatatgcttttaggaacagatctaactatgacacagaaggattatgctcaaactgctcaaatgtgtggcagagcattgattacactgataaatgatgtccttgatcgagcaaagattgaggctggaaagttagagcttgaagcggtgccttttgacctgcgttctctcatggatgatgttngttacttggtttcttcaaagtcacgggagaagtgcattgag

SEQ ID NO: 52475 - DNA, 445 bp, Zea mays
  Clone ID: LIB3067-040-Q1-K1-G4
cccacgcgtccgcccacgcgtccggcgcacagtcgatagaagcggaaacatacttcctggcaccgtggtcgattcgaagatttgccatcctactgagtttgacttctacctgtgtagccatgccggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgcccccggcgtactacgctcatctggcagccttccgagctcgcttctacatggagccagacacctctgacagcgggtcactggccagcggtgcccgtggccccccacccggtgcggcacgcagcagcacgagaagggccgggagtgtcgaagtcaggcccctacctgctctcaggagaacgtga

SEQ ID NO: 52476 - DNA, 323 bp, Zea mays
  Clone ID: LIB3067-040-Q1-K1-G5
ccacgcgttcggtggctgatttagctgcgcggcatctagttccggtggcgggcgaggccccacgtgaccgggttcaagggacttgacctgctgatgaaggctggcaagagcatggcgcttgtcggcatgagcggctccggcaagagtaccgtgctgtcgctcatcctccgcttctacgacccgatcgccggaagagtcttgatcgatgggaacgacatcaagaagcttaagctcaagtgtctcaagaaacacatcggcctggtccagcaagatccggcgctgttcgcgacgacgatctacgacaacatactgtatggcaagga

SEQ ID NO: 52477 - DNA, 388 bp, Zea mays
  Clone ID: LIB3067-040-Q1-K1-G6
cccacgcgtccgcccacgcgtccggtggcagagcccagcaaggaggaaaatgcagagaaagaggaggctcctgcatccgatgataagaaggatgataaagagtgaaggttgaaggcaaacaagggtcaaatggatgccattccattcatttcgtttccaaggttcagcttccccgcaaattttcattgtgttttctccgagatgaatgtttgtgttcggtgaaatcagagtcgtcagtcatctacatagcttttcttggttgatagactgttattttaagtcgcatgtttatctgggatggctggggtcagcatgtttgtacaattatttggagttgcttttggaatggacgcggtttgatgagttgcctacagcatgagatgtcaaa

SEQ ID NO: 52478 - DNA, 431 bp, Zea mays
  Clone ID: LIB3067-040-Q1-K1-G9
aaaacttgctgagcagaggttccctagcgagttcgagttgcgggaccttgttggcagcagattgcctgggtctccatttgggaggaatccggggaaaaccctgacttgatgatgaccccggaaatcagagctcagaatgccacaatttattatgttgcttttaaggtattagtagatagtaactatttggtattgatctatcgaggctgcagcttgtctgtaaacacaactttccagcttgtataatggatcaacggatcacctgatatgtgacggtggccgaagtactacgaactctaatgacgttggaacggtaaggatattgtgatggcctgttagtttatgggaggtgtactgtttggcattgatctcgatgtaaacaaacaatgttagccttgccccatggggaagattaagcgagcaggatgtta

SEQ ID NO: 52479 - DNA, 326 bp, Zea mays
  Clone ID: LIB3067-040-Q1-K1-H1
cccacgcgtccgcccacgcgtccgcggtacaaagttagaaatggaaaattttcacgtaagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaagaaaataaaaaatatgaaatataataattgaaatacatggaaaaactattatgaaaaagctattactatgaaaaacaaagattatgctaaaaaaagcatcatatgtatagcacaaacatttattacactgataataagtatgtaatag

SEQ ID NO: 52480 - DNA, 380 bp, Zea mays
  Clone ID: LIB3067-040-Q1-K1-H11
cgtacgcgtgggtgctagttcatcactgccttctatgagagggatcctgcctaactatttcagttcacagtggtcatttgctcatgtccatttaccacaagtcactcgtcacatagtagcctttggtgcccataatactgtgatgatggctggcctgcatggcatcttattcaggttcagttttgaccattcgaatggagggcagatgttgccacatgaacatttgcggcttctcaagtgcgacagcccacctttcatgactgcagccgattgacctgctgcacgtggatcatccatccgaccatgtaaatgtcgacatgccactgtacatatacgctgtctaccggctaagttataggcagacggaataaggatagctg

SEQ ID NO: 52481 - DNA, 430 bp, Zea mays
  Clone ID: LIB3067-040-Q1-K1-H12
cacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgccttcgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcttggtcagtcagatctgcaaacaaccaaactgtaaaaaagaactggagcctgtcttgaaatcatggagctgctgctgcttgacccatg

SEQ ID NO: 52482 - DNA, 405 bp, Zea mays
  Clone ID: LIB3067-040-Q1-K1-F9
cagcaatgcttcgcgagcggacatgattgctgcatgcgacgcccgcaaccttgacgctcttcagaaagagtttcctgtgtgagccctccggtccaaggcattagagcttccatggaaggaagcagcacactagcaagccgagtgactgcacctgtggtcatggaaatggaattggaaaccagtagcgttttgtatttgcctgttgattcttatatttatttttaggaagtgggggaatgtgtagcaactaggaagcgagggaacaacatccagttgatgtgaagcattcatggcacagtaggcaatagtggcaaaggggtactatacatacacacttacgggacgcacaacatatataaagaatggttgattaataaactatctattttggggacacacccctaa

SEQ ID NO: 52483 - DNA, 266 bp, Zea mays
  Clone ID: LIB3067-040-Q1-K1-E4
cccacgcgtccgcccacgcgtccgcccacgcgtccgatgaaaacaaaataaaggatttgaacttggcacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaataaaaaaaaaagaaacaaaaaaaaaaaaataaaaaaactaaatatataaaatacaaaaatagaaaatctactaataaaaa

SEQ ID NO: 52484 - DNA, 296 bp, Zea mays
  Clone ID: LIB3067-040-Q1-K1-E5
gcgcgggcgcgtgcgcccacgcgtccgcccacgcgtgcggtcaagagttctgaacataacaaccatatatggtgttttaagtgtttcgacatgtttacttccagtgtttctataacattattgagacagatatggagtgtactttgaggtagtttctgcaattcaagttatttggggattaataaatgattttaccagagcttcatcagtgtaaagacggagttcatatatcagaagccttatggagttcaagaacgggacaaccgcagcggaaataccgtgcttttgtcaaaatg

SEQ ID NO: 52485 - DNA, 437 bp, Zea mays
  Clone ID: LIB3067-040-Q1-K1-E6
cccacgcgtccgcccacgcgtccggcactggtctccagggcttcctcgtcttcaacgctgttggtgggggaacaggctctggccttggttccctcctcctagagcgcctgtctgttgactacggcaagaagtccaagcttgggttcactgtgtacccttccccccaagtttctacttcggtagttgagccatacaacagtgtactgtccacccactccctcctcgagcacactgatgtggctatactgctggacaatgaggccatctacgacatttgccgccgatcccttgacattgagcgcccaacctacaccaacctcaacaggcttgtgtcccaggttatctcatcccttactgcctccctgaggttcgatggtgctctgaacgtggatgttaacgagttccagaccaacctggtaccctacccgaggatccac

SEQ ID NO: 52486 - DNA, 433 bp, Zea mays
  Clone ID: LIB3067-040-Q1-K1-E9
attggtgtgggcaccaaacctcaagaacagactcaagacccaaacaatctgcagaggcaacaacagtccatgaaccaactacttccattgagccaatctcaaaccaatcttgtccaggctcaggtccttatccagaatcaaatgcagcagcaacagcaaccaacatccatggctcaaaatcagcagccagctgccagccagtcactgatcctgccccagcagcagcaacaacagcaacaacatcaacaacaaaagttggtacatcaacagcagcagattttactgcagcagcaacaattgcagcaacagcaacaaaatcagcaacagctaaataagatggctgcacaaatgccaaatctggtatcacatcagccgcaactgtctgatcagcagcttcaactgcaactgttacaaaaactgcaacagcagcagc

SEQ ID NO: 52487 - DNA, 421 bp, Zea mays
  Clone ID: LIB3067-040-Q1-K1-F1
gaatttctgcaagcagttatgaaggccagcgacaaaaagtttcagattggtgtacagtcagatccagtggaatttatgacatggctcttaaacacactgcatgcgaaactaaaaagttcaaagaagaaaaacagaagcataatacacgattgttttcagggagaacttgaagttgttaaggaggttcataggaagcatataatggaaaaaagagaggatggcggtgagctgaatggtgaggcaggttcagtggtgggaactgcagatggaattgttactgaaacatccaaggtcccattcctgatgctcggtcttgacctgccaccttcacctcttttcaaagacgccatggagaaaaatatcattccacaggtaccattgtttaacatactgaagaagttcgatggtgagacagttacag

SEQ ID NO: 52488 - DNA, 238 bp, Zea mays
  Clone ID: LIB3067-040-Q1-K1-F10
agcggccttactactgcatgcgacgccctttcctttacactctttagaaatagttctcggggtgagccctacgctccaaggcattagatcttccatggaaagaagcagcacactaacaagcagcgtgtctgcacctgtcgtcacggaaatggaattgtaaaccattaaccttcagaatttctccatcgctactaatactcatgtttacgcaacagtggaatgtgtgatacctaataaa

SEQ ID NO: 52489 - DNA, 395 bp, Zea mays
  Clone ID: LIB3067-040-Q1-K1-F11
cccacgcgttcgggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggatgctgcggcggcggctactgtggtggccgtgg

SEQ ID NO: 52490 - DNA, 413 bp, Zea mays
  Clone ID: LIB3067-040-Q1-K1-F12
gtactgcacactgccatcgctctcgtcccttcgctgccgctctatctcggccggagccatgggcggcggtggcgcggcgctgctgctggtgatgtgggcgggcgtggcgtcggcggccgtgtacgaggtgggcggcaccattgggtggaccgtcatgggcaaccccgactacgccgcctgggccagctccaagcagatcgtcgtcggcgacactgttgtgttcacgtataacaagcagttccacaacgtgctggcggtgagcaaggcggactacaagaactgcatcgccaccaagccgacggccacctggtccacggggaacgattccgtcgtcctcaacaccacgggccaccactacttcctctgcggctacccgggccactgcgctgccggccagaaggtggacatccgcg

SEQ ID NO: 52491 - DNA, 353 bp, Zea mays
  Clone ID: LIB3067-040-Q1-K1-F2
gccacgcgtccggcaatgtttagcgcaaatttcttgctgcccacagatgctggtcgttgcgttgctataccatgtatatgcccgtttatagtcgcactggatgatggtgcacaaacagttcaggtggagctggtaccctgtcccgacatttgcaccttacaaagtctaaggcttgttctacacattgatccttgctatgtgtggtcacgctcagacgacagcaactgctttagtggctctgcagagtctgacaccggatgcacagagcgtattgagactgcttgatgagtattcagattcataatgcaaggacgagagcttgccagtcaacatgtttgtatacgaaatggtcg

SEQ ID NO: 52492 - DNA, 435 bp, Zea mays
  Clone ID: LIB3067-040-Q1-K1-F3
caagagatagagattgctggtcgagaagaagagatgttacatatataataactactgtaggcagcggcatctcctgctgggacgaaggttcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccggcatcttcctcgtcgccgtcggggtgcacatgtacctcggctcctaggcggcgccggcgcgccgtaccttctcttcctctctatctctctctcgctgcacgcgcgccatccgtctcttcttttat

SEQ ID NO: 52493 - DNA, 444 bp, Zea mays
  Clone ID: LIB3067-040-Q1-K1-F4
cggacgcgtgggtccggacgcgtgggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgctctgtacggtctcattgttggaattatcctttcatcccgtgctggtcaatcccgggcagattaagtgcactaccattctgcaattaccgtactgtttattatgctattctaagagaattgaaaccctatgcccttgtctagtttattcttgctaccatgtattaatgaaacaatttgtagctgaaggaaagtgacacttccagccatgttggttttggcggtgttaagcagaggttatttattgggttaaggttggagg

SEQ ID NO: 52494 - DNA, 391 bp, Zea mays
  Clone ID: LIB3067-040-Q1-K1-F5
ccggctgccgtgccgccgcgtcctgctggccgctcccgcgttcatcgcccgaagcaccgccgggcgccgcggcctcgcgccagcgccaccgcccagaaaccatctttcccggccgcgccgctgagcccatagcccatatcggggcctcgttcggccgaagcgcgctgtgtcaaatttctgcgaccttgccgccgccgtcatcattctggagctcggattgatttcttcctttgctgtgctgtcattaccgaactaaaaacagtttctgagagcaagcgtcacaattgccatggaagctgggagaatggatcagccttgcatggcttctatcaatagccagcctttcgtggctgatactgagccagtgaagaaagccagtggggacatgcct

SEQ ID NO: 52495 - DNA, 431 bp, Zea mays
  Clone ID: LIB3067-040-Q1-K1-F6
cggacgcgtgggcggacgcgtgggcggacgcgtgggctaatgtatccatctatggagggtgctgagctttattatgaacaaaacgtgctggaggtggaacctgagattctcccggacatcagttggcgtctctctagttcagtagatggtaaagctaagattgctgaaggccgtcttaccgatgatgagcttgaccagtaccattctttggagaacaatccaattattattgagctgatagacgagccagcgatcccgcatctggtagtgtattgaagaatctgcgccagctggacagaaagctctgcttccttgctgcttgctctggaatctggagttgcctagtctagaatgctagtaagtcttgaccctggtgttgtccccaactatgttctgatgatgtaggatttcaggccgagtactggtaccag

SEQ ID NO: 52496 - DNA, 430 bp, Zea mays
  Clone ID: LIB3067-040-Q1-K1-F7
ctcaccacggaggattgagttggtgactggttggcacctatgcaatggcccagtgtaaattagtggtgcagtgggctggcgatcatgctgctagcaaccgaaattgcaagacttgtatcatacataaacgctattgcttttaccgactgacacggaagggtggagatcatgcatcaatgctattgcttttacaacctgacacagaagggtgtcattgttttttgtaggagttgccatctgaactggagagctacataggggataggttctgatcggaatgtgaatggcactagaaaattacttttactgtatctgcttgtgttgtcaagaaccgaatgaggtgcctggcatccttgtctgtaccctgtacactaaaatgtggagaatgttccctcggcagtaatcggctggacttgtaaggtgccagtgt

SEQ ID NO: 52497 - DNA, 326 bp, Zea mays
  Clone ID: LIB3067-040-Q1-K1-F8
cggacgcgtgggggaaattcaacatatataataatgcaagcaccggaaataaaattctactgtgttctgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaataatataacaaaaaaaataaaaaaaaaaaaaactaaaaataacaaatacaaaaactctacaaacataatagattacactaatttatagatttgcataacctatactttctgctctgaactaaaatcccattaaaacagcaaacttactgattaatcaa

SEQ ID NO: 52498 - DNA, 430 bp, Zea mays
  Clone ID: LIB3067-040-Q1-K1-E3
gcgaaggagaaaagcagttcttcagctatgagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagtcacaatccattttcctcctgattatcctttcaaaccaccaaaggtggcatttcgtactaaagtgttccatccaaacatcaacagcaacgggagcatttgcctcgacatcttgaaggaccagtggagtccggcactaacaatctccaaggtgctgctgtccatctgctccctgctgactgatccgaaccccgacgaccctttggtccccgagatagctcacatgtac

SEQ ID NO: 52499 - DNA, 261 bp, Zea mays
  Clone ID: LIB3067-031-Q1-K1-D2
ctccaaaccaaacgccccagccccaccgcacgcatacggcatacgcatccctcatctccctctcctggccttcccgccgcggcgccgcctctcctttccgaattccgactcccgcctccccggggtgcgtgtttccgcatccggctcgtccggcgatcctcgcgaggcctcctcgaccccgaccccgacccggcgcggccaccggttcaagacattcacaaaaaaacatgggtcatgatgaagctgtaggtactcagaatt

SEQ ID NO: 52500 - DNA, 301 bp, Zea mays
  Clone ID: LIB3067-031-Q1-K1-D3
tcggactcttgggaaaaaaaaaaaaaaaaatataaaaaaaaaaaaaaaaaaaaaaaaaaaaagaaaaatataaaaaaaaaaaaaaaaaaaaaaaaaaacaaatttatataattatattttactatctcttaaatactattatatacacttttcttttatatatactaattttaattaacttttatttttttttaaatctttttattttttataaattcttttatacccaatttactactcttttatatttttattttatttttcattttttcttatatttcaatatttttacatctttttt

SEQ ID NO: 52501 - DNA, 205 bp, Zea mays
  Clone ID: LIB3067-031-Q1-K1-D4
ctcataaatagatgaatgttcagaaaaaattaaattaaaaaaaaattatttaattaaaaagaaattgtataaataaataaatttaataatcaatttatttttaaattattatatctttttttccttctttttaactatattattttctcttattcttttttttttttttttcttttttcttctcttctttttttttttttttata

SEQ ID NO: 52502 - DNA, 456 bp, Zea mays
  unsure at all n locations
  Clone ID: LIB3067-031-Q1-K1-D6
ctagatgatgccatccaaattataaacagaaacaagtatggcaatggtgcttccatattgacaacatctggcgtctctgccaggaaatttcaaacagacattgaagctggccaggtgggcatcaacgtgccgattccagtccccctgccgttcttctccttcacgggcagcaaagcttcattcgcaggagatttgaatttctacggcaaggctggcgtgcagttcttcacccagatcaagacgatcacgcagcagtggaaggagtcgccggtgcagcgggtctcgctctccatgcccacctcgcagaagtgagacgtcaaggacgctcacgccactctccaaagcttcactcctttccactcctctggacatagacccacgcatgggccacangagaaggataattggtaggcatggcgacactccatgcatggccatgatactagtgtgtgctcg

SEQ ID NO: 52503 - DNA, 460 bp, Zea mays
  Clone ID: LIB3067-031-Q1-K1-D7
cccacgcgtccgcccacgcgtccggtacaagcaagtccaaaacttcgactggaggagcggggccgactggaagaccgccgccaacatcctcttcacggtgccccctaagcgcaaggagttcggctgtctatttagtggcccaatatgcacggagggagatcaaaaggatggaaggggaagcagaagagaaaaggaaaaaagacgaggaacttgagaaacaaaaacaggtcgaggaagaatctgccaaggaggatgctgattcaaagctttcgaaggtattagacaggctagatacactagagggtgtcgttaaggagattgtggatgacaaaaggaaactttcttcccctgatttaccgaccaaagaggaggttgcaaagaaaaatgaagcatctccggctaaggcttctgattccagaagctatggtcagccagtggtggctgccaatagtaaggacac

SEQ ID NO: 52504 - DNA, 450 bp, Zea mays
  Clone ID: LIB3067-031-Q1-K1-D8
cccacgcgtccgcggacgcgtggggcgacacttgcacgggtgtgcgggcgatcaggttgtgggggagcgtactcgtgactgctcgtttcgtccgctcgactaacgctgatccagttcttcgtcgtcggcgccgttcgtgggactgcactgcttacatctgcctgcgtcgactgcgtacgactacatcgaacatatacacgagatgtctcttgtgaatagagccactgatgccttgagcatcggtcactccgcaggttccatctaagagagaaggcaaacaactgtggaaaattgaccgcaaagcacataaggaggatggataggaaggaaatggcatggttcaaagtattctgccaaggaagaggcatacctgtgctgacctccgagctgttcacacggactccaaaagccgatcaatctctgcgatccatggtcaccaatggaatatag

SEQ ID NO: 52505 - DNA, 403 bp, Zea mays
  unsure at all n locations
  Clone ID: LIB3067-031-Q1-K1-D9
cggacgcgtgggcttgtgcgcagccgcagccgctgcttttcgttcgtcttcagtcctacgggagggcgaaacccacagaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagtngtttgtgacacggactattcggagaagccaccatctgtcagattccactcaaatatcaacatgacatgc

SEQ ID NO: 52506 - DNA, 445 bp, Zea mays
  Clone ID: LIB3067-031-Q1-K1-E10
acgacaagggccgtctgtccaaggaggagatcgagaagatggtgcaggacgcggagaaggacaagtcagaggacgaggagcacaagaagaaggtggagtccaagaactcgctggagaactacgcctacaacatgcgcaacacgatcaaggacgagaagatcgcgtccaagctggctgccgacgacaagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggaagctccggcggcatggacgaggacgctccggctggaagcggtggacctggccccaagatcgatgaagtggactaaacggtttgggtcagtctcgtgtgtct

SEQ ID NO: 52507 - DNA, 138 bp, Zea mays
  Clone ID: LIB3067-031-Q1-K1-E11
cccacgcgtgcgttgacgcgtgctgccatgcttgaaattttgacatagaaacgggagggcacctccactacaactaggcagcgcagatagttaggtcaaatcgatattgacctgagatgactgatcatagcttaaatt

SEQ ID NO: 52508 - DNA, 454 bp, Zea mays
  unsure at all n locations
  Clone ID: LIB3067-031-Q1-K1-E12
ggactacaacggcgcgaggaccaaggacgccatcgtcgactggatcaacaaggagctcggcccggccgtgcaagatgtcaccagcgtcgacgaggccgagaggatactcaccggggatgacaaagccgtccttgccttcctcgacactctaaccggtactcacagtgacgagcttgctgctgcttcaaggctggaagatagcatcaacttttatcaaacttcgattcctgatgttgctaagcttttccatatcgacccagcagcaaagcgtccatccattgtactgctgaagaaagaggaggagaagttgaccttctatgatggaaagtttaaagcatcagccattgctgaatttgtgtctgctaacaagcttgctttgattaccacactaactcaagaaactttcncttctatttatggcaatgcaatcaagaagcagatttactatttgctg

SEQ ID NO: 52509 - DNA, 281 bp, Zea mays
  Clone ID: LIB3067-031-Q1-K1-E2
cggacgcgtgggccgcggcgccgtcgtgccctgcggtgggaagcctggaaaccacgtcggacgttgatctcccgtgggacgctccagattaggaaatagtgtacccattcgtggagctcccgggaaccgtctgatggcggttgatcagataggattagatgttgggtactgtttcatctgatgggattgtgaccgtggatccacgggcggacgggcccgatgcgatctggttgtaattaaagccgaacaatagatccttaatcctgtggtcgtcattgtgc

SEQ ID NO: 52510 - DNA, 420 bp, Zea mays
  Clone ID: LIB3067-031-Q1-K1-E3
cccacgcgtccggtgtccggcgagccctacacgctgcacaccaacgtgttcacgcgggggcaggggcagcgggagcagcagttccgcctctggttcgaccccaccgccgacttccacacctactccatcctctggaaccccaagcacgtcatcttcatggtggacgacatgcccatcagggacttccgcaacctggagagcaagggggtggcgttccccaagagccagccgatgcggctctactccagcctgtggaacgcggacgactgggcgacgcagggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgccccc

SEQ ID NO: 52511 - DNA, 209 bp, Zea mays
  Clone ID: LIB3067-031-Q1-K1-E4
acgcccacgcgtccgtccacgcgttcgaaaggatccgattgtcatggatttctcgaacttggagtttgaggagtgagctggaatgactaaattatggttgatgcagtacagatatattttgagcttgaagaaaaatggcgggcttagtcttgcactacaagaagacagagtgaaagaaaaggggaggcacttcttaagggaccaatttt

SEQ ID NO: 52512 - DNA, 454 bp, Zea mays
  Clone ID: LIB3067-031-Q1-K1-E5
gtcaacgaggacgtctgccggcagtgctcctgctcctcctcctactcctcctccgtcccggccgccgcgcgagcttgggttagtgtctcttcttcgcggagacctgtgaggagagccatcatcatggccgctgttgagactgttgtcctcaaggttgctatgtcatgcgagggctgcgccggggcggtcagaagagtgctctcgaagatggaaggggttgaaaccttcgacatagacctcaaggagcagaaggtgacagtcaaaggcaatgtcaagcctgaggacgtcttccagacggtttccaagtcggggaagaggacctcctactgggagggggaagccacagccccggacgctgcggcggctccagaagccgaagcagctcccagcaccgcggcagaagcgccttctgctgctgctccggcggcgccagagatcaccccagccaaagctg

SEQ ID NO: 52513 - DNA, 284 bp, Zea mays
  Clone ID: LIB3067-031-Q1-K1-E7
ggccaggaaggtgaagctcgactccaagaggaccaagcttaccccggagactgcgaaggtgaaggctgctggcaaggcatggtacaagaccatggtctcggacagcgactacaccgagtttgagaacttctcaaagtggctcggcgtgactcagtgagcggcaagggtagttaagttctgagtagctcagcttatgttgagaggaaagagaatccatcaatctgttttatcctgcatcatcataacaagttgctacaagtcttgcatgttcgagttggttgtgc

SEQ ID NO: 52514 - DNA, 226 bp, Zea mays
  Clone ID: LIB3067-031-Q1-K1-F1
cccacgcgtccgcccacgcgtccgcccacgcgtccgcgctctagacactggtgaaccctagcctgctagccgccgcggcgccgtctttgccctcgctcggccacgcgccggcccgtcccgccgcgcgccctttgggcttggtcggccggccggccacgccttgttccgcggcgcgccatacgggtgggggttggcttggccggcccggggccgaccgggcacgcgc

SEQ ID NO: 52515 - DNA, 456 bp, Zea mays
  unsure at all n locations
  Clone ID: LIB3067-031-Q1-K1-B5
aacgagacgatcgcgctcaagaagatccgcctcgagcaggaggacgagggcgtcccctggaccgccatccgcgagatctgcctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgncgcaacaacctcttgaagctcgcggactttggactggcgaaggccttcggcatccctgtccggacgttcactcatgaggtacgtttcgcaccctgatgacacgctctcgatctggtagtatgctgg

SEQ ID NO: 52516 - DNA, 231 bp, Zea mays
  Clone ID: LIB3067-031-Q1-K1-B7
acgcccacgcgtacgctgacgattatgtccattccacacgcctctaccctatgcatcggcatcgtaacatctcgatcgcagtatccagagcgaggcgaggacaacatggcgcacattggaaggtggtggagaccatataccccgacgtgcttattgtccactgacggcaagtcaagaccgctggcattgctgaaaccctgtagctatggaacatggtcatctgtggacaac

SEQ ID NO: 52517 - DNA, 432 bp, Zea mays
  unsure at all n locations
  Clone ID: LIB3067-031-Q1-K1-B8
cccacgcgtccgaatctccccagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacagagctgctgatccgcaagctgccgttccagcgcctggtgcgggagatcgcgcaggacttcaagaccgacctacgcttccagagctccgctgtctccgcgctgcangaggcggctgaggcctaccttgtcggtctcttcgaggacaccaacctctgcgccatccacgccaagcgcgtcaccatcatgcccaaggac

SEQ ID NO: 52518 - DNA, 385 bp, Zea mays
  Clone ID: LIB3067-031-Q1-K1-B9
cggacgcgtgggctggaacggcgagacgctcgagagctttgctaccgtcgaggaggaggagctcctggacgccgtgaggaagtacgccgtcgatggcactacgacggctcctgcctcggcgtccgcctaattcaggagatgtgatgtgtagcaaatagcgcgcgcgcaccagtcgtcaataaataaataaatgaataaataaataaataaataaaggccaacgtacgacgacaaattagtggcgcgcgcggtagtagctagcagagtatgcgccgtcactgtgtcgatctgcagtttggtcgtttaatagtgattgtagtgtgtactatgtctagcttgatgatctcggagtcggtatatacgctcgctcccgtgctggacgggt

SEQ ID NO: 52519 - DNA, 77 bp, Zea mays
  Clone ID: LIB3067-031-Q1-K1-C1
cccacgcgtccgcccacgcgtccgcccacgcgtccgcccacgcgtccgcccacgcgtccggtagtgctagatcgcga

SEQ ID NO: 52520 - DNA, 466 bp, Zea mays
  Clone ID: LIB3067-031-Q1-K1-C10
cccacgcgtccgcccacgcgtccgatccggactctctcgctcgagggtagggcagggcggggcagggcaggcggcgatccgaatccaatcgccggagggaggaagccaccggtggccgcagtgagggcggcggaggtagaggcaaagggatgacgcgcgggaagcagaagatcgacgcgcagcggcgtaacgcggagcgaaaccagaaatccaaggggtctcagctcgaggcccgcgccgtcggcctcaagatcgtctgctccatctgcaaggtacaattggcaaatgaaaaacagctgaccgatcactatggatcaaagcatccaaaggagaaacctccgagcacatcgagcaccgaataaccatggctggtcgtgacgcagaaatatagatccttggctggtttgaggatctttaagtgcgtctgatccatgccttggacctcaacgtcaagtatatactctct

SEQ ID NO: 52521 - DNA, 377 bp, Zea mays
  Clone ID: LIB3067-031-Q1-K1-C11
gggactcttgcattgatgactgctgacacgggtgaaattcgtgcagaggttggggagcgcattgacacaaaagttgcagagtggagagaggaaggaaaagccgatattgtccctggtgttcatgttatcgattaagtccacatgctatacatcgagtgcttctccttgctgaaccgcgcgttgtaaaacgacatggcgccgatcttagcaatcgcaacgaaccgagggatcacgtctatccgcgggacaaactaccgctcgccgcatgggatcccgccagacttccttgaccggctactgattatcacgacgcatatttacacggaggatgagatccggaagatcctggatatccggtgcgacgaggatgacgtgga

SEQ ID NO: 52522 - DNA, 400 bp, Zea mays
  Clone ID: LIB3067-031-Q1-K1-C12
ggttttcttgcattgttcactggtgacacgggtgaaattcgtgcagaggttcgggagcagattgacacaaaagttgcagagtggagagaggaaggaaaagccgatattgtccctggtgttctgttcatcgatgaagtccacatgctagacatcgagtgcttctccttcctgaaccgcgcgttggaaaacgacatggcgccgatcttagtaatcgcaacgaaccgagggatcacgtctatccgcgggacaaactaccgctcgccgcatgggatcccgccagacttccttgaccggctactgattatcacgacgcattcctacacggaggatgagatccggaagatcctggatatccggtgcgacgaggaagacgtggagatgtccgctgatgccaaggttc

SEQ ID NO: 52523 - DNA, 191 bp, Zea mays
  Clone ID: LIB3067-031-Q1-K1-C2
ataaggtaaggggcgacgaaaatggctccaacgaccgacaccaacgacgacagtggctacggcggctagcgcctacgcaagctgcacgcgatcgacgacactaaacttgaggtgaaaggtctggtggactccggagttaaatccatactgttcatcttacaacacccaccggaagccctgagcgaaataat

SEQ ID NO: 52524 - DNA, 403 bp, Zea mays
  Clone ID: LIB3067-031-Q1-K1-C3
agcgttcctaatcaccgacgaataatctcttcttcacctcactaacaccgagctagcaggtcgctctgtcctgcaacaatggccgctcgctcctcctcccagcagctggtcgcggcggcggtcctggcagcggcgctgctgctgctggcggcggaggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccggcaacatccccggcaagtgcg

SEQ ID NO: 52525 - DNA, 283 bp, Zea mays
  Clone ID: LIB3067-031-Q1-K1-C5
acgcccacgcgtacgcccacgcgtacggttggcttctcctacccctccggttcgggtgcgggttcgtgaggttctccggggttcggatacatgggtgagcggatcgagatggctgcgacggatgttgagtaccgctgcttcgtctgcggtctcgtctgggccacggacgaccactcccttcacaacggcttcagcacctacggcgaggtcctagagtccaagattatcctcgatcggtagacgcatagggtcctcggattcagcttcgtcaccttcttcactg

SEQ ID NO: 52526 - DNA, 439 bp, Zea mays
  unsure at all n locations
  Clone ID: LIB3067-031-Q1-K1-C6
ctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctncaactcctncgatgccttggacaagatcaagtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctggtgctgatgtgtccatgattggccagttnggtgtcggtttctactc

SEQ ID NO: 52527 - DNA, 458 bp, Zea mays
  unsure at all n locations
  Clone ID: LIB3067-031-Q1-K1-C7
catggttatcaagtaactcgagtgttccaaagccacctgtaaacggggcagaggaatcacggcaaaacaaggaggagggatctgaaggtgattcagacgatgacttgccccctctcgagaagaatatgaaccacctgaacctcgaagaagacgaagaaagcgaggaagagagtgaaagcgagtaaaattgtggtctgaaagtgctgccatggtaactntacgactgttttacaagtgaatttcagttgccttgcctgctacgaagcaaccgttgtatgtgcttcagtgtctaatagccagaataagcttcaatggccttttcgtccagatgttgaatgcatggttcggaaaagaaattcttgtacgccctgtaatagtgtgtacctatagcactagctttgaagattaatgatgagttgaacacattgagatcatttttctttctaggagaatacaca

SEQ ID NO: 52528 - DNA, 455 bp, Zea mays
  Clone ID: LIB3067-031-Q1-K1-C8
cggacgcgtgggcggacgcgtggggctggggtagtaatcccaccagatggctatttgagaggtgccagagacttgtgttctaaacacaacgttttgatgattgctgatgagatccaaactggcatagctagaactggtaaaatgctggcatgtgactgggaaaacatacggcctgacatggtgattctaggcaaagcactcggtgctggagttgttccagtcagtgcagttcttgcagacaagggtgtcatgctgtgtatcagaccaagggaacatggaagtacattcggtgggaatccgttagctagcgctgtggcagttgcatcactgaaagtggtcagagacgaaggtctttgtgaaagggctgcaaagttaggacaggagtttagggaccagttacagaaggtccagcagatattccctcaaatcctaagagaagtgctgcggaagggttt

SEQ ID NO: 52529 - DNA, 408 bp, Zea mays
  Clone ID: LIB3067-031-Q1-K1-C9
cccacgcgtccgggcgaatagttcaattctcaaatagcaagggtccaggtccagattcgcggatagtttacatagatggtgcttttgatctgttccatgctggacatgtcgagatcttacgacttgctcgagaacttggagattttttgcttgtggggattcacacagatcagaccataagtgcaacacgaggacggcatcgcccaatcatgaatctccatgagcgaagtttgagtgttttggcttgtcgttatgttgatgaggtgatcattggtgctccatgggatgtttcaaaagacatgattaccacgttcaatatctctttagtcgttcatggaacaattgctgagaacatggacttcacaaaagacgatttacacccatatgcttgttcaatggctatgggca

SEQ ID NO: 52530 - DNA, 281 bp, Zea mays
  Clone ID: LIB3067-031-Q1-K1-D1
acccaggcgtacgagcgctcctaatcaccaactaacaatatcttcttcatctcactaacaccgcgctatcagggttcgggtctaatccaacaatgggcggccgctcctccttcaaacaactactcgcccccgctctacagacaattaccctcctgatcctctcagaagacgccgaaaccgcgtaatctactgaaagctactacaatttgactctcaaagtgctgccatcgccactttacaactattttcccagcgaattctacctcccctgcctgctacaa

SEQ ID NO: 52531 - DNA, 417 bp, Zea mays
  Clone ID: LIB3067-031-Q1-K1-D10
cccacgcgtccgcccacgcgtccgactatctctgccagtctgctatcgacgcagctgaggaaggcgattacgaggaggttcggcgggtgcttagggtaatgcagaatccgtatgacgagcagccgggaatggagaagtatgcacggttgccaccagcctgggcatacagacctggagtgtgcatgctgtcctgctcctcgtgaaccccatgatgcaagacgtggacattacaaaaatgcttgggtgcttatagtcttcctcctgtataggggtccatctttgtgctgtaatgtgtcaagcatcgcatgctattttttttcccggtgatgccagtgtgtaagaaccatgtcgttgcaggaatagtgaagcagtgggacctggtattgtgactacctagtatcccgtacggagatggaa

SEQ ID NO: 52532 - DNA, 438 bp, Zea mays
  Clone ID: LIB3067-031-Q1-K1-B4
gattttagtaggcgggatagcttttctgctgtgcagccaggaaataacgtccctcaccagggtacagagttcaatgatcatccctctacccagttaccctattcacccccaccaccctcacagtcccagcatacttctccatcacaatcttattcctctccctcgtatcaggcaacaacagattacccttcttctgattttcacaaaccatcccccaattattcaactcccggctacacaagcacagatttccctaccaatgaagtccacaaaccaccttccaattattccccaccttcttacacaaggacagatcgcccttccaatgacggctacaatccttacagcaattggtaaccagatgtttcggcttacccttaagcatatcaacccccaccctacacatttgaccctcagcacaactcttaaaactactac

SEQ ID NO: 52533 - DNA, 442 bp, Zea mays
  Clone ID: LIB3067-030-Q1-K1-H7
cccacgcgtccgcctccatttgattacattgtaggaactgacattgtttattcggagcatctgttgcaacctctaatggagacgattactgcattatctggtcctaaaacaaaaatattggtagcctctgtccccctttccagagattatttctgcaaagcagttgtttgagaaccactgaaccgctgctcgctatccacagctagggtacgagatccgttcgacaactgtccatgagaagatgatggaaatgtggaaaagcaatttcattgtgaaaacggtctctagatcgaagatggatgtgaaatatcagcatcctagcatacatctctacatgatggacctgaaggcaccattgatccctgaggttgaggctgccgacaatgggaactacgaagaagaggttgaagttgctgtgaatcaagaggaagacgaagatcct

SEQ ID NO: 52534 - DNA, 388 bp, Zea mays
  Clone ID: LIB3067-030-Q1-K1-H9
gatgggagtaatggcactgtagaaattattaggattgaagtctatcacgttcttttgggggggaaagtatcctatgcgatcacaatcaacaagagccaagaagctgagacaacaattgaggaagataaggacttatatgagcaggggaagaaagccttgcaggagaacatacgtcaacagcatgctgccagcaccgatactcagaaactggtggataccaacgatcaagatcctgaggacgacatatcagatgcattcgccaaggcccgacagttgaagaatactgagaacagtgagacaacccccaaaactgagggtggctcagctgaaaaggggaccgctgtcaccggcaaaggtgattgaagtgcaaacctgaacacatggcctg

SEQ ID NO: 52535 - DNA, 327 bp, Zea mays
  Clone ID: LIB3067-031-Q1-K1-A10
cggacgcgtgcgttcacgctaccctcctgtggattcattctagcgctagcattgcgctagcccatgtctactctggactatctcataaaaaaaaatagatccagctgagacgttgttccctccctatttccctgtaccgtgtttcatggtgacttgtgacaatggatggtttctccttgtgcgtcgccatttacaagcttttttgtatgtttgtctgaatgaatgttctggatgaacggagtttcagcgcagtaaacaattcacataacctagctgatgtgttttccgttttaaaaaatgcctttttcaaaatttggtcaattagct

SEQ ID NO: 52536 - DNA, 272 bp, Zea mays
  Clone ID: LIB3067-031-Q1-K1-A11
cagctagctagcgttcctaatcaccgacgaataatctcttcttcacctcacgagacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgct

SEQ ID NO: 52537 - DNA, 392 bp, Zea mays
  Clone ID: LIB3067-031-Q1-K1-A3
acgatccatcacagctagctagcgttcctaatcaccgacgaataatctcttcttcacctcactgacacgcgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgcttaacagccgcgcgtcgtcggcggcggaccggcaggccacctgcaactgcctcaagagcatgacgggccggctcggccgcggcgtcagcat

SEQ ID NO: 52538 - DNA, 267 bp, Zea mays
  Clone ID: LIB3067-031-Q1-K1-A4
acgcggacgcgtgggctgaaccgctggtttctttaagtgattcaacagaccagttgagtgatgtgggagatggggataccaatcaagaaagtgatctgggaaacatggatgactagtatggtggtgtaataatgaattctgagattgattatttgcctgatccaaatgaccatgttgcctggctgaagttggagctattcctactcataaaggatagaagatcagctgttcttatatctgatgaactataaacactacttattgaaa

SEQ ID NO: 52539 - DNA, 341 bp, Zea mays
  Clone ID: LIB3067-031-Q1-K1-A5
ggggacttgagcagcgagcgccacagatctcgatcctgaagcttccgagcgagtgcttccgtcctcctcgcagtcagccatggcccgctcctcctcgcagtcgcagtcctccgtcggtggcggcggcggcggcggcggtggcgcgcgctcaggcaccgcgggcccgcgccagcctgacagttaacccacctgaacgtgcacaacacggaatgaaacaggcgtctgaaactttgactgtcgatttgggaaggacagcctctgctctcagtggcaaccctattaagggccataacttaaaagcgggtgttggatcagtgctagctactgaaatctgtggagca

SEQ ID NO: 52540 - DNA, 279 bp, Zea mays
  Clone ID: LIB3067-031-Q1-K1-A6
aaaaaagagaaagttacggtgattctataattattgacccatgggggacagtgatagctggacttccagatcggctctccactggatttgcagttgcagatcttgatttgtcaaaagttgaggctgtgagaactcgaatgccaatttcagagcaccggaagttcgacagcgattggaaacccacgcctctttagtagctgagggtttattttgtgtttcctatgtttaatgtgcgtatacacatatagttgatatattcatctatgcataattattacc

SEQ ID NO: 52541 - DNA, 461 bp, Zea mays
  Clone ID: LIB3067-031-Q1-K1-A7
cccacgcgtccgcccacgcgtccgcccacgcgtccgcctatcagacgattgcttgatccgacttcttccaagaacacatcgccatgagctttatattgagtcgtctgttgaaggaccccattgtgggcttttccctgttggagcaccatcaacaagcacaacaactactggcctgaaatggaatctaagtgaatcaaagatgagatttgggagcatgataagcacatccaacattgtgcagtcggagaaagtaactgtagaatctgatgcagatctcttgtggacaatttctctgcgaaatctgacataagcagttcctagtttgttatcttttttcttctctttcctgtcaagtggcaaccaagctcttgtacagccacttttgtgtttatgagttgtgtgtctggtaaataaataccatctgatgacaaatcgatgaggtctcatcattagacaggatg

SEQ ID NO: 52542 - DNA, 463 bp, Zea mays
  unsure at all n locations
  Clone ID: LIB3067-031-Q1-K1-A8
cccacgcgtccgcccacgcgtccggaagaagaaggtgcctgttgctaagaaggatgcgagtganggacaagagggtgaggctatagctgaggaaacaaagaagagtaaccatgtgcagaggaagattgagaagcgacagcaggaccgtgcactcgacactcatattgaagagcaatttggcagtgggagattgttggcctgcatttctgcccgtcctgggcagtgtggccgagctgatggctacatccttgagggtaaagagctcgagttctacatgaagaagctccagaggaagaagggcaagggtgttgcatcttagagcattcttttagctagaactgcaaaatatcttctacttgggggattttgttgttagtctttatgcatatcatttgcggacctgatgaacacttcataagtgaatcaactctcgattctaagaattgataattttcacatgcgg

SEQ ID NO: 52543 - DNA, 78 bp, Zea mays
  Clone ID: LIB3067-031-Q1-K1-A9
cccacgcgtccgaccacgcgtccggccaaatgttatataagatacataaatggtagatggagatcatctgtaagaatt

SEQ ID NO: 52544 - DNA, 323 bp, Zea mays
  Clone ID: LIB3067-031-Q1-K1-B1
cgcccacgacgtacgacgtacgcgtggagtgcccgatgaaaaacagactcaccagcaaagtgaccggaaggtgggaccaagcaaccgagggcgatagccatggcgaagcctggcagctgtggcggtggcggcctcctggacttaaaggggcactacgccttttacggcgcctaccacagcaaccccgtcaacgtgggcatccacgagctcttcaagtggcccatcttcctgaccgcgctcatgctcctccaccttaccgaccgcttcacgcacgccgtcagcatcagcgccgcggtctacgcggtctactacttgctccttga

SEQ ID NO: 52545 - DNA, 415 bp, Zea mays
  Clone ID: LIB3067-031-Q1-K1-B10
cccacgcgtccgcccacgcgtccgcttgcacgggccaacgcacacataacacgagctcgtcgtcgatggcgcggtgggctgcggtgctggcgctggccgcggccacggccatcgccgtggcgtccgtggcgggcggcgacatgagcgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgaccccaacctgggcatcaagatcaacgccaccctcgcgctcgcgctccccaacgcctgcggcgccacccgcgccaacgtctgccactgcgctcagcttctgcatat

SEQ ID NO: 52546 - DNA, 400 bp, Zea mays
  Clone ID: LIB3067-031-Q1-K1-B11
cccacgcgtccgcccacgcgtccgcccacgcgtccgcggacgcgtgggcaggtagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgccttaagagcatga

SEQ ID NO: 52547 - DNA, 451 bp, Zea mays
  unsure at all n locations
  Clone ID: LIB3067-031-Q1-K1-B12
cggacgcgtgggcggacgcgtgggtttttttaaaagaaaggcggatagcaacataggaagttcagatagtcaccacatggagaggactacatgctcaaaatcaacaggaaacattgaagaacttgctgttgcagctacgtcagcaatggattgtacattatgtaaagaaaatcatttgagcatggaggaactccggatgatacatgttgcaaaatggaggacactctttcaacataacagattgcgccattggggtgttaggagaagtcctaagattcagttgtttcttgagctaaggctacaaaagccctctacgcctatagcttctgatagtatgtcaactccaacaaaagaacagtcatccctagagagcacaggaaaccttgatatcaccaaacttctggatgaactngaaataccatctcggttctagaatagcacatcgtcttca

SEQ ID NO: 52548 - DNA, 185 bp, Zea mays
  Clone ID: LIB3067-031-Q1-K1-B2
agctggtcaagcacaacgacaccggggaggttggactagtgatgcgtcaggcgaagacgctgaagatgtgagccaaccatctagtgctggagacgactaagatgcaggaacacgcggcgagcgacaagtactgcatttagaacgcgctggagtttgctgacggctagatcaaagaggcagatgtt

SEQ ID NO: 52549 - DNA, 311 bp, Zea mays
  Clone ID: LIB3067-031-Q1-K1-B3
atccggagcagccgcagtcccaccgaccccgccggcggtcgcccttcatcttcttgccggtgcctgttgtttctcttttcaataatcaagatgagccgtggtggtagtgcccgtggtggtcaaagttctctgggttatctctttggaagccgtgagccccccaaaccaacagtggcaccagcttcaagtgcttcacctgttgagaaaccatttgcttcaaagactgattccggccaacaagttgcttcttgggttaccaggccaaccaattacttccacaaggcttattgtcagaacacttgcaactttct

SEQ ID NO: 52550 - DNA, 290 bp, Zea mays
  Clone ID: LIB3067-030-Q1-K1-H6
cccactcgtccgctcacgcgtgctcccacgcgtacgaaaaaaaatataaaaaaaaaaaaggaaaaaaataataaaataaaaaaaaataaaaaaaaaaaaaaaaaaaaaaaataaaaaaaaaaaattaaaagtttatatggacgtgcattttgagctatctaagattgaaatcagttccttaaaagctataactgtattattagatgacttaattcaatttgaatgttcgtcttttcaaaacgataatgattgaaaaaaccgtgcagttaccgaagttaatcacctttgat

SEQ ID NO: 52551 - DNA, 103 bp, Zea mays
  Clone ID: LIB3067-009-Q1-K1-G10
cccacgcgtctcgttaattgtatagatatttctctctacttcgagcaaaacactatatacgggggggtcttttaaaacgccggcgcggcctatgatgctttcc

SEQ ID NO: 52552 - DNA, 395 bp, Zea mays
  Clone ID: LIB3067-009-Q1-K1-G2
ggaaataaaaaaacattttccggaggagaaaaaacccccgagaagaagaattcctctcgctcgaggggtgggaaagaagcggaaggggagacgagtcgagaggaagccctcgcctccggcacacgccatggtggagactcgccggagctccgccgccgccgccgggaagcgcacgtctccatcgccatcctcttcgtccgtacctcccccgaagcgccccaaggcggagtcctcggggtcaccgacggcgtccgcgcccggcagggccgaggaggattctgtggcgggagcggcacccgcgaggagcgccggctcggtcgatgacgcggcagcgatcgcacagaaagatcaaagagtcgataagccgtcttccgctgttgcagatagttcaaagc

SEQ ID NO: 52553 - DNA, 403 bp, Zea mays
  Clone ID: LIB3067-009-Q1-K1-G3
aaggccatctcaaggaatgtaagcttgtcttccatcacaatacctgcatacacagtggcagaccttcagatggcaacgggcagcttcagtcctgacagttttatcggtgagggatcggtaggccgtgtttacaaagccaaattcggtgatcagaaggtcatggctgtaaagaaaataaacttctctgtatttccaagccatccttcagatttgttcattgagttggttgcaaacatttcaatgttaaatcatccaaaccttgctgagcttgctggttactgttcagagcatggacaatgcttgctggcatatgaattctaccgaaacggttctcttcatgatttccttcatctgaaagatgaacacagcaagccattgtcttggaacaaccgtgtcaagattg

SEQ ID NO: 52554 - DNA, 406 bp, Zea mays
  Clone ID: LIB3067-009-Q1-K1-G4
ggaaataaaaaaacattttccggaggagaaaaaacccccgagaagaagaattcctctcgctcgaggggtgggaaagaagcggaaggggagacgagtcgagaggaagccctcgcctccggcacacgccatggtggagactcgccggagctccgccgccgccgccgggaagcgcacgtctccatcgccatcctcttcgtccgtacctcccccgaagcgccccaaggcggagtcctcggggtcaccgacggcgtccgcgcccggcagggccgaggaggattctgtggcgggagcggcacccgcgaggagcgccggctcggtcgatgacgcggcagcgatcgcacagaaagatcaaggagtcgataagccgtcttccgctgttgcataaagttcaaagcggaagaaggag

SEQ ID NO: 52555 - DNA, 384 bp, Zea mays
  Clone ID: LIB3067-009-Q1-K1-G5
cttgcttggttttgcaccgtcaacatccctaccagctatttcttcttcgaagttgaacaaagttcttcttcctaatccatttgatagaccgcgtgctgttttcctcgtgcaaattgctgggttcgatgttcctagcttcgtatctgaaggcagcaacattttcaagaccaggattgaaggtgcaaacatcgctgatacagggcttacagataaggatgacttaattgtcattcattcggatgaatctctagatctctctcgatcagattatcttgataatgaactttccagcttggcaaactggttggagggatcttatcagaagtctaccggcaaactagtcattcccttggagaatggaaacagtcttactttgcaacttga

SEQ ID NO: 52556 - DNA, 383 bp, Zea mays
  Clone ID: LIB3067-009-Q1-K1-G6
cccacgcgtccgcccacgcgtacgatcactcgtccgcccacgcgttcggggttagggtcccagctccccgtagcctgggcgagccaagtgatggccggccctgccccctccggcgcaactagtgcctccgccttaccgtccccgctgatgcagctgccgtcgacgttcgcggagctcgtcaagggcccctccggcctccagaaggtcatgcttcgcagcgctcgcaactgctgtgcccagatgtatctttatggaggtcaagtaacatcatggaagaatgacaatggggaagacttgctatttctcagtagcaaggctattttcaaaccttcaaaagctaatgctggtggtttaccaatctgctttcccctatttggatcaca

SEQ ID NO: 52557 - DNA, 308 bp, Zea mays
  Clone ID: LIB3067-009-Q1-K1-G7
cccacgcgtccgcccacgcgtccggactagttctagatcgcgagcagcagcagcacagtcatccacactaacgaacgaactcttgctccgatcacgagctagctgaggtcgacgatggcggctgtgctgaacagcaggaagacgccgcaggtggtggccgtgctggtggtggaggcgctgctggcttcgtccgcgtcggcggcgatcacctgcgggcaggtggggtcgtcgctagcgccgtgcatcccttactcgactgtgagggccagctcgctaccctcgacgtgctgcagcggcgtcaagagcct

SEQ ID NO: 52558 - DNA, 410 bp, Zea mays
  Clone ID: LIB3067-009-Q1-K1-G8
aaaaaaaaaaaataaaaaaaaaaaatataattaaaaaaaaaaaaaataaaaaaaaaaaaaagaaaaaaataaatataaatgtaaaaaaaaaaaaaataaaaatgatataataaaataaaattaataaattatataaaatatttatatataattcatatttattattatgtgggggacctttttttacgtgtgggtatttttttgattcattgcttacttttaattttttattaattgtctttaattttattgaatctatatttcttttttaatcttttgttgtttattatttagtttgtacttttttaatcttttttagtaatatttatattttatcttttttgtttttttagttattttgttttgtttatttatgtttttttatttttattattatgtatttattttgg

SEQ ID NO: 52559 - DNA, 358 bp, Zea mays
  Clone ID: LIB3067-009-Q1-K1-G9
cggacgcgtgggtgttgcagtaatatatgttccgctatattggccatttgatttacagcaggcggcttttctgaaaaaaatgtgttactttgattcacaggcataccttcgaccagaagaggctcaagcagccactctaccgtcacccatgggaggatgtactgtacaccaagtgagaaagccattctttgcaaggcataataaagtattattatcgcctagagcttccagttgcctagcttccagttgcctgtacacttcattaaatcgagcacttgcaaaatagaaagccagagagaggaagacgaacatcactagacagcactagattgcgtgttatatcgtgagttgcaaattc

SEQ ID NO: 52560 - DNA, 309 bp, Zea mays
  Clone ID: LIB3067-009-Q1-K1-H1
cccacgcgttcggcagatgtctggcgttcatctgaagagaagagatacaggagaagaatcagttcgtactgtgaaagggtcattttatggcataggacatactccaaacagtcagctgttgcagggccaaatcgaacttgatagtgctggctatattttagttaaagagggctcatccaaaacttcagttgatggtgtattcgctgctggtgatgtttaggatcatgaatggagacatgctattactgcagctggatctggatgcatagctgttttgacagttgaaagatacttagatgcctattatct

SEQ ID NO: 52561 - DNA, 94 bp, Zea mays
  Clone ID: LIB3067-009-Q1-K1-H10
tccgcttcaacgaggaatacgtatggactgtttcaagaccctagcacaaaaaaaatatagaaggataaataaaaacaatgcgtattaccatgaa

SEQ ID NO: 52562 - DNA, 226 bp, Zea mays
  Clone ID: LIB3067-009-Q1-K1-H11
caactccgtccctctcttctcagcccagatatttctttcccccgtcctccctcgccttcgggtcgggttcaggagatatgcagcaccacctccggaccaccccgaccctccttctctctcgcgctatggcctagactgatgtgctcaaggttgtcatgtcctgtgagggctgagtctgagctgtcatgctggtcctgggcaagatgttagggtttaagtgctacca

SEQ ID NO: 52563 - DNA, 249 bp, Zea mays
  Clone ID: LIB3067-009-Q1-K1-H12
gtgacacagtttcacgcagcagatcagagagtctgcaggtacgctagcgatctagctgccggtgtgctgcgtacagtgcgtagtaccatggcgaagaaagtggccactctgctggccctcaacctcctcttcttcgccttcgccgacgcatgcggctgcaggtgcggcggatcctgccctagtccaggcggcggaggcggtggcggtggaggatctggtggtggtggtggtggaagccgtgggggtggg

SEQ ID NO: 52564 - DNA, 393 bp, Zea mays
  Clone ID: LIB3067-009-Q1-K1-H2
ggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccggcggcgccttcgcactctacgagaagcacgaggcgaagaaggaccccgagcacgcgcacaggcacaagatcacggaggaggtcgctgccgctgcggccgtcggcgcctgcggctacgtattccacgagcaccacgagaag

SEQ ID NO: 52565 - DNA, 426 bp, Zea mays
  Clone ID: LIB3067-009-Q1-K1-H4
cccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgatgccatgcttcaccagaccggaggcagcgttcctagcaccacctaaaagcatcagtcgcggagcttcgttttgctctccgtcctgcgtagtagtaaacaaaaaggaaaaagtctttt

SEQ ID NO: 52566 - DNA, 300 bp, Zea mays
  Clone ID: LIB3067-009-Q1-K1-H5
gcggtgcgagcggaggaggcgacagaagcgccacttgcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagatgacatagaagaggtggggaagaaaggggatacaatgaaggtgcgagctggattctaccgcaacttcttgctttccaaggg

SEQ ID NO: 52567 - DNA, 390 bp, Zea mays
  Clone ID: LIB3067-009-Q1-K1-H7
cccacgcgtccgcggacgcgtgggcaccagtgtctaccacaacgactctagtgaaccatgcaaaaggagcgtccaagtcgtttgacggaggctgtagatcacttgaacgctataagggccatgtaaacgggaatggtatgaacgtatctaccgattccagtgaagataaagattcaaacaactcagatgagaagtgtaacgagtttgcatctgctgagtcggaggactcggtgtcaggtgttctatatgatatgtggcaaaaggaggtcatttctctaaggaaggcgtgccacgaaaaggatcagagcctgaaagacaaggacgacgcaattgagatgttggcaaagaaagtagatactttgacaaaagctttggaatcagatgccaaga

SEQ ID NO: 52568 - DNA, 357 bp, Zea mays
  Clone ID: LIB3067-009-Q1-K1-G1
cccacgcgtccgcacgaggtgtggtgagcctagtgcttggctacttgaacaatcttgtgatcgaaatggccttcttggtacagggaaacacaaatgaagaactcccggaattcctcctaggtacctgccgactgaattacctggatgcctccaaggcagtgtccatagacgagtgctaggaccccaactgacctcattttttaaagccaagtacaccaaaagacaaaaaaaaaaggctgaatccccattccttgctgccgacacaatcggcaaccctagcccagatgcccattttattgcctcaccgcaaaagtgggggatccattgcaaccgttgtacattctcttcttgccgact

SEQ ID NO: 52569 - DNA, 424 bp, Zea mays
  Clone ID: LIB3067-009-Q1-K1-H8
cccacgcgtccgcccacgcgtccgcccacgcgtccgcccacgcgtccgcccacgcgtccgcccacgcgtccgcccacgcgtccgatgttctggagctttcagagggatgggattcattggtcactgcacgtgcagctgaactcctaagtttaaatcttgaaaccatggagaagttgaaggaatcagaagagctattggaacgatgccttgcagtcaagaaaaagattctacctgaagatcatcttcaggtagcttatacgttggtacacctggcaaggttaacattgcacagagttgtaaaggatcgggatgtaaacagcgatgtaactgcatattacctcgcaaaagcaaaacagttcagcaatgattcaatcaggattacagaaggacaattaaattcttcaagaaaagatcagaataaaat

SEQ ID NO: 52570 - DNA, 408 bp, Zea mays
  Clone ID: LIB3067-009-Q1-K1-D4
ccaactcgatctcgcacctagggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgttctcgtcggccttcgcgactaccaggacgacaaggccgacgttatccttaagtacatgaacgacgaggcgcgcctgctcaaggcctacggggagctttctgacacgctcaggctcaacgagggc

SEQ ID NO: 52571 - DNA, 311 bp, Zea mays
  Clone ID: LIB3067-009-Q1-K1-D5
cctaatgaaatatggaaatcattcgttgacctataggatagttgatagaattttgacacagataccaaggaaattgacaagcatgacagaagggaagatgggctatgaagactttgtttattttatattatcagaggaagacaaatcatctgagcctagtcttgaatactggtttaagtgcatcgatcttgatggtaatggtattttaacttacaatgaaatgcattttttctatgatgagcaattgtcccgaattgagttcattgtttaaagaaccttttggtttttggtgacatttttatttcagatta

SEQ ID NO: 52572 - DNA, 360 bp, Zea mays
  Clone ID: LIB3067-009-Q1-K1-D6
ggaagaaccagttcaggggtatccgtcggttcccgtggggcaaatgggctgctgaggtcagagatcctctcatgggcgtgcgcctctggctcggcacattcaactcttccgaagaagctgctcatagcttacgactccgaggcacgcatgatccgcggcaagaaggctaaagacaacttctctgatgaggtttctactgctgtttctcagaagcgccgtgcttctggtcttgcctctctgaaagcccctaatatggactttgatgatgagaagcctatcatcaatctggcttgtaacaatttgaccaacttatacgcattattacttacccttcctgcatatgccattataacatctttc

SEQ ID NO: 52573 - DNA, 54 bp, Zea mays
  Clone ID: LIB3067-009-Q1-K1-D7
cccacgcgtccggcggctgtatgcaatgattgaactattaaaaaaagaatattt

SEQ ID NO: 52574 - DNA, 313 bp, Zea mays
  Clone ID: LIB3067-009-Q1-K1-D8
aaaagacgaaattgttttcgaggaggcgaggcagttcatcatcaacatccatacggggaacctgcatctgcactcacctttggcgtcgctctactaatttgatttgcccctacaggtaccgcagagaataccgggcccattaagtcagctacacaggactctaaaggtgaagatcatgatataatgagctttggtactgggaaatgcgcgtttgccaagcgcctatatcatgaataggaccaaaacattgttagcttcgaggcagtcgtaccaaaccattgctatgcaaaggggactttgaatagaccgtccc

SEQ ID NO: 52575 - DNA, 63 bp, Zea mays
  Clone ID: LIB3067-009-Q1-K1-E12
ctgacgcgtggcgtgctccgtaagcacctttatctgaatgtcgcagccctccactatcacaag

SEQ ID NO: 52576 - DNA, 423 bp, Zea mays
  Clone ID: LIB3067-009-Q1-K1-E2
agtgcccccaccaaaccacccctgtgcgattcgccgccatcattgtgagcaagctcgagcgcgtctgccgccagccaccaccgcttccgttgctttagctctgttctcccgccaagaaggcgaaggggagacggttggttgagttgaggcagccagccagcaagccagtggcggggcgtctgctctcggttgctttgctatggggatctgcgcgtcgtccaagcgcgtggagcaggaggaggacgagaacgtggtgtacgtggtggtggacgggcagggcggcggcggtggagggggattgggaggggacggccgtggcgcggcggtggagcggacggtggccgtctccctcttctcgcagaagggcaagaaggggcccaaccaggacgccgtcatcctctgccagggattcggcatggagga

SEQ ID NO: 52577 - DNA, 282 bp, Zea mays
  Clone ID: LIB3067-009-Q1-K1-E6
gttgtgctctctatctttattcgatccacgcctaacatcgagccagccgtctagcgcgggtgtctccaccgacgacggcttcggcatgcctagccgtatcttacgaaggacagcgccacacccagatccccttgctgattcaatgcagaaccccagacagccagtacgccagcctctgctttcagctgctgtgctatatggatctggccgtatgtcaagcgcaattagcaccaccatgactaaaagcatggtgtacctgcacgtgtactgccatggcacaca

SEQ ID NO: 52578 - DNA, 423 bp, Zea mays
  Clone ID: LIB3067-009-Q1-K1-E7
ctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctccctcggcgggaaccccacgcaggcgcagctccgggacatcgcggcgcaggagaagctcaccgcacccttcgacttcccgcgctttctcgacctcatgcgcgcccacctcaagcccgagcccttcgaccgcccgctccgcgacgccttccgcgtcctcgacaaggacggctccggcaccggcgccgtcgccgacctccgccacgtcctcacctccatcggcgagaagctcgaggcccacgaattcgacgagtggatccgcgaggt

SEQ ID NO: 52579 - DNA, 413 bp, Zea mays
  Clone ID: LIB3067-009-Q1-K1-E8
cccacgcgtccgattggattaaaaatggtgtccacatcgggagtggcagaaaatataaggattcctattttcttcaggcgcaagtaatgtgctactacaacgtataacagtatcttatttccgagctacacacgaagacttgcacttatacaggttgttcgaccgtccaaaccatcctagaatatgattggtggactgcgattaaattgcgtacatgatgcatcagttctatgcatgctcgctgctgtctgttcggaggtcatcaactcgggacctggactaagggccttgtcgttcgctcaacccctatgaaaaagtttggctttctaaagatgtagtagaagtactcatttattccctgccaattgaacatttcaaatcttcgtatggtgttaatgaaaaatctgatgttt

SEQ ID NO: 52580 - DNA, 344 bp, Zea mays
  Clone ID: LIB3067-009-Q1-K1-F10
ctcacgctccgcgttctgtcgcgacccgacttcgaacacctcccggacatcttcacctccgtcggcctcgagtactacgagaaggtcctcccatccatcggcaacgaggtgctcaaggccgtcgtcgcgcagttcaacgccgaccagctcctcaccgagcgtccccacgtctccgcgctcgtccgcgaatcgctcaccaagcgcgcccgcgagttcaacatcgtcctcgacgacgtcgccatcacccacctagcctactggcaggagttcgcgcaggccgtcgagaagaagcaggttgcgcagcatgaggccgagcgctccaggttccttgtcgcgcgcgctga

SEQ ID NO: 52581 - DNA, 74 bp, Zea mays
  Clone ID: LIB3067-009-Q1-K1-F11
cactaacgaacgaactcttgctccgatcactttctagctgaggtcgacgatggctgctgtgctggactgcaaga

SEQ ID NO: 52582 - DNA, 118 bp, Zea mays
  Clone ID: LIB3067-009-Q1-K1-F12
cccacgcgtccgctgactcgtccgcccactcttcctctaagcttgcgtacttgtagtagaggacggcctcaagcaacgccagagcgagatgtctagctttctaacatcatctcttctt

SEQ ID NO: 52583 - DNA, 210 bp, Zea mays
  Clone ID: LIB3067-009-Q1-K1-F2
gccgaacctggtgcatatttttgcgatgttgactacttgagtatataattgagggactgctgttgctgttgtcggtgttgtacaaaaaattatatttctgatccaataaggcccgtttttcatgcactatgggttatacgttgtccatgaattcccatgtttcgctgaaaataaagaagacgcacgtttctatgcaaaaaaaaaaataat

SEQ ID NO: 52584 - DNA, 110 bp, Zea mays
  Clone ID: LIB3067-009-Q1-K1-F3
cggacgcgtgggctgcgccgggagataatatctgttgcagttctcgcatttagcggtactaaccttttgcagtactagcaacacgcagaagattagtaccgggaaatgcg

SEQ ID NO: 52585 - DNA, 425 bp, Zea mays
  Clone ID: LIB3067-009-Q1-K1-F4
ccgaaccccaaaccctagcttcgctcgttgcggcggcggcggcgagccggcgatggcgaagtctctgcgatccaaacgcgagaagcggcttcggacgttgcgccgggagatagcggagccgttctacgacaagaaggaggccgccaagctcgccgcccaggccgcagccttagctgctgccccgctcccggtccgcgggcccccgccgtcccaggatgccggtaccccccgcgcagctagctcggcctcggctatggatgtggagatgtctggtgcagggaacagcaggtctaagaccttcttgaggccacttggcagcattagcaagaagaaggtgcagcttcatttgaagatcaagaaagacaagagaaaagctaggaagaatggaaagttttcttttaagaagtagacgagtgtatgatgaa

SEQ ID NO: 52586 - DNA, 88 bp, Zea mays
  Clone ID: LIB3067-009-Q1-K1-F5
cccacgcgtccgctaaatttgttgtgctgtccgacagattctatgtctggtccttaaaaataaaggaataatgaatgtagtgtttttg

SEQ ID NO: 52587 - DNA, 428 bp, Zea mays
  Clone ID: LIB3067-009-Q1-K1-D3
cttcgcggacgcgtgggccgtgtgcacgttgcaggagggacagcttcatcacccaccgcgccttctgtgacgcgcttgccgaagagagcgccaaggcgcgggcggaggcgccttccgcggaggatgggagctcggcagccgccgtggttccgccaccggcacccccgtctgcgccagcgccggcgccactgcgacagcaaccgcccccgcctgcgccgcatcatgcggagccacgtaatgagcctgacacgaatgcgactgaggccgtccagttcgcgccgccgactccgccaccgccgtcgacgtcgcagttacagctgccggtgctttcgcaagcttcggtgagcgctgctgccaacgttagcgccagcagcagcagcagcagcgtcgcggggacgtcgcagagcctgctcggcggtatgttcgcg

SEQ ID NO: 52588 - DNA, 454 bp, Zea mays
  Clone ID: LIB3067-009-Q1-K1-F6
tccgtccggtcgtcaccggcatgagggtgataggcggttgaagtgcttcccgcagtagaacggtcatcactcgctcctggttgtttacctatgccagcataaggtggcctcagaccagcactcagagtaaactccgtctctctccaactggagtcgctcaagactcggttaatctcgatcgtgcaaccatgagctccatagccaggatgcggtgcaagggaactggtgaccaaccaaggcaggctgtggaactggcagcatggccccataagcgttgctcgatctcctcatcgctactggatggagagcagttggctagttgttagcgggttccctagtttctcttcctcttgtgttccccgtttcagtttgcttatagccccgaagactcttttcttccgtagtgtcggaatgcccaaggtctgtccctgtggatgtgttgcgtaactgggat

SEQ ID NO: 52589 - DNA, 385 bp, Zea mays
  Clone ID: LIB3067-009-Q1-K1-F7
cccacgcgtccgcccacgcgtccgcccacgcgtccggttattgttacctcctcgccggcgcgcacaggacggcgttcttcgggatgtacaggaactggggccccggcgtcgacgccgtgcacggcgtctcctgggcgcgagagctcgactacttcgccgcccgccctttcctcggcaagagcttcgtcaacggataccactggctcacacctgatgtctgaaaaacacacaaacacacgcgcgagagtcatgagacacatcgattacagcaaaccagattaatttattcgtacagcataaagacagaataagacaccatttacaagccactgaatatgtatagtgatccactggcgcagaagtcagattcaagattcatttcgtc

SEQ ID NO: 52590 - DNA, 422 bp, Zea mays
  Clone ID: LIB3067-009-Q1-K1-F8
cccacgcgtccgcccacgcgtccgcccgcctcttcgccgacaccgtcatcaggctcaacctgcagaagctcaagtccgtcgccgaggccagcacctgcagttccgcacccccgccgccgtcggagtagcgggcggccggaatcggcaaggggagaaacgcagcagcaagttttgggcgtttttctgttatttcacttctctgggaaatggtctctctgaattaaatctgatcgtggatggatttggactgcacgagaggagaggaggggtcgggtcagcttgaatcaggtgtcgcgttgccagggtggtcacctgtaataacctctccttcatctccgagattccttcctttcatctcctagattcattcctttcatctctgcttcttccagaatttggttaatttcagctttatgcgagtg

SEQ ID NO: 52591 - DNA, 403 bp, Zea mays
  Clone ID: LIB3067-009-Q1-K1-B2
cctcaaaagctccgatggcgaggagttcgaggcggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccggcgccgcctcgaaggccggttccgacgacgtgggtgccgactgcgccaacagcaccgccgtctgcggtgaggacctcaagaactgggatgcggacttcgtcaaggtcgaccaggccacgcttttcgacctcatcttggctgcaaactatctgaacatcaagggtctactcgaactgacctgtcagactgctgctgacatgatcaagggcaagaca

SEQ ID NO: 52592 - DNA, 68 bp, Zea mays
  Clone ID: LIB3067-009-Q1-K1-B3
attacgcgtttgtaaaatataatgaccatccacttcaacgcctatgctaccctaaaatagggggggat

SEQ ID NO: 52593 - DNA, 421 bp, Zea mays
  Clone ID: LIB3067-009-Q1-K1-B4
ctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagcccggacaagtactggagcccccaccccaagaccggcgtgttcggcccggcggcggtggaccccaagctggccgctggtggcgcgccggacgccggcgcggatgctgcaggaggcacggtgcttgaccagaaagtgtggttccgcccgctcgaagacgt

SEQ ID NO: 52594 - DNA, 55 bp, Zea mays
  Clone ID: LIB3067-009-Q1-K1-B5
aaaaaaaaaaaaaaaaaataaaaaaaaaaaaaaaaaaaaaaaaaaaaaaaaaata

SEQ ID NO: 52595 - DNA, 402 bp, Zea mays
  Clone ID: LIB3067-009-Q1-K1-B7
cccacgcgtccggtcgctggtatatgtactgcgcagtcggtgtaggtgacgacgaatgaaaactgaaatcttggtctcctgaatacctgaaacagggtcgtttcgagatactgtctctgtccgggtcgtttcttctgtcagagaacggtggccagcgcagtcgaactggtgggctcagcgtttcgctagcaggccccgacggccgtgtcctgggtggctgtgttgccggactcctgacggctgcttcaccggtacaggtctgctgtcgtcctctggatcctgctggctgaaaaatcactaccttcctggttccattcatttcgtcgtggtagcgtaaattacagagcgttgtcggtcgtcgactgtatctccagatttcctcgtcgacgccactcaattgcc

SEQ ID NO: 52596 - DNA, 420 bp, Zea mays
  Clone ID: LIB3067-009-Q1-K1-B8
ggaaaatggaacaatatctgaggatgttgttcggagtgcgttttctgctacggaggaaggcttcttgacactcgtgcggagaacacgttttataaagcctttgattgctgcggttggatcctgctgtctagttggtgtcatatggagaggaacactatatgtggctaatctaggcgattccagggctgttactggcgttctaggtagatcaaacaagatcgtggctgagccactcacaagagatcataatgcaagtagggaggaggtcaggcaggagcttatatcccgtcatccagatgattctcaaattgtggttctcaagcatggtgtttggcgcatcaagggcataattcaggtttcaagaacaattggagatgcttacttgaagaggcgggaatttgctcttgatccatctatcac

SEQ ID NO: 52597 - DNA, 400 bp, Zea mays
  Clone ID: LIB3067-009-Q1-K1-B9
cccacgcgtccgcatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagca

SEQ ID NO: 52598 - DNA, 399 bp, Zea mays
  Clone ID: LIB3067-009-Q1-K1-C1
ttcaccagcgccaccttccacgccaaggctacgacgacaatggtggcgaggagcccgaacgccaagccggacaggcagaaggctgcagccctcgccgcggctgccgcgctcaacccggctctcctcagggagacgctcaagaaggttgaccgatgcatggcacggctgcaggagctgcagtacacggtagccggcggcgccaaggtcgtctccggcgtcagtctcagcccccgcagcacgcgcgggtacctccggaccagccttcggtgcaagcaggagaccgtcaggatgaggggcggcgcgtcggcgcagaagaggtccccaagcggcaagttcgggggcggcgtcggcggaaagggcgcgcagtggcgacgaatgtcgctgccggcgatgctgctc

SEQ ID NO: 52599 - DNA, 194 bp, Zea mays
  Clone ID: LIB3067-009-Q1-K1-C11
cagaggcacagactagactacagagatgaatgacggaacgtcgtctgggggaggggcctgcgctgtattcatttatctgagggggacttttactcaatgctcatataatgctcatactctcccctctcataaaagtcacatctataatgaattcaacttttaatctatatttgtttgcctcgatttttctctca

SEQ ID NO: 52600 - DNA, 404 bp, Zea mays
  Clone ID: LIB3067-009-Q1-K1-C2
ggtctgtgctgagcttgctttgattattgttcacactttgtagtactcgtacttttcgcccccttcccttgtgggcattcttgacgtccctgtcttcctcggctgccgcagatacatgatttcgtcaaacattggtgaagtcgcttctatattcctaacttccgccctgggcattcctgagggtttgattcccgtccaacttctatgggtcaatctcgtcaccgacgggccccccgcaactgctctaggtttcaatccgcctgacaaggacatcatgaagaagccacctaggaggagcgacgactcactgatcactccctggatcttgttccgctacctggtaaacggtctccctcgcgtgctacccgtcccttgactctgttgggtcgtcatcttttggagac

SEQ ID NO: 52601 - DNA, 426 bp, Zea mays
  Clone ID: LIB3067-009-Q1-K1-C4
gcagggtgtgtcccggccggtcctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcgcgcggggcgcgggcagcttgtaggcgttcgatcggccatgtagggcaactatacatctttggcaggtctccatcatcctccgtgggagagaagatgcatggtaatggagtgcgtgtgtatgtatgtgtatgcccatggcgcgcgcgcgcggctctgggcgagtcacagtagagatgcaatatcatgtatccagtatctttcttacaacacatacagtgagaaattattagtaaataaaataaaaa

SEQ ID NO: 52602 - DNA, 427 bp, Zea mays
  Clone ID: LIB3067-009-Q1-K1-C7
aaagccagaagatatccctggtctcagggaagctgggtggacgcctgatcaattggggcattctaaatcacgatcatcattctccccggactataatacttacaggcaacagcttactacccttatgcagacagcgctgaagaatctgaatgaacatcctgatgcttggccattcaaagagcctgtggattcacgggatgttccagactattatgatatcatcaaagatcctattgatttaagaacaatgttaagaagagtcgactcggaacaatattatgtgaccctagagatgtttgtagccgacatgaagagaatgttcagcaatgcaagaacttacaattctccagatactatctattacaaatgtgcgacacggcttgaaaacttcttctcgggcagaattactgtactgcttgcacaactc

SEQ ID NO: 52603 - DNA, 433 bp, Zea mays
  Clone ID: LIB3067-009-Q1-K1-D1
gagaacctcatcaaatatggaaatcattcgttgacctataggatagttgatagaattttgacacagataccaaggaaattcacaagcatgacagaagggaagatgggctatgaagactttgtttattttatattatcagaggaagacaaatcatctgagcctagtcttgaatactggtttaagtgcatcgatcttgatggtaatggtattttaacttacaatgaaatgcattttttctatgaggagcaattgcaccgaatggagtgcatggcacaggaacctgtggtttttggggacatattatgccagatgattgatatgattggaccagagaatgagagctattttactctacgggacttaaaacggtgtaaactctcaggaaatatattcaatattcttttcaatctgaacaagttcatggcatttgaaa

SEQ ID NO: 52604 - DNA, 184 bp, Zea mays
  Clone ID: LIB3067-009-Q1-K1-D10
gacaaggtagatgaaggtttcaacacatcctagtccatgtcaggctcgtcgagtggccatgctgtgtttgaagctgaatcgcgggctgcataaaacacgggtgaagcatcagcagttgaggttgtcaaccatcaagtgcctgactcgagccttatagtatgtaatcttagagatctttcttttc

SEQ ID NO: 52605 - DNA, 59 bp, Zea mays
  Clone ID: LIB3067-009-Q1-K1-D12
acccctcacgcgtctctccactcttactactagttctagatctcaagaccccttcctaa

SEQ ID NO: 52606 - DNA, 260 bp, Zea mays
  Clone ID: LIB3067-009-Q1-K1-B10
ggccatgtgcctacattggttgacaatgactatgcggagagtgaggaacctgtgaagagcactacagtggctgagcaggtggatgagtatgttgatattgtggatgaaatgccagcagccacataccaatccatggagatcgagaaggacgctgagggtaggactggctctggtggttctggcagtggctcttaatggtcaagtggtcctaagtcaagaagttcagggtccagttcttaaggagttggcaatgctaattt

SEQ ID NO: 52607 - DNA, 411 bp, Zea mays
  Clone ID: LIB3067-009-Q1-K1-D2
gccacgcgtacgcccacgcgtccgcccacgcgtccgtccacgcgtccggccacgcgtccggccacgcgtccgcccacgcgtacgcccacgcgtccgcgcacgcgtgcgaaaccacacacccgacctaccccggccggaccggcaggcagcacaacatggacctcgccctgctggagaaggccctgctgggcctgttcgccgcggctgtggtggccatcgccgtggccaagctgagcggcaagcggtaccgtctcccaccggggcccccgggcgcccccgtggttggaaactggctgcacgtgggcgacgacctgaaccaccgcaacctgatggccatggcgaagcggttcggcgacatcttcctgctgcgcatgggcgtgcgcaacctggtggtggtgtcgaccccggagc

SEQ ID NO: 52608 - DNA, 215 bp, Zea mays
  Clone ID: LIB3067-001-Q1-K1-A7
tccacgcgtccgtccacgcgttcggactaaaaggagggagacatcaagcccaagtttggagggcccaaaggaggccttgggacctaattttgatggggtttgaaattcctgcccctggttaattttagggcccttaataatttctaatggattattaggaccttgggtaaccttgacggtttcctgtttcttaattggttttacacttgtttgac

SEQ ID NO: 52609 - DNA, 65 bp, Zea mays
  Clone ID: LIB3067-001-Q1-K1-A9
aaaaaaaaaaaaaaaaaaaaaaaaaaaaaaaataaaaaaagataataaaaaaaaaaaaggaagaa

SEQ ID NO: 52610 - DNA, 381 bp, Zea mays
  Clone ID: LIB3067-001-Q1-K1-C4
tccacgcgtacgcccacgcgtccgcccacgcgtccgcccacgcgtccgagcactccagctgcatcgacgaggaccgacggagcgatttgcgaagcatgggacgggagaggaacccgaggaaggcgaaaatgatctaccgcaactggtcgctgctctcgtccacagacgtcattcgtggcggcgtcaccaccgtcggtctcgccggtatcttactgttgggcggcaaggagaaattcaatggttatctgtgccgagaaggcgagaggcttacgcagcaagacagagccgctatggaccgacactcaaccttagctactaaggtatctcaagggagcagtaacccttcgaaattccacaagattcctgcgtgcctaccagaac

SEQ ID NO: 52611 - DNA, 316 bp, Zea mays
  Clone ID: LIB3067-001-Q1-K1-E11
cccacgcgtccgcccacgcgtccgcccacgcgtccgcccacgcgtccggtttgttatgcgcactggagaaacaaaaatcagcgggctgttaaaactgttaatgagacaataaaactcctgctgctggacagtaattatgagttagatgtaccttcatcaggggtttatttacctctatgatattacatagtataccttgtacatcagaatgatacaaaacaataagtcccaaaaaggaaggtgagttaaaaaacaaaaaaaaaacaaaaaaaaaaaaaaataaaaaagaaaaaagaaaaaaaactaataaaaatat

SEQ ID NO: 52612 - DNA, 164 bp, Zea mays
  Clone ID: LIB3067-001-Q1-K1-E2
cacttttatcgattcaaaaaaaaaaaatataaaaaaaaaaaaaaaaaaaaaaaaaaaaggaaaaaaaagacaaccgatttggaggatcctcatcttacgtccacgttcatgcaccgtcttatccctcctatagtgtctcctatattcaattcactgtccagttc

SEQ ID NO: 52613 - DNA, 86 bp, Zea mays
  Clone ID: LIB3067-001-Q1-K1-F12
cccacgcgtccgcggacgcgtggggtctggtttctacctgaccgtttcgctatctgatgcggaatctttaatatcataatagaaat

SEQ ID NO: 52614 - DNA, 402 bp, Zea mays
  Clone ID: LIB3067-001-Q1-K1-G12
tttacgtaacaattgatgaatatgttatatgtatgtgtggtgtctataacctataagtcaaactattgattgatgaattatgtctatgtatgaaattggtctatacgaatataagtgtgggttaaactgctgaatatgtgtgtgaatagtgaattgatgagtgatgagttgtgttaatttggtgttatattgatatggtctgtgaaactatgagtataaaaaaaaaaaaaaaaaaaaaaaaaaaacaaaaaataaaaaaagataataaaaagctaagataataaaaaaaaaaaaaaaaagatacaaatgttatactacataacatgggggcgctccattttagagacccaagtttgattccccatatttgcacaaagttactctttcatttgggaacccaaa

SEQ ID NO: 52615 - DNA, 417 bp, Zea mays
  Clone ID: LIB3067-002-Q1-K1-A1
tgtgtttgtaaaaaatatctctgcacatctgggagtagctgtcccgcacattgagttgaagcatgtgattgctgctacaattgctcttaagggacttggaagtctcctttttattttgaccagctccctcggtgcttatctcctgctgctgtacctcgctctgatcagtcctatcgttcacgacttctacaactacgacacggagaaggaagaattcgcgcggctgtttgcgaagttcacccaggacgtggcgctagttggagctctcctcgtcttcctgggcatgaagaactccaccccgaagcggcagggcaagaagaaggctcacaaggcgaagacgaactaattagaagttgctcgctcgggctcaggcgggtgtcaggagacgaatagtggcccaatgcgaaacagtcgatg

SEQ ID NO: 52616 - DNA, 247 bp, Zea mays
  Clone ID: LIB3067-002-Q1-K1-A11
cactttttcattttattttgatgggcattccttcattgttcgttctttcaattttattcttctttctttctttccttctttccctttttatttccgttcttcgtccttactctcaacgatttcactggcagcgagtacgccctcttcaccgagcgctgacattcgctctccaggctcgtcggcgtcgatgtcacgaccgatgctgacttccgcgaggttaacctatctgtctactaatacatgcgac

SEQ ID NO: 52617 - DNA, 198 bp, Zea mays
  Clone ID: LIB3067-002-Q1-K1-A7
cccacgcgtccggccacgcgtccgcccacgcgtccgtatcaacgtgcccattgtgccgcgctctaatcaccatgcgtgtgaggctctactcctaagtcggttggtgtctggagggatgggaccaaacagaaaggtgcaagaacttttgggcgcatggactgcgctacgatcttgagatatggtccatatggatgtcat

SEQ ID NO: 52618 - DNA, 365 bp, Zea mays
  Clone ID: LIB3067-002-Q1-K1-C7
aatttttcgtcgtatgcgaaactggagctccaaatatggaaatgctgctgaaagcgatttacgagctgcacacagacttcgttctgaagaatccgttctatgagatggagatgccgattcggtgcgagctgtttgaccacaacctggctcaggtgatccagaaggaccgagttgcgctcctgggtcggtgaaattggaaagcttttggtcctaaccataccatgtatcttgtactttcccccctttttctacattatgctcggacttactgtgcaattgtctcggccgaagacagctggtgaccaacaactgtttggtcctgactattagcaccgtatttggaacagatctaaaaataagaacct

SEQ ID NO: 52619 - DNA, 380 bp, Zea mays
  unsure at all n locations
  Clone ID: LIB3067-002-Q1-K1-D2
tccagaacttcaggtggttttgatctctgcaactcttgctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattntctgcaatactaagagaaaggtggatttggctcactgaaaaaatgcgtacaaataacttcaccgtatcagctatgcacggtgacatgcccgaacttggaatggatgccattatggttgagttcagggtctgcggcatctcgtgtgctaataactacaga

SEQ ID NO: 52620 - DNA, 155 bp, Zea mays
  Clone ID: LIB3067-002-Q1-K1-E7
cccacgcgtccggacagataaagaccaggcaaactatattgaatgggagaggataaagccaatcaacatatgagaggtgattattttaatttgcaatttgtctacataataaattagatacgaaattgtttgtcaaaaaaaaaataatacaaaat

SEQ ID NO: 52621 - DNA, 304 bp, Zea mays
  Clone ID: LIB3067-002-Q1-K1-G3
tcgcccacgcgttcgcccacgcgtgcgcccacgcgtccgcccacgcgttcgcggacgcgtgggcaaagagatgtcgtgggaaaggaacgtgtcgtcctccctagatctttcactttggcgaattaggaggcacgtgtgataaataagagtcttgctagttcgtcgtcgtccatgttgtcatagatcctgtcttgtgtgttcatgttactgtgatgcaggcaattgtgtgttgtgttcgggcgttatttgctgtgttgtgcgttgccaatttgccagcttcagattatgtgtgaataaaaaagag

SEQ ID NO: 52622 - DNA, 399 bp, Zea mays
  Clone ID: LIB3067-002-Q1-K1-G7
tccacgcgtccgggccgccctttttttttttttttttttttttttttttttttgtggtgtgtgcacaacgacaaccatccctgcaaaattattaatacacgaacaaatccgtccaaaattgctggcaagtaaatcataaattatccacccaactgggaacaaaacggagaggctaatcattctaactacggcgctcactgatcactccaatgacgtagtataacttccaaagttttattgaatggccctacagatgtgtatgatcaagcaatcttgggcttgggcttaagtttattcaattgcgagtttgggaaaactccagcaggagcgatcctggttccaatagagttgttgggaaaaacaggggtcctgaataactgatctgaggtcacaatgacc

SEQ ID NO: 52623 - DNA, 88 bp, Zea mays
  Clone ID: LIB3067-002-Q1-K1-H3
gcgtccacgcgtacggccacgcgtgcgcccacgcgtgcgtacacgcgtccgaaaaaaaaaggagggttcaaataacatggaaaaaaga

SEQ ID NO: 52624 - DNA, 444 bp, Zea mays
  Clone ID: LIB3067-003-Q1-K1-A12
gagaaatggtaatccgcgttatcaaagatcagatcaaaacatggatcaagatccaacacgtccatgtacaaaaactagccactacacatcacgcgaggtggctcccgattattcgacttgctgcacggctccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacgtcacgccgccgaggcgcccttggcgtcgccgctgcagtagtcgcgaacggcctcgagcttgaagggcggggcgtcggtggcgagccactgctcgacggtgaacagctgctgcccgcaccccttgtgcgggcccgtggtggt

SEQ ID NO: 52625 - DNA, 89 bp, Zea mays
  Clone ID: LIB3067-003-Q1-K1-B10
aatcaatatatataataaacattatcaaataacaaaactaaaaaaaaaaaaaaaaaaaaaggaaaaaaataaataacagcgagacaaac

SEQ ID NO: 52626 - DNA, 142 bp, Zea mays
  Clone ID: LIB3067-003-Q1-K1-E9
aaaaaaaaaaaaaaaaaaaaaaaaaaaaaaataaaaaaaaaaaaaaaaaaaaaagaaaaaagagtataatggttccaaaattacgtacacataaatacaacaaaaataaatctaatataaagaaacctaaaattaaattaat

SEQ ID NO: 52627 - DNA, 342 bp, Zea mays
  Clone ID: LIB3067-003-Q1-K1-F9
gactgcatagctatagttttgtgataccgaaatctaattcaatggcactggccttacaactacaacactgggaaagccaaaaccttgcccatctcaatctgattggactagatccacatttcgctatctgcagttgtagcaataaggaccaggccgatacgcgattgccattagtaacacatgctcaatgtcaaaggggactggcactgtccctgtacattaacatcaaccgctgtggttgttacgctcacgctcaccgttacagttgccattgccatagccctagctcctgttcctttcgttccttcctttctcgtcatgttcaccggctttgcctttcaa

SEQ ID NO: 52628 - DNA, 91 bp, Zea mays
  Clone ID: LIB3067-003-Q1-K1-G7
cggacgcgtgggcggacgcgtgggctttttgaaaaagtctcaaattattacaaaaaaaagggaatataaaatgaaaggaaaaaatagaaaa

SEQ ID NO: 52629 - DNA, 318 bp, Zea mays
  Clone ID: LIB3067-004-Q1-K1-A12
tagatcgcgacggccgccctttttttattacacatttactgcactgtattgcaaaacattgaggggaagtcttactagattgggaggcaaactcatctaatcccgctcaatccacatgtattgagagctatacctacaagctcgcaatgtattccttgatttctgcttcccctaactcttaggtgcttaatgccaaactttatgaatctctttaaatagatcctatctagttcaatacactctggtcctttttaaatgcacagacatatttttatatgtctactttatacaattcaataactcatgagaactttacaa

SEQ ID NO: 52630 - DNA, 349 bp, Zea mays
  Clone ID: LIB3067-004-Q1-K1-A8
tcctcttctccgtcgcggctcagatcttttcgtgcggcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggtaacaaaaacaaggctgtagtctgggaagaagacactttgtatgagtacctgcttaaccctaagaagtacattcctggaaccaagatggtcttccctgggctgaagaagccgcatgagcgtgctgatctta

SEQ ID NO: 52631 - DNA, 54 bp, Zea mays
  Clone ID: LIB3067-004-Q1-K1-G7
cggacgcgtgggaaaaaaaaaatgcattgatagaggaattaaaaagataaaaag

SEQ ID NO: 52632 - DNA, 59 bp, Zea mays
  Clone ID: LIB3067-004-Q1-K1-G8
ttttctgcttgcatgcgatgatataacttttctattgtttaacctaaattcaatttatt

SEQ ID NO: 52633 - DNA, 237 bp, Zea mays
  Clone ID: LIB3067-004-Q1-K1-H2
cccacgcgtccgcagatccggacccgaccgccgatccatccaaatcatgcttccccttgcaccaccaccaggccgtcgcctcgtgccctcaattctcctttcgaatttagaatccccgtgctgagagctgagtgccgccttggttgctccgtactggactcgattcctcatcgcagcagaagcatcccgtccctccgcttctccttgctctgctctggtaacacacagacaaataaa

SEQ ID NO: 52634 - DNA, 359 bp, Zea mays
  Clone ID: LIB3067-004-Q1-K1-H8
ggggttttgtagcattctgcagcttatgaataatccagtaattgtacaataccgacagtaaactgacgtcccattataaatcctttcagtaatgataacaaaagtttcaacaaatgctcgacacaaagttttaacagcaacatattatagcactctgcagccgggatccatgtggctaaacatcataacataaagttctcggcagtaagaggcagcagcaataattccttcacaaacttctaacttcaaaaatataaagtaacacttaggccagcattcggccgttcttcaaatcaaatacttattcttccttctcagccttctcgagccatttgacatacggctccagagctttcacg

SEQ ID NO: 52635 - DNA, 400 bp, Zea mays
  Clone ID: LIB3067-005-Q1-K1-B7
tgatcgtccaggatctgccttccttgggctggggagtaagaaaagatctggctatctgctggtgcatcttgcttaggcagaaggtcgatgaaacttattgctgtgtgcagtatcttgaaaatcatctggagcttttagatttccttgttggttgctacaagaacttggatattgcattgaactgtggaaatatgttaagagaatgcataaagtaccctacacttgcaaaatacatattggaatctggtagctttgagctgttctttgagtatgttgagcttccaaactttgatattgcttcagatgctctgaacaccttcaaggatctgcttaccaagcacgaagttgtagtcgcagagttcttgagttcccactacgagcagttttttgaactctactc

SEQ ID NO: 52636 - DNA, 439 bp, Zea mays
  unsure at all n locations
  Clone ID: LIB3067-005-Q1-K1-F12
tccatgtcgtttttgtcgtttaaggcgaacaataaattttgcttttgaataattttgctcaaggatagacatgtttcccggactctctccacaaacaggatccacaagtgctggctccacacaagcaaccatagtagaaagacattcaaatgctcggggtaccttgggctcatggaggtctgaatgtatcatccaaaagattgatgatacttgttcatggcttcgaaggttactaagaaggcctgaaattgatgacactgaagcatgccttaacatggagctaattgagtcaacagccacagaaaaatatgttttgccttctccttcaaaacctcctccaagttcagtagtggaggacatcaattntgtaacatccttcacacttctataaacagtaatattatctntaattgttgagaactgctntgcactgttccct

SEQ ID NO: 52637 - DNA, 305 bp, Zea mays
  Clone ID: LIB3067-005-Q1-K1-F8
cccacgcgtccgcccacgcgtccgcccacgcgtccgaaaggagtgatctaccacgggttaactagtttttctacttggcatggaagtaccatccagactatgaagtcttctttgcttgctaaataatactgtcaaagaacaagtcgactacatttttgcatcatatttctgtttgtatttgtggatatgaaatgccatcaacttgaagatcagcattgttactattttggttaattaaaaaaaaaataatataataaattaaataaatattaataaaatatatattaatattattattttataaa

SEQ ID NO: 52638 - DNA, 144 bp, Zea mays
  unsure at all n locations
  Clone ID: LIB3067-005-Q1-K1-G2
nccacgcgttcgaaaaaaaaaaaaatatttttaaattaaaaataaaaaataaaaaaaaaagggcgtactttctaaaagggccaagcttacaaacacattcatgcaaaattataaacatttctatagagtcaaataaattcaatt

SEQ ID NO: 52639 - DNA, 374 bp, Zea mays
  Clone ID: LIB3067-005-Q1-K1-G8
gaagtacattgggagattcatcgatagctaaatattaggagtaatttatgtcatgtcattagggcataaaattaccacaacagccactcagagcacacacattgagtggtccaaatatttccagctagggaaacttgcagagtaactgatacgactacagcaaagagcagcaggttaagctagattgttaggaaagagcacctgcacctggctgtctccattagtggatatacgagacctggtactgaactgggtagccattaccgtaataaggtccatgggcaggttgcatcgtgtaagacgctgaggtcatcatgggaagaagatgaacctcagcgccatacacaaactgcctctcgcaaggattgaatgga

SEQ ID NO: 52640 - DNA, 178 bp, Zea mays
  Clone ID: LIB3067-006-Q1-K1-B11
ttgagaagggatgctcttaccttttcaatcagagccgtggaaccattgccaaatttgcatagcgttgacgacagatgaggggttgctgcagacattgcacattcaggcttaagcaccagctatagtctgaggtgtcggaatcacgactgagcagattcaacagcatctggatgagaat

SEQ ID NO: 52641 - DNA, 380 bp, Zea mays
  unsure at all n locations
  Clone ID: LIB3067-006-Q1-K1-B5
tgtgtcctagcgccgtcgtcgccccaactcgccttgcgtgactgaaagctcgtcggcttccgtccacgcgagaagcgagagcatggacacccaggtgaagcttgctgttgtggtgaatgtgatgggcaggaccggctccaggggtcaggtgacccaggtcatatntagggttcttggatgaccagaaccggctcatcatgaggaatgtcaaggggcccgtccgcgagggtgacatcctcaccctgctcgagtccgagagggaggccaggaggctgcgctgaagccctagcgttcttggtgggctcttgtttggtctttggtgtcttcgaatttgtgctatggttgaacttttgtgaccctgtcttgagagtagtaagcct

SEQ ID NO: 52642 - DNA, 201 bp, Zea mays
  Clone ID: LIB3067-006-Q1-K1-C2
ttcatgttgaacttatatatatttccatccttttgcagttagtttgagtcgtatttgctgtgtaccaaacatgtattgcaaatttggaatttttgtaagctataataatgccagcacggcaatatccccacatgataaccccgaaatttgtatcgttcaaagttcaaaccatggtatcctaattcaaaaattttgcctttt

SEQ ID NO: 52643 - DNA, 52 bp, Zea mays
  Clone ID: LIB3067-006-Q1-K1-D10
aaaaaaaaaaaaaaaaaaaaaaaaaaaaaaaaaaaaaaaaaaaacaaaaaaa

SEQ ID NO: 52644 - DNA, 57 bp, Zea mays
  Clone ID: LIB3067-006-Q1-K1-D8
aaaaaaaaaaaaaaaaaaaaaaaaaaaaaaaaaaaaaaaaaaaaaaaaaaaaaaaaa

SEQ ID NO: 52645 - DNA, 391 bp, Zea mays
  Clone ID: LIB3067-006-Q1-K1-E5
tccacgcgtccgcaaggacctgtacatcaacaatgctatccagatggatgttaccgggagcaggaaggctgttgtcatccacgtcccataccgcctgcgcaaggccttcaggaagatccatgttagactcgtcagggagctggagaagaaattcagcggcaaggatgttggtgattgttgctacaaggaggattgtgaggccacccaagaagggttcagctgttctgcgccctctcaccaggactctgactgctgttcacgatggcatcttggaggatgttgtctacccagctgagattgtggggaagcgtgtcagataccggctggatggttccaagattatcaagattttcttggacccaaaggggaggaacaacactgaatacaagct

SEQ ID NO: 52646 - DNA, 179 bp, Zea mays
  Clone ID: LIB3067-007-Q1-K1-B1
aaaaaaaaaaaaaaaaaaaaaaaaaaaaaaataaaaaaataaaaaagggcggcccaataaaagggtaccaggttacttacacatgtatgcgattaaatattctcttatatagagataccaaaattcaattcattggtcctgtaattacaacgtattgactgggaaaaccttttctttac

SEQ ID NO: 52647 - DNA, 248 bp, Zea mays
  Clone ID: LIB3067-007-Q1-K1-B2
tagaactcttgttatatagtaaagatgtgacattcgatcatgtgccatgattcatcatatgtgtgaggcttggtcccagcacacctggtgattatgtttgcgcccgggtcttggtgccctgaaaccctggtgtgactgctttgagctaaatattcttgattctatgatattcttttgatgtcttgtatatatttttcatatgtttttctttatattctggttttaattttatatgtttttttcttttt

SEQ ID NO: 52648 - DNA, 321 bp, Zea mays
  Clone ID: LIB3067-007-Q1-K1-B3
tgattttagccgccgccgctgctcatctcacatccctcgagaagacgcctgctcctcgccgatcgatacgatggccgacttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgc

SEQ ID NO: 52649 - DNA, 289 bp, Zea mays
  Clone ID: LIB3067-007-Q1-K1-B5
cccacgcgtccgcccacgcgtccgcccacgcgtccgcctatattgtgtgcctccacatattggggagcttgaagcatcgacaagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctaaaaaaaaaatataataattattatattaaatat

SEQ ID NO: 52650 - DNA, 96 bp, Zea mays
  Clone ID: LIB3067-007-Q1-K1-C10
cccacgcgtccgaaaaaaaaaaataaaaaaaaataaaaattaaaaaaaaaaaataaaataatggaaaaaaggaaaaaaaatataaaaaataataat

SEQ ID NO: 52651 - DNA, 463 bp, Zea mays
  Clone ID: LIB3067-007-Q1-K1-E12
tgctctacttcaccggcgccaccaacatcctctacaccttcggcggccacgccgtcacagtcgagatgatgcacgcgatgtggaagcccgccaagtgcaagtacatctacctgctggcgactctgtacgtgttcacgctgacgctgccgtccatggcggccatgttctgtgtgttcggcgacgagcttttgacctatttgtacgctttttcgcagtttctgattttcttgttgcttgtctctgttgttttaatattgcgtttcttttttttttttttttagttattttttttttatttttttttttttgattttattttttgttttttttaatttatttattttattgttattttatttttattttttttattttttttttttttgttttttgtttttatatatttttttatttgtttatttatttttttttgttttttctttttttttttttgtttttgttt

SEQ ID NO: 52652 - DNA, 73 bp, Zea mays
  Clone ID: LIB3067-007-Q1-K1-F3
cgccgttataaagctgattatgagctaaaaatataaatccaaaaaaaaaaaataaataataaggctaaattaa

SEQ ID NO: 52653 - DNA, 188 bp, Zea mays
  Clone ID: LIB3067-008-Q1-K1-A6
atgacaccagcatgtttcctgtatcattttgctgtttttttttggttgttgctccggtttcaacaaggagccggaaacatgttttctgtatcgttttaggtctttgttcggttaatcctattacctatgaattggatgagattgaaaaaattaagaaataactttgacttgtttggaatttaaaaata

SEQ ID NO: 52654 - DNA, 177 bp, Zea mays
  Clone ID: LIB3067-008-Q1-K1-B6
caaggctgtagtagtgtgtgtagtaacgaagtatatacatgcatcagatggtgtaagggagtaccagctgttagttcatggtttcaagcttagccccccttcaatttgttcgatgatgtattacttcacaataaacattattacttagatgtatgaggtgagcacacttggtcttta

SEQ ID NO: 52655 - DNA, 371 bp, Zea mays
  Clone ID: LIB3067-008-Q1-K1-C11
gatgcagcacctccaaattttaacctctcgaaacaggccaatagccatacattataggacacaaactaaaacaagagccttacgtgattctagctacccgtgacgaaacagtttttttccccgggtcacgtccgttattgcagagtgcagacaacgtagcatagactaacaggacaactaactgcacaccgaccgatgcggcagccgcagcgcgtctcctccttcctcccgtgcatagggcacggacggattcaggggctcagttgcagggctccctcgcgaacccgacgcgcgagccggcgacgtcgacgactacccgcacgttctgctgcttaaggttggccaccacgttcactactgctttcactttc

SEQ ID NO: 52656 - DNA, 246 bp, Zea mays
  Clone ID: LIB3067-008-Q1-K1-D6
aaaatacaaatacatgcatataaatattaaatccggcacgagacggacatgaccgcgagcacgttacacagatgaacatgaaccccaggagcgaccatggatcgataatggcgggtgcagttgacaggatcttatttagacgctgctattaattatatttatacgccttgtcgacgtcgtcctttcgactcttgtgcgccatcgccgggccgggcggtccggctcagttgcagttgcatctggagc

SEQ ID NO: 52657 - DNA, 398 bp, Zea mays
  Clone ID: LIB3067-008-Q1-K1-E10
tttgttatcctaagggtattattgatcctgtggaccttgcaaagaacaatgagaatgcaccgccaagaataccaagctgcatttgaaattatccctgataaagttgcagagggtaatgatgtgtcttccacaggaattactaaggatactactggccatagtgcagatggtaaagctctcacttcagaaccgcatataggggaaacacatgtcaactcagcttcagaatccataccaaatgacgcatctcccccaacccagagcaaaatgaatgggtcgaccaagaaatcattagtcaatggtgttttggatcaaccaaatgccaactcatggctagaatcctcgggaaatgattatcctagctacactaactcgagcagtgctttgccacccgcgag

SEQ ID NO: 52658 - DNA, 154 bp, Zea mays
  Clone ID: LIB3067-008-Q1-K1-G5
cggacgcgtgggcggacgcgtgggcttaccataacttttgggcaaagtaagcgctagcatctgggttgtactagtatgttgcacagatctgaataatgtgcataagattcttcaaaaaaaaaacacaaaaaaaacaaaaataaaaactattaag

SEQ ID NO: 52659 - DNA, 168 bp, Zea mays
  Clone ID: LIB3067-008-Q1-K1-H11
tggatgggtacaacttcacgcagtgtcacggaaacgggaccaaatgattgaaatggttatactagtagggtgttactgtagttttcccagttgaatttaatttgcaactgagtttgtactcaaaaaaaaaaaaaaaaatataaaaaaagaaaataaaaaaaataaata

SEQ ID NO: 52660 - DNA, 215 bp, Zea mays
  Clone ID: LIB3067-008-Q1-K1-H3
cccacgcgtccgggtcggttgaagggtgaagggtggagtttggttgaagggtcgagctatgctgacgttcgtcgattgaagggtggaggttgtttttttccagcaactggattgtatatggatggattggggcctgagttcgattctgcattctgcttgagcaataataagtctgagctattcctgtcaaaaaatataatagtttctaattaaat

SEQ ID NO: 52661 - DNA, 64 bp, Zea mays
  Clone ID: LIB3067-009-Q1-K1-A6
gaagattctcaaccaatgcaaccaagcagagtggcggccattcttcaaaaaaaaaagaaaagaa

SEQ ID NO: 52662 - DNA, 189 bp, Zea mays
  Clone ID: LIB3067-009-Q1-K1-B12
tagatcattggacacatatcgaaacagctctagctagcgcgctcgtcgtctaacctggcttccggcatggcttccaagcagatcggagtcttgacctgcttcattgccatcaccgctctcgccttccgtccctgcgcattcgccgtgcccatggactgtgggcgtgttccactatatactcatccaatt

SEQ ID NO: 52663 - DNA, 125 bp, Zea mays
  Clone ID: LIB3067-009-Q1-K1-C3
cccacgcgttcgaaggaaacatatgttcctgctatttggaggtttagttggctcgcaaaggaaaaaataaaaaaaaaaaaaaaaaaaaataaaaaaaaaaaaaaataaaaaaaataaatgaaaaa

SEQ ID NO: 52664 - DNA, 334 bp, Zea mays
  unsure at all n locations
  Clone ID: LIB3067-009-Q1-K1-C5
tccacgcgttcggccacgcgnttcgccacgcctccgggtccccatccttcgccaaggggaagagcaagatgctttacgcaagcttaaaccagaaattcaagaatggccttaaatgcattcaaggtgaacttcaagccacaaattccaatgaaattaacctttattagatcaaagattcggcaccctatgcgcaacggcatttcgaggttcatgatcacaccttattgacattcctacatattgtggatatgtatgcgcctttatacactgggctctgaaaaactgtttttgggagatgtggggttgttgctctgtgaaaagatactcataggtt

SEQ ID NO: 52665 - DNA, 131 bp, Zea mays
  Clone ID: LIB3067-009-Q1-K1-C6
tccactcgtttttctattctttcgtctacttattcgtttccccattattcttcttggtcgggattctgatgcttcactcgaggtcaatctcattaattcattagtggccttactggaattcatgatatact

SEQ ID NO: 52666 - DNA, 404 bp, Zea mays
  Clone ID: LIB3067-009-Q1-K1-C8
tctgaaacacaaccgtcctagtcccaaacacactgaagagaaacaacgcatatttgccgaatctgtcttgatgagactggaggagaaatgaagggacgtcaagccgtacaagtgcacttcgttagggttttacatgcagctaccttgtaattcggttggcttccagaaaaaaaaatgtgagcctggacacgtcaagtgaccacctcagttttgttgtaaatttgttactagtttgataggattattagtatgtacttatcaggaaaagaattctcagtatgtgttttggctgcccattcaatgataggtcagtgattaacaccgaagcattgtgctcttgtgagatgctgtgttggtcttaatatattgacggtactgtaccatggtttaaaaaaaaaataaaa

SEQ ID NO: 52667 - DNA, 59 bp, Zea mays
  Clone ID: LIB3067-009-Q1-K1-E1
gacacgccctgtatcggcccattaagcgcgtcggttgtggtggttacacccatcgtgac

SEQ ID NO: 52668 - DNA, 70 bp, Zea mays
  Clone ID: LIB3067-009-Q1-K1-E3
accacgcgtccgatttattagcatcctcgattcctagaaaaaaaaaaaaaaaaaaaaaaagaaagaaaaa

SEQ ID NO: 52669 - DNA, 375 bp, Zea mays
  Clone ID: LIB3067-009-Q1-K1-E4
tccttctccagctccttccacactgcaggagaaggagaacaaggagttcttcgacaagtacaggcagtgtatctctgagaagttattctgtagctctttttattcttatatgatcttgtcttttttattttttttttttattttctttaaaatatctttttttgtttcttattcttgcttttattttttatgttttcttattatttactgtttattattttttgatgttttatttattttttctattaattattttttttttttttttattgtcttcttttattttttttttcttttatttttttttttttgtttttgttatttattgtttttctattttttttctttttttttttttttttttttttatttatt

SEQ ID NO: 52670 - DNA, 151 bp, Zea mays
  Clone ID: LIB3067-009-Q1-K1-H6
aaaaaaaaaaaaaaaaaaaaaaaaataaaataaaaaaaaaaaaaaaaaaaaaaaaaaaaaggggtagccaatactagcgggaccgatcttacttacacttgcatgcaacattataagctgttctctcttgtaacgtattttcacttctctt

SEQ ID NO: 52671 - DNA, 473 bp, Zea mays
  unsure at all n locations
  Clone ID: LIB3067-010-Q1-K1-B8
tccactgccgtccgaagggaaagtatcntgggccatcttgatatctgcnntgcgtcgatgtaaaatgccgggcttacttcctttgcgtcacgnaatcaagctgttacttaatgctcaacactgaagatggttactcaanttaggganagctttccgaagccaatactctgggctgtgattctgctctttgtgatgggtttcatagcaggtggtttcattctgggtgctgttcacaatgcaattttgctgatagttgttgtggtgatatttggttttgttgctgcacttcttatctggaatgcttgctggggtagtagaggtgcagttgggtttgttaatcgctatcctgatgctgatctcagaactgctaaagatggacaatatgtaaaggttacaggggttgttacctgtggaaatttcccccttgaatcctcgttccaaagggtcccgaaatgtgtatacacttctactag

SEQ ID NO: 52672 - DNA, 260 bp, Zea mays
  Clone ID: LIB3067-010-Q1-K1-C8
tcgtctcgtatcatcatgcgccatatcatataatgggactccgtggtatgaatgcttcatcggcgatcaggacgttgccgtatttggcgtgtactcgtatgcattgcattaactgtagctgttcgtaggactacctattgtgacttgctgtatcgtaattaatatatatatatttggatgtctatgtaaataaaataaataaataaaaaataataaaaaaaaataaaaataaaataaaaataaaaaagaaaaataaaata

SEQ ID NO: 52673 - DNA, 77 bp, Zea mays
  Clone ID: LIB3067-010-Q1-K1-E4
aaaaaaaacaataaaaaaaataaaaaaaaaaaaaaaaaaaaaaaaaaaaaaaaaaaaaaaaaaagcaaaaaaaaaaa

SEQ ID NO: 52674 - DNA, 107 bp, Zea mays
  Clone ID: LIB3067-010-Q1-K1-F6
aaaaaaaaaagtctatttctacagctaattattacacattcaaaaaaaaaaacctaacaaaggggactaaaaaaaaaaaataaacaaaaaaaataaaattcaaaata

SEQ ID NO: 52675 - DNA, 82 bp, Zea mays
  Clone ID: LIB3067-011-Q1-K1-C5
tccaatctatccgatctataatgacttctgcatgacatactaggcatagaagatgtgcatcggagtaattgagaactgcgaa

SEQ ID NO: 52676 - DNA, 199 bp, Zea mays
  Clone ID: LIB3067-011-Q1-K1-D5
tccacgcgtccgtccacgcgtccgcacacgctttcgtgactatggttatccaacaagagttcggctatatttatggaagagctcatttcccgtttcatggacgagtaacagctgtcatggagacaggtacaagttcctatttatacatatttccaatttgggctgtcatgatacactactaccaactattcaattggac

SEQ ID NO: 52677 - DNA, 111 bp, Zea mays
  Clone ID: LIB3067-011-Q1-K1-F2
tacacgcgttcgcccacgcttcctgcagattcttccatctgctgcctgctgttcctgatccagggaccgttgatcataagctagcatcttctgtgatgctcaaggtcatga

SEQ ID NO: 52678 - DNA, 236 bp, Zea mays
  Clone ID: LIB3067-011-Q1-K1-H7
tattgacgagaatcaacgcggaacttatgacttcatctacctgccaattgattttagggatagatgtaacgcgggatatgcattcatcaatatgacagatccactgcaaatagttccattttacatgacattcatcggcaagaaatgggagatgttcaatagcgataaagcggcatcacttgcgtacgccagaatccagtgaaggaacgctatgagtgctcattctcagaattcta

SEQ ID NO: 52679 - DNA, 313 bp, Zea mays
  Clone ID: LIB3067-012-Q1-K1-F9
actagtggatcccccgggctgcaggcataaatcgccgaggaaaacaagatgtcggggcagcaagaagaagataagaaacccggcgatcagtccggcggtcacatcaacctcaaagtcaaaggccaggacgggaatgaagttttctttaagatcaaaagaagcacacaattgaagaagctcatgaatgcatattgctaccgacaatctgtggatttcaactcgattgccttcttgttcgatggtcgccgtctgcgaggtgagcaaactccggactagcttgagatggaggatggtgatgagatcgatgctatgc

SEQ ID NO: 52680 - DNA, 60 bp, Zea mays
  Clone ID: LIB3067-013-Q1-K1-A11
aaaaaaaaaaaaaaaaaaaataaaaaaaaaaaaaaaaaaaaaaaaaaaaaaaaaaaaaaa

SEQ ID NO: 52681 - DNA, 283 bp, Zea mays
  Clone ID: LIB3067-013-Q1-K1-A3
ccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaaagctatgttgtggacagaagtgtaacgtgccggatttcttgcaaaaaaaaatatattatatgttttactttaatttgtattataat

SEQ ID NO: 52682 - DNA, 205 bp, Zea mays
  Clone ID: LIB3067-013-Q1-K1-D1
ttcctctcctcccggtgccagccgccgtgcgcgctctcttcgccctacggaaggtgcggaggtgccgagatcttgctcgatctcttcggcggcgaagagcgccaaccagatccgtcctgtttgttggtgtggcgcctgagcaggagtaggtcgcggccacagaaccctaggagcaaattccatggcaccgagtgacacaattgat

SEQ ID NO: 52683 - DNA, 56 bp, Zea mays
  Clone ID: LIB3067-013-Q1-K1-D9
gacgcgctctgtatcggttcattaagcgcggttgtagtggtggtttctcgcatttt

SEQ ID NO: 52684 - DNA, 69 bp, Zea mays
  Clone ID: LIB3067-013-Q1-K1-E3
cggacgcgtgggctgacacgtgtgcggacgcttgggataaaaaaagcaacaagtattgatggggtacgg

SEQ ID NO: 52685 - DNA, 53 bp, Zea mays
  Clone ID: LIB3067-013-Q1-K1-E8
ttcacgcgtacgtttactcgtgcgttttagttttgatgagatgctaaaagatt

SEQ ID NO: 52686 - DNA, 94 bp, Zea mays
  Clone ID: LIB3067-013-Q1-K1-F1
aaaaaaaaaaaaaaaaaaataaaaaaaaaaaattttaaatttaaaaaaaaaaaaaaaaaaaaaaggaaaaaataaaaaaaaaaaaaagataaaa

SEQ ID NO: 52687 - DNA, 389 bp, Zea mays
  Clone ID: LIB3067-013-Q1-K1-F11
tttttttttttttttttttttttttttttttttttttttttttttttttttaaattttttttttatttttttttttatttttttttctttttttttcttttattttcttttttttttttttttttttttttttttttttttttttttttttttctttttttaatttttttttttttttttttttttttctttttttttttttttttttttctttttttttttattttattttttatttttttttttttctttatttttttttttttttttttcttttttttttttttttttttttttttttttttttttttttatttttttttttttttttttttttttttttatttttttttttttttttcttttttttttttttttatttttttttt

SEQ ID NO: 52688 - DNA, 344 bp, Zea mays
  Clone ID: LIB3067-013-Q1-K1-G4
ggggttccaacgttcgcaacaagtgcggcgtctattccatggtctctaccgtgtccgcagtccacgcctcgaaggagtagactctggtcagcggtgataatcgtgattccatatattgtagaactacaatccctgctagtaatccatttgtgctgtttatgtatcgaaggcagcaaagatgtgtgaagcggcaatgggatgcttgctgtaaggtaatatgtttggcttgctaggcatgctacacgctatttggatgtagcaacgttatcaccagctgtatacgctttttaatcgacaacatttgaataatatgtacataaaataaaataatcaattaaataaag

SEQ ID NO: 52689 - DNA, 445 bp, Zea mays
  Clone ID: LIB3067-013-Q1-K1-H3
tggtgcggctcctatttcgtctatgatgactgtgcagcgatggtcgcgtggcccttcagccacccaaatcggaaagcctgctgttcacatggctagcgttgacttgaaaggaaaagcatacgatgtattgaggcagaattcttccaggtttttgttggaagatgtctacaggaacccaggtccgctccagtttgaaggaccaggtgccgattcaaagcctatctcactgtgcgtcgaggatcaagactacatgggcaggataaagaaattgcaggaatacctggagaaggtgaagagcattgtgaaacctgggtgctcgcaagatgtccttaaagcggcgctgagcgccatgttttctgtgacggagacacttgacaataagacctcatcgttcacccgccagactgcactgtgacttcgttggtgcccttttgtggtgcggatc

SEQ ID NO: 52690 - DNA, 223 bp, Zea mays
  Clone ID: LIB3067-014-Q1-K1-A10
gagggagcgagtagaccgcgtgtttcgctatcgtgggactagaataagccatgccaatgaacatgagccgaatagaggctacgtactgttattgtatcagtactagtaccctatatatatgggcgcactacagttctgtgatgtaatggattctgctagtatttgactcttgtgcttttgtacagaaaaaaataaaaataaaaattaagagaaaaaatataat

SEQ ID NO: 52691 - DNA, 155 bp, Zea mays
  Clone ID: LIB3067-014-Q1-K1-B7
tcgtccacgcgtccgtacctttatgtgcacattttccatatgtgacccccttctccatataaggtgaacatattttactcttttgggctccttgtaatttcattagtaaaatctctacttaattattaatgctgcatagttaaaaatttataaaa

SEQ ID NO: 52692 - DNA, 226 bp, Zea mays
  Clone ID: LIB3067-014-Q1-K1-C9
tccacgcgtccggcagcccctggtacggccccgaccgcgtcaagtacctcggcccgttctccggcgagcccacgagctacctcaccggcgagttccccggcgactacggctgggacaccgtcgggctgtacgccgaccccgagaccttcgccaagaaccgctagctggaggtgatccactcccgctgggccatgcttggcgcgctcggcttcgtttttcccttgct

SEQ ID NO: 52693 - DNA, 413 bp, Zea mays
  Clone ID: LIB3067-014-Q1-K1-E11
tccacgcgtccgcagtcatctcaaacttatttatcatgtaatctgagatctccagttgatgtcaatgttggagatggctctgagacctcacctgggcagcataatggtctggtcactctctcttatataatggacttttttggatcaatgcttccaggctaaaatgttctatgaaattcttcatgtctgcttccactaattgcttccattgagcatggtgaggttagattttttgcatcaccataattgttttgagcctgttactttgctttcctctttgattgtctttgtcagtcttttgtttttttttatcttccaagtggaaacactttttctaattgttctattttactttattttttcttttgtttattcttttttttttattctttcttttttttttatttcttttt

SEQ ID NO: 52694 - DNA, 171 bp, Zea mays
  Clone ID: LIB3067-014-Q1-K1-E7
tatgcatatatctgttgaaatgctattatgttcaaataaaatatcaatagaccttatagggggtaattttaaaaattattcaggatgaaatattaatataatttaacattaaaacatattatataaattactataaatgtgcaacctcttttgaggttcctggattatata

SEQ ID NO: 52695 - DNA, 447 bp, Zea mays
  Clone ID: LIB3067-014-Q1-K1-G12
ttggtgacttcccttcaatccttctacaataataaacaggttgggtgcaagatgggctatggattctgtgctactggaacaatgatcttcaaaagtaatctgtcttctcgagaaattgtagagcagctggtccatgcatcctactattctcagatccaaaatgttgttttcatggagcttaccaacgaagattctgaaatatgcagttcaagttacggatatcaagctgaagctttaccaacgcggctatcattcacgtggaaagtggaaaatttcttgtcttttaaagagattatggagtccagaaagatttttagtaaatatttttaggctggctgctgtgagttgcggataggttgatatgagtcgtttgatacgatctgcatatacttggtaagtgatcaatcatctgggtttgatcctgattagaaactttgggtacatttt

SEQ ID NO: 52696 - DNA, 54 bp, Zea mays
  Clone ID: LIB3067-016-Q1-K1-A10
cccacgcgtccgaaaaaaatacaatataatattttttataaaaataaataatat

SEQ ID NO: 52697 - DNA, 130 bp, Zea mays
  Clone ID: LIB3067-016-Q1-K1-A2
tgttttttgttttttttatgaaaaagaagataatggtgctggattgacatagcagggattttatattagtcgttaaaaaaaaaaaaaaaataaaataattaaaattaaaaaatatataggttatttttat

SEQ ID NO: 52698 - DNA, 87 bp, Zea mays
  Clone ID: LIB3067-016-Q1-K1-C3
aaaaaaaataaaaaaaaccaaaaaataaaaattaaaaaaaaaaaaaaaaaaaaaaaaaaaagagaaaaaataggaaaaacattataa

SEQ ID NO: 52699 - DNA, 155 bp, Zea mays
  Clone ID: LIB3067-016-Q1-K1-C5
tgtgtattgggaataaccgaacaaggccttagatggttaaaaggacgtgttccggtatggatggtactatggtgaaacattgtgtcagtttttgtggtctctgtatggattttgaagtatgcctaaagaagtttttggtgcttaaaaaataatat

SEQ ID NO: 52700 - DNA, 60 bp, Zea mays
  Clone ID: LIB3067-016-Q1-K1-D1
aaaaaaaaaaataaaaaaaaaaaaaaaaaaaaggaaggaagaaaaaaagagatataaaat

SEQ ID NO: 52701 - DNA, 442 bp, Zea mays
  Clone ID: LIB3067-016-Q1-K1-F5
tgaataagtatcaattagtttgtctagatggataggttgccggtcataacagaaaagaactgaatgcttgctgtatgatcgcgtgtttacctaatttcatgctgactcatatatgaaatatgtacatatatcatgtttattggctgagcgaatttcatttatttgaggttagtataacctatattagatctgcctagtgatcatatctcatctataggggcgttcggtttatcttttatagtttcgttttaagttagaatttcttctaatctgtttaacttttattatctgatctgttttactgtttgaggttattttttttttttcttattttcttttatgtgtgatttttgtattattattattttttgtgttttttgttgtattcttttttttttttattttttaatattttgtcttatttccttaatgttttgatttt

SEQ ID NO: 52702 - DNA, 203 bp, Zea mays
  Clone ID: LIB3067-016-Q1-K1-G5
tctcaagcaaggatgggcggcaggaggatgatgagttcagaatctgatccatcactaaatgctgaacatcggagcatgaggagggcaccatcagcatcagttgggaatctgcctcctatggggagacctatcttttcttcgcagcaggcatcagatctcataggggggtcttcagtttccaactcaaggaaagatgagttcta

SEQ ID NO: 52703 - DNA, 73 bp, Zea mays
  Clone ID: LIB3067-016-Q1-K1-G7
tcgcccacgcgtccgaaaaaaaaaaataaaaattctaaaaaaaaaataaaaacaaaagaataaaggtaaaact

SEQ ID NO: 52704 - DNA, 87 bp, Zea mays
  Clone ID: LIB3067-016-Q1-K1-H1
aaaaaaaaaaaaaagaaaaataaaaaaaaaataaaaaaaaaaaaaaaaagaaaaaaaaaacaaaaaaaaacgaaaataaataaaaaa

SEQ ID NO: 52705 - DNA, 93 bp, Zea mays
  Clone ID: LIB3067-016-Q1-K1-H6
tatacgcctttcttagtgctatgcttaattaatcagagcaaaccacgttacagtacattggaatttgggaccggttctgtatatattttaaag

SEQ ID NO: 52706 - DNA, 363 bp, Zea mays
  Clone ID: LIB3067-017-Q1-K1-A1
gtgatgtgtagcatatagcgcgcgcgcaccattcgtcaataaataaataaataaataaatagagtaataaataaaggccaacgtacgacgacaaattagtggcgcgcgcggtagtagctagcagagtatgcgccgtcactgtgtcgatctgcagtttggtcgtttaaaagtgattgtagtgtgtactatgttcagctcgatgatctcggagtcgctatatacgctcgctcccgtgctggacgggttatcgatctgatgaacaagaatacaataatatgtatggatacttgtgactgggttccgcggaagtctggctttaattaccgtgtgattgggtacctgcaccaaaataaaatattttaa

SEQ ID NO: 52707 - DNA, 88 bp, Zea mays
  Clone ID: LIB3067-017-Q1-K1-A12
ggggggaagttctttttttttgttttggttttcttttttttttggattgcttctctcttttgacttgtttttgatttatttttattct

SEQ ID NO: 52708 - DNA, 158 bp, Zea mays
  Clone ID: LIB3067-017-Q1-K1-A7
acgcggacgcgtgggatacacatggattggataggattgggaataaccgaacaaggcctaagcggaatcatcaaagaagcgattgtgttctgactttttgatgtagttcttgtgacgtgcaatgctatccatgcgtcgcactccaaaaaaaaataatt

SEQ ID NO: 52709 - DNA, 393 bp, Zea mays
  Clone ID: LIB3067-017-Q1-K1-B12
cagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgttgtcatttcatgtgtgtaccccgtgcaatgctttgtgcgcatggttgatttctctgtggcaaacttcccgtcctgcatggggttgtaagctgtctctaaatttaacggcaagtcgtatgcctgaaccttcatcttaagttgttgtcgtatcccttcgtcttgtttcggttgcaccccgtgatggtatggattgggtgctgacc

SEQ ID NO: 52710 - DNA, 357 bp, Zea mays
  Clone ID: LIB3067-017-Q1-K1-B4
cccacgcgtccggaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttatttcgtttagttccttgtctgtgacgtgttggactattgttagtagtattcttgaagttgtttcgaatgtaatccaatcttatcgttcgataattgaaaaaaaaaaataatattatatatattaattatttatttattattattatttttctattatataaaaattaatat

SEQ ID NO: 52711 - DNA, 95 bp, Zea mays
  Clone ID: LIB3067-017-Q1-K1-E11
tttttcttttttttcttagtgtctttttttatttttattcgtttttttttaatgtttttttctcattgtttctcaatcccgagccccccataaaa

SEQ ID NO: 52712 - DNA, 314 bp, Zea mays
  Clone ID: LIB3067-017-Q1-K1-E3
tgaagacctacggcttcctcactcctgagttctgggccgagaccaagtatgccaagaccccgttccaggagttcaccgacctcttggctaagccgacaaagggtcttctgatcgaggctcccaccgagacagtggaagcttgaacgtcttagtttactgttccaagtgtcgcgaaaagagttttctgtactagctacatattttaaatgttattttgaattatgatgagaaaccaaggtatgcacccaagataattgatgtcctgctgttttcgtatgtgggtatcgaaccccaaagaaatagattcaaaaatg

SEQ ID NO: 52713 - DNA, 63 bp, Zea mays
  Clone ID: LIB3067-017-Q1-K1-H2
cggacgcgtgggcggacgcgtgggaaaaaaaaaaaaaaaaaaaaaaaaaaaaaaaaaaaaaga

SEQ ID NO: 52714 - DNA, 166 bp, Zea mays
  Clone ID: LIB3067-018-Q1-K1-B12
aaggaatcctcttcaatttttggagctcacttttgggcttttgaagccgagcctttagattgggttcttttcttacgctgcggcacctaataaatgacttgccttctatgttttcgagaaacttacattattcttttttatataacaataatactgtctattcagt

SEQ ID NO: 52715 - DNA, 313 bp, Zea mays
  Clone ID: LIB3067-018-Q1-K1-C7
accaaaaattcaagagtgggctcaatggcattcaggtggaactgcaggctactgatgcaagtgaaatcagccttgatgagatcaaggatcgggctcgctaggcatcatgatcatgcatcatggactcggcctactactgtggatttgtatgccattatagacttggtgctgtgaaagactgcttgatgatttgcgggtttgttgctgtgtaaaaaaaggtcccatggctcccagaagaccatgaaggttcggatctatcatgtaattccttgttatctgccaattatgtatggactaaaaaaaataatataaa

SEQ ID NO: 52716 - DNA, 514 bp, Zea mays
  unsure at all n locations
  Clone ID: LIB3067-018-Q1-K1-E10
tcgtctcgtcccacgtcgtctcgtcagtatctagtaacctgctgactattagtggtcaccggggtagagtgcccttggcgtgacgctgactcagcaatgcataatatggctccagtccaatctctcgatctccatccggcatccagctcgtcccgcaactccgcaanagctagcttctccggacttagtctagggtcttcgatctacgctcgcttagatctaagtcctctactcccggcatctcgagggtcgcatgcgttgatgggcggcggcatccggcggacgctaagggcggagggccgccaagtatggatcctcactcgaggaccgatgactgagttcgaagagcttcgagaatcgaccatagaatgggatgacccaggaagaaggcatacgaagccgtccagcatgtgggaggatgatntgggatgaccgatgacgtgaatcgatgaatttctctttgcatgctcaagggaagagcttggacggaagcaatggcccagaagagctgaag

SEQ ID NO: 52717 - DNA, 385 bp, Zea mays
  Clone ID: LIB3067-018-Q1-K1-E12
tgccgtcttcggtgttctgagacctatccggtacttgagagctggaaaggatatggttgagaacactgaaattggcgattggtaccgacgcatggaagacgcagttggagaaccatcaagaatacaggatgcagaagcaaactagaattttgacaacattcttttaaatattttagaggtatccgtgcctatgcatggaggctattcaaattttttgccagaatcaagtgtatgcaataatgctctgccagattattaagcataataggctaatagcacctgaggaacagtgttttttgacttgggaacttggttgtgttactgtgtaaggttttgctcccctaaaaaaaaaaaaaaaaataaaaaaaaaagaacactaaataaa

SEQ ID NO: 52718 - DNA, 334 bp, Zea mays
  Clone ID: LIB3067-018-Q1-K1-E9
actaccgattccaagcctgaggatcgaactatcaacatcaaggctgacaggggaggctgaggcagcggcagcgtctcataattcagcttgctgtggctactgagcacttgtcaccgcgtgatagtggcgttctcgcgcatgtaattatcatcgtttcattctttgccagccactctcttcttgtgcttgttgagctatcgcacttgctgtggcctggacacatgggttctaactgctaaaccagatcagataattgctgtattgtgggaactctacccatggtaaggcatgcataatggctgtgcaaagcacctttttacactaaaaacacact

SEQ ID NO: 52719 - DNA, 85 bp, Zea mays
  Clone ID: LIB3067-018-Q1-K1-G5
aaaaaaaaaaaaaaaaaaaaaaaaaaaaaaaaaaaaaaagaaaaaaaaaaaaaaagaaataaagaaaaacaaaaacaaaaataaa

SEQ ID NO: 52720 - DNA, 109 bp, Zea mays
  Clone ID: LIB3067-018-Q1-K1-G7
aaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaa

SEQ ID NO: 52721 - DNA, 277 bp, Zea mays
  Clone ID: LIB3067-018-Q1-K1-H9
cggactcgtgggtgaagaagaactggcagaatgtgagatgcctgtacgtcaagagcaccatggggaagccatacagggtgttctaagtctgctcttttgtgaagtctgctaggttctggcaccgaagttttatcgaattaaactcttgttaagagtatgtttttggacgatcctatatttcgtcctggcgctactatgtttcagaatggtggtactactataagtattgcttgaaaggatcaatataatttgcgtgtcatacccacataataaaaat

SEQ ID NO: 52722 - DNA, 294 bp, Zea mays
  Clone ID: LIB3067-019-Q1-K1-A12
tgctatgctggttatatgtatgtgaaagaaataatagaagcgttgcatcgtctatccaaaaagaaaaaaaagaaaaaaaaaaagaaaaaaaaaaaaaaagaaaaaaaaaaaaaaggaaaaaaaaaaaaaagaaggaaaaagggatgaggataagaaaagatgagagcgtacacggagaggcgagtgcaaggagagaggagtaagatagagacgcctaaagataaggaaggggccccgaacgaaaaacgtcagggccggaataaacatggggatgccagggaaaaacggggggac

SEQ ID NO: 52723 - DNA, 377 bp, Zea mays
  Clone ID: LIB3067-019-Q1-K1-A6
gttggaacaagtatttgttaatgtcgatggtgcacacacgatagttacacgccattatgggtacattatcatccagagtaagaggagcgcattgaattactgtccgatcattctgggtatatgatcatcaagaggagcacaatgagcaactgtctggtgccgacgtcagttcctgttcttgatggcgctcttgaccatgttcccgggcatggaggacgatggcgtgacggccttccggatcttgaagaggttccacgccgtccccacggcgtggccggccgtcgcgaacgcgtcttgggttgcctctcctgcgttctcgccgtacctcctggacactgcaccagcgacgacattcgaagttgcagcgagtgacttct

SEQ ID NO: 52724 - DNA, 435 bp, Zea mays
  Clone ID: LIB3067-019-Q1-K1-B2
caaggctattccgttccgagagccaaaaactccactgctttcatcaactccggcgacttggagaatacgaagttccagaatccgatcggaagtttggtgctcgcgccttgacggattgatttcggtgcgccgatggggcaggcgttccgcaagctgttcgatgccttcttcggcaccagcgagatgagggttgtgatgcttggtctggatgccgccggtaaaaccaccatattgtacaagctgcatatcggggaggttttgtcgactgttcccacgattggtttcaacgtcgagaaagttcaatacaagaatgtgatgtttactgtgtgggatgttggtggccaagaaaagttgaggcccttgtggaagcactacttcaacaatactgatggcctgatctacgtagttgattcgttggatcgggagagaattgga

SEQ ID NO: 52725 - DNA, 349 bp, Zea mays
  Clone ID: LIB3067-019-Q1-K1-B6
gggagcttatttgttcctcccttcatcttcacgtacgccaacggcagaatttcccatttcgtttcacttcctcctccccccctcgtcttttaaccttttttggctgagatatccatcgattctcgctggaatggtcttcccctccttcggtcagaagaaaccctccctggttgtactgtactaggcaatgcgcatcctgctagatcgcctccgctgaaatggaaagcgtatgtgtgatggtgacatgaagttcacttgtgtaattattaccatttcagtaaatccatgcttcttgcaaaaaaaaaatacaaaaggaacaaagaaaaaatatactagcaaagcaacacat

SEQ ID NO: 52726 - DNA, 390 bp, Zea mays
  Clone ID: LIB3067-019-Q1-K1-C1
tagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaagcgccccctgggccccacaactttacgaaataaagcaccccgctggcatgagcacctgcaatgctggtgcttaaacttccatgggcgggtaacagttgcatcaatcaagaatttccagcttgtggctgctgccgaccccagtgagcctactaccaacgtggatga

SEQ ID NO: 52727 - DNA, 275 bp, Zea mays
  Clone ID: LIB3067-019-Q1-K1-C5
cggacgcgtgggcggtctcgtgggcaaccggtgtcactcgtatagtggtgttgggtctctgtagacaaactcgggacggttgcttatcctaaaaattcgattgtactgcgtggcatgaaatgatcgattcgaagaatattttgaacatgctgccacctaatcaaaaaatttcatgtttaacttaaaaaaaaaaaaaaacaaaacaaagacaaaaaaaaagaacaaaactgaaaaaaaaaaaattacaaaaaaaaaaacaaaagaatagataagaa

SEQ ID NO: 52728 - DNA, 302 bp, Zea mays
  Clone ID: LIB3067-019-Q1-K1-E4
gttcatcttcctcctaataggcctcaatccatcccttgccaccccaccagtcttgctcctgtgcaatccttatcacggtgctgttcgcgctcccctcgttcctgatactgtatttcgcgtatccgagcctggactggcttgttagggaaatctttgcctgagatttccttgttcggtaaaatctcaatgctgttgttgagtccttgtataactgaaccttccctagatcttgttgcaagcgtggatgctattgcaaagttttggtttttacaccatgagatgtgtttaaaaaaaaaaaataa

SEQ ID NO: 52729 - DNA, 144 bp, Zea mays
  Clone ID: LIB3067-019-Q1-K1-F10
accctccctgtcacgaaccattaagcgctgcacgtgcggtgcttacgcgcaaagctgaccatgcacttgccagatcacgtacgcccgctcctttcgatttcttcccatccattgtcacactttcgccggtgtttcccgtcaagc

SEQ ID NO: 52730 - DNA, 444 bp, Zea mays
  unsure at all n locations
  Clone ID: LIB3067-019-Q1-K1-F11
caagaatccgaagaaaattcattttcgagatgaacgaacagtccagaacccactgctcgaaaccgcagccactggccagtctatgcccatgactgcggtgcccaggaccggccccggttgcctggggtcgccgccggctcatgctctgtcgagctcactagccggggttcaaggcgccccgaatcgactgggcgtatcgaagccgtcgtggatcgttcgcactgagtcaaacgtgaggatggagagagcaaaacgacctgatcctacttgcaccatctgcataggcacagggagaatagactgccgcaactgttttggtcgacgtagaacaaaccatgccgatgtggccatgctttcgaacggcgaatggccacaatggtgtncaatttgtggtggtagtggactggattactgcctncggtgccatggaactggtgagtatcg

SEQ ID NO: 52731 - DNA, 286 bp, Zea mays
  Clone ID: LIB3067-019-Q1-K1-F2
ccgacctcctctcaaaggagcagcggcggcttttttttaccctcctgtggattcgttctcgtgctgcgttccgctagcccatgtctactctgtactatctcataaaaaaaaatagatccagctgagacgttgttccctccctctttccctgtaccgtgtttcatggtgacttgtgacaatggatggtttctccttgtgcgtcgcccaaaaaaaaagaaaaacaaagatgcaatgatacacaaggaaagcctaagagaagcgagcgaaggtggaagcaaaacgcgaa

SEQ ID NO: 52732 - DNA, 352 bp, Zea mays
  Clone ID: LIB3067-019-Q1-K1-G10
gatgacttcaaggagagactatccaagcttctgagtttacaagaagcctggactctaataattgatgatggattggcggcttcatttgtggccccggctactgattcgttagaagatgacagccaactaaccattgaagagtatcagaggagttgggagcagaacgaggaacttggtctgaatgacatggatacgtgctctgcagactcggcttacaacacgaccaacacataattattttagttttgatgtgccgaatgtatttgttacgctatcagtttactttgatgaactttcagtgtgtatactaatatcaacaacttatatttcctctgacgataaacaaaagatg

SEQ ID NO: 52733 - DNA, 315 bp, Zea mays
  Clone ID: LIB3067-019-Q1-K1-G6
cccactcgtccgcccactcgtccgcccactcgtccgagccacctgtggtcagcaactgctgccgtgttgctagaataaagttggtggcgatcgatcgatcgatctttggtgatgggtgtccctccctgtgtgtttgtgtttagttccagtcgtttgtgaggaagtcagttatgtttgagtgagaggggtacttcgctcttcggttaactctgtacttgtcatgaggagagttttcatacccggagtgtaggaactctgtactgtactcggatccttcctttttcataaaaaaaaaatataagaaaaataaaatta

SEQ ID NO: 52734 - DNA, 409 bp, Zea mays
  Clone ID: LIB3067-019-Q1-K1-H10
tccacgcgtccgaccactcgtccgcccactcgttcgttgggcccaagcggtaaaggtaagccgactgcgtcggcggcggcggcgatcatggccgctcacagggagaactactcggccgtggctgtcgccccagcacacggcgctgcggtttcggggtctccttctccttcttgcttatccggatgcccgaacttgtccgcgttctcctcgggagacctgtggtgcgccgctatcgtgtaaccttgtggagctcagcgccaacgtggactcgctgcagaagctgctcgggcggaaagccgtcttcgtagacgatgacatgttcttcaaggactacctggtcgtcgaccaggcccggaccattaacgttcttgaccagagggtgcagtctctggaacgtgaactcgatgct

SEQ ID NO: 52735 - DNA, 138 bp, Zea mays
  Clone ID: LIB3067-019-Q1-K1-H4
ctttcttttgtaatcactctgatgatatatatcgtaatctggttataacttgtaaatgttgtaacttgtaaccattttgtaataaagaatttacgctgcaaaaaaaaaactaaccaaaagcaactaacaaaaaactat

SEQ ID NO: 52736 - DNA, 251 bp, Zea mays
  Clone ID: LIB3067-019-Q1-K1-H6
ccacgcgttcgcccacgcgtccgcccacgcgtccgcccacgcgtccgcccacgcgtccgcttgtaatacagtgaagcagccaacaaagaagatacaaaagagaccagagtagcggcaacattaagtattcatcgttggctgcttcactgtattacaagaaattgctagacttggattatttcagttgttttgaatcatgtactggttgcaccaaaaaaaaaagaagagaataagaccgagggaacacaaat

SEQ ID NO: 52737 - DNA, 311 bp, Zea mays
  Clone ID: LIB3067-020-Q1-K1-H9
tttttctttttttttttttggtttttggcttttttttttttttgtttttgatttttttatccctaattcgatatgctcccggtatctttttgaagtttttaaataacttgaaaaccttgggccccacatgctacgataggttgttcccattcactgatcaggggacctgccttacaaagatttgcctgtttctggttaacaaagccatccccaaagcttatcagggattacaaacttgccctttgtagtcgcaccatatcgctcaatgctcaacttttactttgacatttccatttggcaaaattccctgg

SEQ ID NO: 52738 - DNA, 366 bp, Zea mays
  Clone ID: LIB3067-021-Q1-K1-C12
tgaacatgtaccggaacatggacatgctctatgaacgtcctgaccaaggccgcgcccggggacagccccaacaccggtggcatccacattggcgtctaattcggcatcacaatcaccaacaccatcattggcatcggtgacgactgcatctacatctgcctctgcacctgcaaggtgaacatcaccgtcatgacctgcggccttagctacggcattagcatcggcatcctaatgcggtacatggaccagaacgacgtcacggacatcaacgtcaacgattgcactcttgataagactatgttcaacatgatgtgtcacgctgctcaactccttgatcaactacgccattagcctggtctgtactgt

SEQ ID NO: 52739 - DNA, 84 bp, Zea mays
  Clone ID: LIB3067-022-Q1-K1-A10
aaaaaaaaaaaaaaaaaaaaaaaaaaaaaaaaaaaaaaaaaaaaaaaaaaaaaaaacataagtgggcggacaaaaaaaatagat

SEQ ID NO: 52740 - DNA, 406 bp, Zea mays
  Clone ID: LIB3067-022-Q1-K1-A12
tgaggattaaatgaactgtataaggccgtaatttgttcctggtttagtttcagggtagaaatggacattgctgtaatcagctacacattacatgcgaccggacctgaattattatataagaaacctgaagtgtagtcgatatacatgttttcgtcggtgaaacccacttactttttgtaggccattgaggtgcaataatttgatacccatgtatgttaatctgctaacccacatggaatgcaatttcacaagttaaatttgtcgcttgtcatattttgtaggcttcaatgttaaacattgtcacaggttctcatatatgggtggaagataaagatttgtccagggttgatggtgaggtatttcgaattgatggccaaaacgcccatgttcgcacaaccaaggggaa

SEQ ID NO: 52741 - DNA, 174 bp, Zea mays
  Clone ID: LIB3067-022-Q1-K1-B3
aactcatgctagaagtcgacacttttatgatagagcagatggtccgattcacaataagatcacatgatggaatggtcgtgaacattctcttaacatgataagaaatgcacataaaatacaggctcatgtaataggccatcaagtgagaaagaaatacagaacaattgctagcac

SEQ ID NO: 52742 - DNA, 317 bp, Zea mays
  Clone ID: LIB3067-022-Q1-K1-C12
gcgccaacatctcggtacaattattcgttcccccatcagtaccaccactagaacaaggcgatggagcagatagagcgaggcatgctatgccatggcccatggcacgcgcggctgactgtctgactgactcgaacaaaacacaaaaaacgacactgctacaatattatatactagagcttattaattagctagagataaagagtccttccgaggaccccatcacgccctgcagcgtcatcgccgccgtcgtctcacttgcaggtgcaggggtcgcaggtgcagttggcgccgcacttgcacccgccgttctcagctcc

SEQ ID NO: 52743 - DNA, 55 bp, Zea mays
  Clone ID: LIB3067-022-Q1-K1-C7
aaaaaaaaaaaaaaaaaaaaaaaaaaaaaaaaaaaaaaaaaaaaaaaaaagaaaa

SEQ ID NO: 52744 - DNA, 243 bp, Zea mays
  Clone ID: LIB3067-022-Q1-K1-C8
ttgtttttttgttttttttttttttttttttttttttttttttttttttttttttttttttttttttttttttttttttttttttttttttttttttttttttttttttttttttttttttttttttttttttggttattttttttttaaaattttttattattttgttgttatttatatatttagggagatttttaaaaaattaaaattttatgtttattgatttataatattaaatttttt

SEQ ID NO: 52745 - DNA, 210 bp, Zea mays
  Clone ID: LIB3067-022-Q1-K1-G10
ttttgtgcaaactttctaattacactgacttatttgtatgtggatgcccttaggatattatcgtcatttgttgtaaaaaggacagaataggttttatgttcaggtgtggttaactttcaggtaaaaaaaaataaaaaaaaaaaaaaaaaaaaaaaaaggacagaagatataaaacttataaaatatactaaaaaatgcaatactgataat

SEQ ID NO: 52746 - DNA, 389 bp, Zea mays
  Clone ID: LIB3067-022-Q1-K1-H10
catacaataaggaaccacactttcatccggtacatatagcttgtctcggcaaaacttaattttaaacagaagtgacacggaacgaactgtcttagcactgcccttatcataagatacaaacctagctaggaccagatcaaactgccatttcgaggacgctgttgggaccttagacctcagctgccaagacaggagggcgcagctcgtcctcctccttcggggtatggatggtcaccaggtccggaagaggggtgatcgggccaaccttgcccttcgggtcccagtcaagcatgatcttcaccttgatacccagaacaccctgtctgaggaggacgtgtctcacagctgagtcgatgtactcattcactggctgaccagatgagatcatg

SEQ ID NO: 52747 - DNA, 379 bp, Zea mays
  Clone ID: LIB3067-022-Q1-K1-H11
tccatttcttgagggggggccattgcaggcccttgggtgtcttatgagggagggctcggtttatttcagttggctttgcagaatactgataactagaaaaagtagtaggacctcaccttcgtgtattatgatgatgcacatacaattttctgagtagaatggatgttgaatcatagaactaatgaataatatgaacactcgccttcgccccaaaaaaatatgaaaacgggaccctgattgagaacatgataaaagaaggaaaagatgtcgctcggcaagtgactatgaagctagttcacgaagccatgattgcaaagtaaaaatgacttatttctggatcgccggaattacattgaatgaacgggaatttaaataattg

SEQ ID NO: 52748 - DNA, 388 bp, Zea mays
  Clone ID: LIB3067-022-Q1-K1-H2
gacggaaacctgaagaacattatcttgtagcttctattctcgatggaatggatagacgggctatggcgacatcatggagtgccaagcctgctgaccagactgatatgagaacgtactcttatatgcctcgtaacgccaaatacattggggaggtctctgcacactatcagattgatcatggaatgctaaatgtattgcaagagaacgctaaactactcaatcaaatacaagtaaatattttaacatcacaggagtaattttcaattcgtctagataatacttttcaggcccataacaatattgaactttttcatcacgcaagaaggaacatcaatggtcttttacaaagcatgagccaaatttcctgaataatgagcaagatgtcccc

SEQ ID NO: 52749 - DNA, 51 bp, Zea mays
  Clone ID: LIB3067-023-Q1-K1-B10
aaaaaaaaaaaaaaaaaaaaaaaaaaaaaaaaaaaaaaaaaaaaaaaaaaa

SEQ ID NO: 52750 - DNA, 390 bp, Zea mays
  Clone ID: LIB3067-023-Q1-K1-B11
aagcaatgctcctatgttggattgtgaaatgaccgcgccttgagactggaacctgtggttgcaactgtgcatttcccctgggatgtttgacgatctgaggcatgcgagcctgttgttgaagatgcaaggttacgtacttgtacgacaatgtgacctgtgtagctgagtagtctatgtcgcagtgacatgtaacggcaccccccttactactaactgacgcttactcgagattgccatagttgatcttgtaatttgttatagagcagtatgaatgtatttatggtagcttgaatctatgtatggattcacttcgattttccatgttcccttgactgcagacccagattgctaccgtattgtttcagaattcctagctacctgttgcctaaa

SEQ ID NO: 52751 - DNA, 175 bp, Zea mays
  Clone ID: LIB3067-023-Q1-K1-D9
tcgtacggctactcaatttgtgcacatgcttgtacaggatgtgaacacctgaaccatcgacgctctgggacagctaatgagttgttcacgctacgacgggctgattgggcaagacacagtgacctgcatgaatatggtaatacgtctacgaatgtatgcagccacttgcacaatg

SEQ ID NO: 52752 - DNA, 254 bp, Zea mays
  Clone ID: LIB3067-023-Q1-K1-E7
tcttgtttctaatgccaaaggacccaaatccgtttgggtacctaaagttaagaactaagtttcttttgtaggttcatgcatccattgtctcaagtaggattctcgttttcactatcactttctacattactgaatagactggggtatcattcttttactccttttatttttgcttttatgctgcggtaaatttgatggtattctaataattttagtatatgtaagtatggtttgcagttgtatatattattagt

SEQ ID NO: 52753 - DNA, 404 bp, Zea mays
  Clone ID: LIB3067-023-Q1-K1-F3
tgctccccgagatcgagcccgaccacatcgtctccctgttcgagggcaactcgaacctgttctgggccgagcggctcgggcgcgaccacctcggcgggatgaacgacctgtgggtgaagcactgcggcatctcccacacggggtcgttcaaggacctcggcatgaccgtgctggtgagccaggtgaaccggctccgccgcgcgccgctgtcgcgccccatcgccggcgtcgggtgcgcgtccacgggggacacctcggccgcgctctccgcctactgcgccgccgcggggatcccggccatcgtcttcctccccgccaaccgcatctcgctggagcagctcatccagcccatcgccaacggcgccaccgtgctctcgctcgacaccgacttcgacgggtgcatg

SEQ ID NO: 52754 - DNA, 340 bp, Zea mays
  Clone ID: LIB3067-023-Q1-K1-F4
tccacgcgtacgcacactcttgaccacacgcgttcgtctaccagagacccatcgaaccaggggtgtcaatgcgttcgtgcgacacattaagaacgtcataatccatgccacacctgtcatcttcaacaccctgtaccaaccctaccgagagggagcttactatctacatatataccactataaactcaacatgggtacccacactgctgtctaccactagcctttcactgaacatccctgactattatacacccacacaacttatgaaacctaaagctaagaacgaaacgtaccttgatgctgtaatcacaattcccaatggaaccttgtttaccatgtg

SEQ ID NO: 52755 - DNA, 357 bp, Zea mays
  Clone ID: LIB3067-023-Q1-K1-G12
cccacgcgtccgcaccttcaagcctttcctcgcggttccccagcagtacaaacagtgaaagcggtgctgcgtgcgtgcgtgctctgcatggatactatagagaggtagctagctgctagccagtgtgtgtgcgcgagagcgagacgagggagatggacatgtcaagtagaagcagaggatatgatgtcattatacatatttacttcgcgagatatgtagttcctcatgagtcttcgctgtgcggttttctaaaaaaaaaaaaaaaaaaaaagataaataaaaaaaaaattacaaaaataaaaataaaaaggaccatgaaataaaaataaatataactaaaaaaaaaaaataataaaa

SEQ ID NO: 52756 - DNA, 324 bp, Zea mays
  Clone ID: LIB3067-023-Q1-K1-H8
aggccatcgagatactccgtggttggcatgtcccaaacgctgaacctgtcgctgccacctacgattcttgagaaatcgctatcatgtgtcagctcatcattcatgggcgactatgctattcacggttctcaacagcttgccaggctctctatcgaaatggtctgtgcatacctttgctgctatgcgttcgctctgtactagcagctggactactggctagaatggtcagttcttctgccctgtttctgttgctattcgcctcaacgttgtaaaactgaattcagaacagtttaaatatagctgtcatctggtctaacatctggt

SEQ ID NO: 52757 - DNA, 123 bp, Zea mays
  Clone ID: LIB3067-025-Q1-K1-A1
cccacgcgtccgtgatcttgtaatttgctatagggcagtatggcaatatctatggtatactcggatctaagataaaagcgagctgaccaaagcattaaagcagagatggacctataactgaat

SEQ ID NO: 52758 - DNA, 286 bp, Zea mays
  Clone ID: LIB3067-025-Q1-K1-A2
ggccagaagagctgaagtattatttctctactttatataaatgatttttatatggcagctacttttggaaccgttgatgtgctttggatgtgaaagtttttggacatcagtcggcaatttgacagcactgtacgtgttagttgtcgttaggatatgtctctagccgaaacgctagatccgccacaatgtctacgccccaactgtttttcttaaaaaagtgccgcaactgtttttctaaaaaaaaaaagagaaataaagaagtagatgcagaacaccaattttttaa

SEQ ID NO: 52759 - DNA, 122 bp, Zea mays
  Clone ID: LIB3067-025-Q1-K1-A8
aaaaaaaaaaaaaaaaaaaaaaaaaaaaaaaaaaaaggacgaacgaatctgaaggatcgaaactgacaaacgcgtgcatgcgaacggcataccgtcttctatagtgccacctaaattcaatt

SEQ ID NO: 52760 - DNA, 64 bp, Zea mays
  Clone ID: LIB3067-025-Q1-K1-B7
cggacgcgtgggtcttgtttaacaaacaaaagacagaaacacataaacaaataaaggaaaatgg

SEQ ID NO: 52761 - DNA, 196 bp, Zea mays
  unsure at all n locations
  Clone ID: LIB3067-025-Q1-K1-B8
tcgtctcgtcccacgtcgtctcgctttcaactggttctcttcgctcgctctgttcttagnnttctcgttttggggccttgaggggtgcactgnntggcggtgtgaaggggcttccctgggtctggtggctnggttggttgggttcaaatgtcgnnatggcgcnnaggtgtnnngctgcgatctttcggctcgtagc

SEQ ID NO: 52762 - DNA, 305 bp, Zea mays
  Clone ID: LIB3067-025-Q1-K1-D12
tggacatatctacatatttacatggtgcttgcaaatataacaaaggagaagataggaaccgggagcataacatgacatatcacattccatgaaagggctcactggattaagttgattcaagtctgactgtacagctgtgcagactaactaacaacagggactgcgctggtcatcgctatacgactaaggaccgtgggaactccttataatccactgatccaacacatgcttgctgagtaagatcttactgaattttaccgtgtgctgtaaacgactggaactatactgtttttctattctgatga

SEQ ID NO: 52763 - DNA, 412 bp, Zea mays
  Clone ID: LIB3067-025-Q1-K1-D8
caaacaaaacagatacttgtcatttcgaacaaattcagacgtgtacattttttacactacgatccaccacttagaaatgtaataccatacattccataactcgagtgcatagtcaaccatgtaagacttgttcgattagctctcaatccatatggattgagtgggattagatgtgttgaattcctaagcaagtcaaagttcttctaaattttttttaattccatcaatccatgtattataggaataaccgaacaagacctaaaagtacaggactctttatgagtattatgctagagaaataagcctgaatgttcagaccagccccttttttaaaaaggaacttggatcttcaaaacaaaatcgttatatggccttctgctagagaaatcatgcctgcaccaatgcactcatg

SEQ ID NO: 52764 - DNA, 448 bp, Zea mays
  Clone ID: LIB3067-025-Q1-K1-F12
tgccaagatctctcaactggaactttcattcaaggagattattttcggctacaggaaacaacctcagtgcaagccacaagttttccgaagcgtctatgttcattggcccccaagaagccgtaacgggaaaacaggagaagaccacgttgacatcatcactttctacaacgaagtattcattcctgccgtcaagtccttgttggtggaggtagggcctggcgccagtccaaagaagaaagaagaggaaaaaggtcctgctgatgtaggtccattcccagaatctccccggctggctcggttcccgaacctccccgacatgtctccaaagaaggtttctgctacccataacgtgtacgtctcaccgctacggtcatcgaagatggacactctgctgtccccgagctccaagagctactacgcgtgcgtcggcgagagcacctacgcgttc

SEQ ID NO: 52765 - DNA, 368 bp, Zea mays
  unsure at all n locations
  Clone ID: LIB3067-025-Q1-K1-F4
tatgaagcagaggagtattggcatgatgctagaaaagacccagcaactcattcaattgatggtggaatatcattaaatgacattgcagaatttgatggtggggcaacaactgaagaaaggagcagcctagagaagcaccgatctgatgagggtgtgaagattgctgtctcccagaattttggtagtatgaatgaaaaagtggcaattgcacctacctcaagttttgagaatcaagaaggattgcagcagcctcgtgaagttcttccaaatgctaaactaagcaaaaataatgaccaagagaacagtgatgtgcatgatatacaagtggttgctacatnctgtgattcaaaaggacacaagtttggatc

SEQ ID NO: 52766 - DNA, 255 bp, Zea mays
  Clone ID: LIB3067-025-Q1-K1-G11
atccggagttcgatatgctccggatatctttttgaagttattagttaagttgaatacattgggccacacatgctacgataggatgtacccattcactgatcaggggacgtgcaataaaaagatttgcctgtttctgggtaacaaagccattcccaaaactaagccgagataacaaacttgccctctgtagtcgtaccattcgctcaatgctcagctttcactttgacatctgcattaggcaaagtaccctgggac

SEQ ID NO: 52767 - DNA, 422 bp, Zea mays
  Clone ID: LIB3067-025-Q1-K1-H2
gacccacgcgtccgtggacattatcctgaaaatgaagcaagatgttgcaaagaggaaaaaactgaattatggaggccccaagtcggtcaacaacaaaaaggtttctgggaagggccattttcgtgggaataggcgctagtgttacctgattcagcttgatgtgaatttgaaggttgctactggtgcttttggacgtttcataggcaattgagagttgagatctcttcagacatcatgttcacgcggttcagagtatttgaagtggaacttaaactggaaagtgtaagataatttccagcagagggctcctgtcatacttgcttgtttccctaacgatgatggtggatgtgcctgggtgccgactactgtttgaacgaactgatcgtgccttgctcattttctaccggcatcggatgtttttg

SEQ ID NO: 52768 - DNA, 55 bp, Zea mays
  Clone ID: LIB3067-026-Q1-K1-C4
aattctccgtgtcgactccactcgtacgcccacgcgttcgcccactcgttcgaat

SEQ ID NO: 52769 - DNA, 244 bp, Zea mays
  Clone ID: LIB3067-026-Q1-K1-C6
ctttattgttacgtgacgtgtactggtatgttgtggtatggtttagcctgggttatcttgtaaaaggatctgaagtggttaaataatcgtgggtaatttcgtttttaaaaaaaaaaaaaaaaaaaaaaaaaaaaaaaaaaaaaaaaaaaaaaaaaaaaaaatataaaaaaacaaaaaataaagtacgcaagcatgcaaagtaataacttttctatagcgtcacttaaattcaattcactttcca

SEQ ID NO: 52770 - DNA, 98 bp, Zea mays
  Clone ID: LIB3067-026-Q1-K1-D10
cccacgcgtccgcccacgcgtccggagcagtagtatgaacctgttgtctgttcctgttgaaagatttcccattttaagtgcaaacctgagtttctccg

SEQ ID NO: 52771 - DNA, 365 bp, Zea mays
  unsure at all n locations
  Clone ID: LIB3067-026-Q1-K1-D12
tccacgcgtccgaccagctgctgcggccggagatgtcgtcgcagctgatcgaggagcaccggtcgggcgcggaggtgcacgtcgggcacgagctgtgcgagcgcaagtcgcgcgagttcatggtggagctgggccttcccgacgggctcctaccgctgcccagcctggacgaggtgggctacaaccggtcgacggggttcgtgtggctgcggcaggccgacggcctgacccacaccttcggctccatcggcaagcaggtgtggtacgacagggaggtgacggcgttcgtggagcccgggcggatgcacggnctcgccggggtgaagagcaaggagctcctcatctgggtcaccatctncgagatc

SEQ ID NO: 52772 - DNA, 64 bp, Zea mays
  Clone ID: LIB3067-026-Q1-K1-D8
aaaaaaaaaaaaaaaaaaaaaaaaaaaaaaaaaaaaaaaaaaaaaaaaaaaaaaaaaaaaaaag

SEQ ID NO: 52773 - DNA, 442 bp, Zea mays
  Clone ID: LIB3067-026-Q1-K1-E8
tccacgcgtccgcccacgcgtccgcccacgcgttcgcccacgcgtccgtccacgcgtgcgagcggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagc

SEQ ID NO: 52774 - DNA, 378 bp, Zea mays
  Clone ID: LIB3067-026-Q1-K1-F4
tctttttacagtgtataacttatattattcaaagtagttatgattacaaagaaaagatccagctacgttcaagcctgctaaagtttacacatgaaactgtaaaatggcagctgaatgagttggaacaaaatgacagcccaaatccccaagcacatttattgcattggctcagtgtcggatgtagtagcaaaaccatctgcgtaaatggggtgaagatcatgaccagcaactggatcaacatgaacccatttcctgcctgagagtttgttgcgctcaaagcgtacattgccttctttcaggcagaaaagtgtatgatccttgcccatgccaacatagtttccaggatggaagcggggtcccttttggcggacaatgatg

SEQ ID NO: 52775 - DNA, 133 bp, Zea mays
  Clone ID: LIB3067-026-Q1-K1-G10
ttcttttactcttttttctttctaatataggtacgtttatcttttattgtttgatttttcatttactttccaaacttcattattctagaaaaaactcaaagatatttaatttaaaaatattaattctttgatc

SEQ ID NO: 52776 - DNA, 291 bp, Zea mays
  Clone ID: LIB3067-027-Q1-K1-B12
tggttgttttttttttttttttttttttttttttttttttttttttttttttttttttttttttttttttttttttttttttttttttttttaaaatcctttatatcatttttttatattaaaattttaaataaatttttcctttttttgcaaaaaattaacatttattaataatccatatatttttttataaaattgtttataactttaattttttctttttaaaaaaaaaaaatcttttcttttttttataaaattaaaaaaattttttattttttaattaaataattt

SEQ ID NO: 52777 - DNA, 400 bp, Zea mays
  Clone ID: LIB3067-027-Q1-K1-B7
tctcctagccccagctagatcattggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctggatccgacggtggtgcgtgtgggtaccagggtgccgtcgaccagcctgcgttctcgtcaatgatcaccgccggcagccaatccatcttccaagacggcaagggctgccgcacctgctaccaggtgaagtgcaccggacacgcgtcgtgctccggcagtccggtgacagtggtcatca

SEQ ID NO: 52778 - DNA, 334 bp, Zea mays
  unsure at all n locations
  Clone ID: LIB3067-027-Q1-K1-B8
tccaaacttcgcgacgcgcacaccagctcgccgtcggacgcaagcgctcacaggctgctgctgctccgtctcccgggcgccagctctgactccggacgcgttacttgaaggcatccatggcgcgcgtgctctgctcccggtcagcggtcctggcgcgccgtctcggggcccagccccagcccggcgtggttctgagccgtcggcacaaccacactcgccggcgcgcggtgaaggttcttgaagaggacgccgcggggccttctgcacctgcgacggacgcctncgagcagtcccggcggttggaggaggcgatcgacagcgccatggcgcggat

SEQ ID NO: 52779 - DNA, 422 bp, Zea mays
  Clone ID: LIB3067-027-Q1-K1-C6
tccacgcgttcgcaccagccgtcgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgtcagcgcaagccgtggcgtcgcaaggacggtgtctacatgtacttcgaagataatgctggagtgattgtgaatcccaagggtgagatgaaagggtctgcaatcacaggacctatcggccgggaatgcgctgacctttggcctaggatc

SEQ ID NO: 52780 - DNA, 399 bp, Zea mays
  Clone ID: LIB3067-027-Q1-K1-D3
taacaaagccacgttagccgagagctcctctgctcctctcgtgtctggccgaacaggcagagcgaccagtctccagagcgctccccatggcgtcaggagatgcggcggcccctgtcgttcagactgtggtgctgaaggttgtcatccactgccatggctgcaagaagaaggtccggaaggtgctcaggggcatccaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgtcggctccgcagcctgccggcgacggcggcaaggatg

SEQ ID NO: 52781 - DNA, 72 bp, Zea mays
  Clone ID: LIB3067-027-Q1-K1-D8
tcgcggacgcgtgggcggacgcgtgggcggacgcgtgggcggacgcgtgggaaaaaaaaaaagggaagaata

SEQ ID NO: 52782 - DNA, 457 bp, Zea mays
  Clone ID: LIB3067-027-Q1-K1-D9
tagaaatgagcttagtggtgctcttacaggtttgacacgtgttagaagattccagcaggatgatgctcatatcttctgcagagaagaccaaatcaaggatgaagttaaggctgttttggaattcatcaattatgtttatgagatatttggcttcaaatatgagttggagttgtctacgagaccagagaagtatctaggtgaagttgaaacttggaacaaagctgagcaacaattgacagaagctttaaatgagtttgggaagccatggaagattaatgaaggggatggtgctttctacggcccaaaaattgatattggtgtgtttgatgcccttaagaggaaatttcagtgtgcaaccctacagctggattttcagctgcccaatcggttcaagctggcttattctgctgaggatgaagcccaaaattgaaaggcctgtgatgatacacaaggcaat

SEQ ID NO: 52783 - DNA, 181 bp, Zea mays
  Clone ID: LIB3067-027-Q1-K1-E2
tgcacgcgtgcgcccacgcgtgcgactcgcggtttaggcaatcagcacgtgcgtatacacaacggcagttaactagctagctagctagcagtcgtagaatgacgatgaggggtctctctgttgcggtcgctctggtcgtggtggtggccgcggcctgccttgccgcgccgcggggcgcgga

SEQ ID NO: 52784 - DNA, 343 bp, Zea mays
  Clone ID: LIB3067-027-Q1-K1-E7
tccacgcgttcgtctgtttctatgcctgaactggtaataggcttatagctgcctgaggattgcagttgaatgatactattacatcacactgtaaattgtgagccaagaatgtatcgtcttgcatttggtaagaccgtaagagaaaggttattgtgactcgttacttgtaaatacgtgcactgactgttcaaagaaactaagaaagacaaggtggaggtgctaccttcccactacccaaaaaaaaaaaaaaaaaaaaaaaaataaaaaaaaaaaataaaaaaaaataataaaccaatttaaaaataaaaaaaaaaacaaaatatataaagtttactctaattat

SEQ ID NO: 52785 - DNA, 322 bp, Zea mays
  Clone ID: LIB3067-027-Q1-K1-F5
tccacgcgtccgcaagttctgaagaggaggctaagttggcgagcgaagcggaggtccgtcgccgggaggcttgggccggagcatgttcctgacattacaaattagcccctagtcaccggaaggcttggaccggaacatggcaaagcatgtttctattgttaagtttgagatatgctcaagcttagttggtattataaattagcccctagtggttgttgccgccggcaagatgatgatgtattgtttgaggtggagtttgctattatgatgctacaaagaatttgtctcaaggttgagtttgtgatcatgttccctattagtt

SEQ ID NO: 52786 - DNA, 352 bp, Zea mays
  Clone ID: LIB3067-027-Q1-K1-G1
taaagatcgtcaaggagaacttcgacttcaggccagggatggtcaccatcaacctcgagctgaagaagggcggcaacaggttcatcaagaccgccgcatacggccactttggccgtgacgacgccgacttcacctgggaggtggtcaagcccctaaagaaggcatccgcttaagaatgtattgggaagttcactggacatgaggttcatcttcgtctggctctgctgatacctgcaaggattgctgctgctgctgcctgccctggatgtgtgtttgatcagtgactggctgctctgctccatagaagatgaatgaagagagagatggtgaagaaggctttggcaaatggcaa

SEQ ID NO: 52787 - DNA, 297 bp, Zea mays
  Clone ID: LIB3067-027-Q1-K1-H3
caagaaaatgtagaggtcgagattgctcctgaaaagaacagggacaccatgaaaacaggtggctttgttttggagtcaagctcagggtgatgccactgttaaagctactgggggtgaagacacagatgttatcgctcgagatatggcagggtgctacgtttcactagcattatcgtttgtaatttgattcacgctcttttgtacataagaattcatgatgttataaggtaaaaaaaaacaatgtgactaactaaaggattaaccaacatatataaaaaggcaaacaataaaggaaaa

SEQ ID NO: 52788 - DNA, 294 bp, Zea mays
  Clone ID: LIB3067-027-Q1-K1-H4
tccacgcgtccgcccacgcgttcgaaaaaaaaaaaaaactgcattatactttctacgggcgacatgatcatggattctgtgttagcatccgattatttgtactcttgattctttggttccatgctctctacggccatctccatgtcaatttgctttgccaacaatataatatcagcgtgccgtgccctcgtggatttccaaatggttatatgcatatgtactattgaaattgtcatatcagtttgcatacaataccaacgcgcctttgtagatttcacaatggatatatctgtt

SEQ ID NO: 52789 - DNA, 385 bp, Zea mays
  unsure at all n locations
  Clone ID: LIB3067-027-Q1-K1-H5
gcatactgaagttccagcacaaacttaattaatagggttcattacaaccaacacacttgggtaacacgcaaaacatctcatctgaaagaggccatcaccatgagaccccacaaatgcttaattggcgggtgataaaaggcggcctacctccgttaatctgcaagccagccttaccaccacttccaattccaaaacaaccaagcaaaacgctaccacaccaaccaggctaacaccagcacgacaaaacccgcgctaatactaggcccaaactactggtaattccccagatccaaagcgagatgcaccattcataaaaccatggcgcctntcggcaagctccgagtgagggtggacgactctaccacgaccaacggaaaactactac

SEQ ID NO: 52790 - DNA, 244 bp, Zea mays
  Clone ID: LIB3067-028-Q1-K1-E10
agttcaaacgaggagctgcaggtaattcatagatccacataaacaaaagacagtcgcacatctgtggatgattcaagttacagaattctaaggcaaaattggtttacaagaaccacattattacagtacagcccttgtttgtaattcctaagattcttttgtttcttcaggtgcagctcgcctcgctgtcataaaggcaaagcatatcttctcttctgctcagctcctagccatggtcagatgc

SEQ ID NO: 52791 - DNA, 287 bp, Zea mays
  Clone ID: LIB3067-028-Q1-K1-E12
ttttgagatgctgtagactagtagtgcctgctctgagttagtaattgaaagtgttgaccgtgaagtgatgctgtttagttggtagtgtgttcgcttcttcggcacttatacttacccccaagcatcaacgctgcctgttttaaatctcaataggtgctgttttaaatctcagatctcaatatatgactactgatcgctgaatagatttcatgctctcttgattgactgcataaaaaaaagactgcaccttgcctacagggaggaaggactgcgcaaggagaacgcca

SEQ ID NO: 52792 - DNA, 356 bp, Zea mays
  Clone ID: LIB3067-028-Q1-K1-F12
tttacgcgtgaaaaaaatggcatttaaatgctgcagaactgcaggccgggacaacctaggtgtgcatttggcgtcgggctgagtacttatgacaaggcctcggtgaatcactatgtgcattcacacatacagatgaatgaatatcgagattgggtagacctgtcggctgcatcaatgaagtttgctagacagattaatacctgcttgaacgttatggatatgactggactcaagctgtatgcactgagccaaataaagatgctgacgatgattactactgacgatgacctgtattatcctgagaaaacggaaactgattacattgctaatgctccatatgtattttcagcgtgttg

SEQ ID NO: 52793 - DNA, 221 bp, Zea mays
  Clone ID: LIB3067-028-Q1-K1-F6
ttgagatttaaattttaagtggcgccattgcccttcctttcttcctcccctcctaagtgtgtaactttgttgcggccattgttgtcgtgactctggccatagatccttttatgtacatgcgaaatgtaaccaagggatatggaataagaacatgttcatcctgttgtagacagcatggtggtacaggaattctttttatttttcatagttgattggtgatg

SEQ ID NO: 52794 - DNA, 129 bp, Zea mays
  Clone ID: LIB3067-028-Q1-K1-H2
cagacgcgtgggcggactcatgggttaccgttgcgttggcgacaatgttgggaacagatttaaattggagtttatgcttgccatctactcaaaaaaaaaagaagcaaataaaaaaaaaaaaaaaaacaa

SEQ ID NO: 52795 - DNA, 175 bp, Zea mays
  Clone ID: LIB3067-029-Q1-K1-A10
gccttttataaaaaaaaaaaaaaaaaaaaaaaaaaaaaaaaaaaaaaaaaaaaaatagggagaaaaaataaaataataagggccgcccgttctaaagcttccaactttaccgtctcttgcctgctaaatcatatctcttctatagcgtctccttacttcaattcactgaccaccc

SEQ ID NO: 52796 - DNA, 402 bp, Zea mays
  Clone ID: LIB3067-029-Q1-K1-C5
tcccactcgtcctcccactcgttcgaaaaaaaaaaaaaaaaaaaaaaaaaaaaaaaaaaaggggaaaaaaaaaaaaaaaaaaaaaaaaataaaaaaaacataaaaaaacttaaaataatggcgtccgttcttgagtatccatttttccttgcccgtgcttgcaacgttttacttcttttatagtgtcacctaatttcattttcttgtcctttgttttacatcttcattcctggtaaacccttgttgttccccatcttaatccctttgcagcacttcccctttttcccatttggcttattacctaagaggcccgctctattcgccttttcaaacatttgcccaccctgattgcccattggaactccccttttatcgccgctttaatcgcgcttgctttggtgg

SEQ ID NO: 52797 - DNA, 53 bp, Zea mays
  Clone ID: LIB3067-029-Q1-K1-D2
actacgcatgccatcttgtatatgaacaatgtggctcagaatgtagccataat

SEQ ID NO: 52798 - DNA, 461 bp, Zea mays
  Clone ID: LIB3067-029-Q1-K1-D6
tttttctcgtgattattttgtaggaaaaatggaaaaagccactgcaagctagggaatttgaattacttacctggatattgcttccttagagcaactatagcagttttgggggttgattctaagaaatgagtccatcagggctgcaaaccccattgctcctgagtcctgttgagggctgaggagcctactgttggtagcttagacgagcttaaaggaaccaagcctggcaaggcttgaggtcgtagaacatgtaagtcaagaaggtgaaggggatcatgtaaaagagcttgacaacctgcacattctatgtgtttgaaatacccactctgcctattgccatccaatgtttttcagagttctgcatgttaaccatcgaaagcaacttggatatgaaaacgcataaagcttgcaggtggtagactaaccgtaaggagtcgactttggggatgaccattaatacc

SEQ ID NO: 52799 - DNA, 424 bp, Zea mays
  Clone ID: LIB3067-029-Q1-K1-F1
tcatcctctcttctggagccctgaattgcgcctttcgtttctaagggataccagtgacagaattgagaaaaccagtgaaacggacctcataaacgcactggaaagcataggaccagtggcgtttggtgggaaatggggagagaaactggatgctgctttagttacagacatgggtcgttataggaaatataactttgagtctactcgtgatcttctgaggtatatcagaaataaatcgggtcattacagagaactttcagatgatctcaagggcatacttgggtcattgccagagggatttgatcactattttgctagccgatttccaaagttgctaattgaggtgtacaaggtcttgtgggtgcactgcaaggacgaagaagctttcagtaaacatttcaatggaagctccttatagctggag

SEQ ID NO: 52800 - DNA, 435 bp, Zea mays
  unsure at all n locations
  Clone ID: LIB3067-029-Q1-K1-F3
tctggatctagcagctcatcatggggtcacctgaagcttcctcatcagatgaacttcctggaggagttgcgccgtgcagtggacgctcatacagaatttgcgtcgcctgtcgtcacctggaactaatcgaagtcagcatctgcatcattatgcgttatgactaatttatggaaggcaggctgttcgccaggtctatgtatgatgtatcccatacacggatgatgtgccaaaaggctttcgtctgacctgcagctgcttctggaatctgcatctgtacaattgtaccattgttacccctggccttgtagctgcaaagcagtttgttgtaacaattaaatgaggcgccggatcctcacgccatcgaaagtttgaaacagctntggttgtgtatggtagttccaagacttggtgattataatgtgcgcattttctcga

SEQ ID NO: 52801 - DNA, 208 bp, Zea mays
  Clone ID: LIB3067-029-Q1-K1-F4
cccacgcgtccggaaaaaacatgaaaatacacagaaactaaatcataaaataaactaaacaggaaggaaaaaaccaaagaaaaagacactcataaaaaataaaaaaaaaaataaaaaaaaaggggcctcctttctataggacccatgcttccttacccttgcttactaattgataactctcctattgggtcacctaatttcagttcct

SEQ ID NO: 52802 - DNA, 400 bp, Zea mays
  Clone ID: LIB3067-029-Q1-K1-H12
tgcttgagatcttagaagatgggcggctaactgatagcacggggcgcactgttgattgggggaacacactattgatcatgacatctaatgtccggagcagtgtcattgataagggaggtcgcaagattgggttcgaccttgattatgatgagaaagacacaagctataacaggatcaagatccttgtgactgaggagttgaagcattacttccggccagagttcttgaacagattggatgagatgattgtattacggcagctgactaaatcggaggtgaaagagattgcagacattatgctgaaagaagtgtttgacaggctgaacgcctaggacattaatctccaggtgaccgggaagttgcgagattcagttgctgacgaatgttattacccgagcta

SEQ ID NO: 52803 - DNA, 366 bp, Zea mays
  Clone ID: LIB3067-030-Q1-K1-B12
aagcgaagtcttcggcggagcctgaggactagcgaggagcaacatgtcgaggcaggcgtgcgtcgatgaccagctgctgggcgacatccaaggccagcacctcagcgccaccgcgatcgtcggacacgacggcagcgtctgggcacagtccgtgaacttccacgagttaaagcctgacgaggttgctgggatgataaaggacttcgatgaacctggaactcttgcaccaactggtctttatgttggaagtacgaagttcatggtgatccaaggtgaacctggagctgtcatccgaggaaacaagggcactggaagcattactgtcgagaaaactggcaagtacctgattatcggtatctatgacga

SEQ ID NO: 52804 - DNA, 429 bp, Zea mays
  Clone ID: LIB3067-030-Q1-K1-C12
aagcgaagtcgtcgccggagcaggaggaagagcgaggagcaacatgtcgtggcaggcgtgcgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggagaggctttcgcgatacctgatcgaaca

SEQ ID NO: 52805 - DNA, 72 bp, Zea mays
  Clone ID: LIB3067-030-Q1-K1-C2
aaaaaaaataaaaaaaaaaaaaaaaaaaaaaataaaaaaaaaaaaaaaaaaaaaaaaaaaaaaaaagagaaa

SEQ ID NO: 52806 - DNA, 77 bp, Zea mays
  Clone ID: LIB3067-030-Q1-K1-D1
tcgaaaaaaaaaaaaaaaaaaaaaaaaaaaaaaaaaaaataaaaaaaaaaaaaaaaaaaaaaaaaaaaaagaaaaat

SEQ ID NO: 52807 - DNA, 270 bp, Zea mays
  Clone ID: LIB3067-030-Q1-K1-E12
tacaggtacagcacggctgtctgctatactagcctaacgttttggatcctgtgatcccgtgctggcggtcatcgtcagggcggacaactactacatcgaatgcgagccgatcgtggacctggaccaacggtagcgctctactgagacacagtcctacgaagatctctatgacaacctctgcgactgcggcgattggacccgcagccgctacacggcccccgtccacgtggactacgagaaggcggacgatcatcggcaagccccgcaagc

SEQ ID NO: 52808 - DNA, 151 bp, Zea mays
  Clone ID: LIB3067-030-Q1-K1-F10
cccacgcgtgcgcggacgcgtgggatccaccatagtgaggtggttggacatgcttcgcgtatatgcacctgtgcttgccttccttcgggacggagctgattggttaatgttcatcgaagacgttgatttgcttgccaaaaaagctagcaac

SEQ ID NO: 52809 - DNA, 96 bp, Zea mays
  Clone ID: LIB3067-030-Q1-K1-F12
cggacgcgtggggtcgaggtatcagtatcatttgagacgcaaaaaaaaaaaaaaaaaggagaaaaggaaaaaaaaaaaaaaaaaaaaataagacaa

SEQ ID NO: 52810 - DNA, 352 bp, Zea mays
  Clone ID: LIB3067-030-Q1-K1-F3
tcgcccacgcgttcgatctcaaggagcacctataggtggtgggcgtggtggaggaaggggttttgggcgaggccttggtggtggctctttccgctgtggaagaggaccaccaaggtggggtggtcgaggtccaaggggtgtaagccgtggcggttttagagggctaggatggttctaggtgcagtttgagtttgatgatgttttccccttgaagcatcatagctgcacaattggaaacttccatgttattgtaaccagatatgtttaaagtagcagagcactttatctgtggaacttggattctcaactgacacaaacggcttgtacctgtttcgtttccaatggcacataa

SEQ ID NO: 52811 - DNA, 403 bp, Zea mays
  Clone ID: LIB3067-030-Q1-K1-H8
tgaaaaaggaaggatccgtgtgctgaccttggttgatccgacattgttaataaggctcaggtgatgacacgctctagtggagaccattactgcattatcctggtcctactacacatatatggctagcctatgaactactgtacctagataatttctgacaagcaggtgcacgagaaccactgaaccgatggtcggtatgcacagctcgggtacgagatccgctcgacaactgtgcatgacaagatgatggaaatgtggaaaagcaatttcattgtgaaaacggtctctagatcgaagacggatgtgaaatatcatgatactagcatacatctgtacatgatggacctgaaggcaccattgatccctgaggttgaggctgtcgactatgggaactactaagaag

SEQ ID NO: 52812 - DNA, 300 bp, Zea mays
  Clone ID: LIB3067-031-Q1-K1-D11
cccacgcgtgcgcccacgcgtgcgcccacgcgtgcgttctcaagagcagccaagtcctgacgggcttctgagaaggactatgaggaagtcggtgcagagggtgccgatgatgagggtgacgagggagacgactattgagtagctggctaataagtagttctctggtggttaatggttgggttattttgagtatatactctatggttccactccattggatactgctgctgcgtgtgtttccattttgtactatgtagtaaattgttcgtagccccctaaaaataacttgaccggataatg

SEQ ID NO: 52813 - DNA, 425 bp, Zea mays
  Clone ID: LIB3067-031-Q1-K1-D5
aaccagttctctatgatcatggtgatgagggatatccacatattgcattctttggaattgagcatattcctccaatgacagagcttacctatgattatggccagaaccagcgtaatagtattcaaatgggaacccattctggttttcggaagtctaaaagttgcttatgttggtccccgaagtgtagaggttcctttggctaataaccagccctataaggaatatattggatcataatactccatttcaaagttacacctaagatatctgctggtcgacttttatattcagctcccaaaaatctgtcacaagtttgtgagagcaactgaattgtctttaccagcagaagcagcccgtcatggtggcctgtatgaatcagcacgggtcttcttatgtcctaagagttccatgcaccatcgaataaa

SEQ ID NO: 52814 - DNA, 82 bp, Zea mays
  Clone ID: LIB3067-031-Q1-K1-E1
atatgctagaaacgtgcgcgactgcaccctattgtcgttaaaaaaaaataaagaaaaaaggaaaggttaaaaatggaaaaag

SEQ ID NO: 52815 - DNA, 461 bp, Zea mays
  Clone ID: LIB3067-031-Q1-K1-E6
aagcaatcggcccatttctattctgtggatataactgaaaaacaagctaaaatggggctagtttgtcgtgttcactcaaacgataaaagcaaattcaagttgctatattttgagcttgaagaaaatggcgggcttagtcttgcactacaggaagacagtgtgaaggttgggaaagttactgctgcagggatgtatttccttggttttcctgtgtaccgttttgaacaaaataacctggcagctgctgcaaaagattctgatggtgcattctttaaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgctacgaaatgtggaggccaagatactcacaaaacgagc

SEQ ID NO: 52816 - DNA, 250 bp, Zea mays
  Clone ID: LIB3067-031-Q1-K1-F3
ttttggtttggtttttttaaaaaaaataaaccgctttatttgatatccgtcatttcaacgtaccaaatgaatagaaagatggccttgctgcgctcgtgcttgagtgcatgtttggtggttatactcgatcgatccattcagaaattacttgacacaggtatatattaaaaaacacacacattcaggaatacggggcaaacgatggaaatctaaagaatccgatgaaagggtatggaatatatatttcatc

SEQ ID NO: 52817 - DNA, 72 bp, Zea mays
  Clone ID: LIB3067-031-Q1-K1-F8
aaaaaaaaaaaaaaaaaaaaaaaaaaaaaaaaaaaaaaaaaaaaaaaaaggacaggggcggtcgatgttcaa

SEQ ID NO: 52818 - DNA, 319 bp, Zea mays
  Clone ID: LIB3067-032-Q1-K1-A2
tgccgacttcttctccacagagcagcatgcgttcgtgtaaccttagctctactacacggtctgcaagagtaggcagccaaaatggagtccaaatgttgagcccctcggaaatcccacaaagggactggttcccctctgacttcaccttcggagccgccacttcagcgtaccaaattgaacgtgctcggaatgaagatggaaagggggaaagcaactgggatcacttctgccacaatcatccggaaaggatactggacaggagcaattcagacattggagcgaattcgtaccatatgtacaaaacggacgtcagattgct

SEQ ID NO: 52819 - DNA, 391 bp, Zea mays
  Clone ID: LIB3067-032-Q1-K1-B10
aagccgatcatgacgaaaccgaagccagttcctaagccacagactccgcctacggcagagacccaagctcctgagcctcagacaccggatcagcagcgatcaaatggcgaaagcacaaccagcgagggagctgcagaggagcctccagccgagcagatggagacagacaaacctgagggagccacagatccctcggcttagctttgcaggtgatggaacatttgtgtgattgaccttatacttggttgggggtgaactaagcaagatggttgttcgccacatttgagaatgtgtgttgggacgttttttcgttatttctgtttcttgacggaggtggttggatggttgaaggatgagagcagtagggtacacttcgtaaatggcgattccg

SEQ ID NO: 52820 - DNA, 317 bp, Zea mays
  Clone ID: LIB3067-032-Q1-K1-B2
tagatcgcgagcggcagctccaactacttacttgaagttaaatctccactggacacttgaagggactaccaggattatctcaagttgaggacaagggtcgaattccttcaaactacacaaagaaatattcttggcgaggatctgggtccgcttagcatgaatgatctagagcagctggaggaccatatagagatatctctgaagcatatcagctcaagaaagaatcaaatgctacttgaccagctatttgatctcaaaagcatggaacaagaatagctggatctcaataaagacctaaggaagcagctgcaagaaac

SEQ ID NO: 52821 - DNA, 285 bp, Zea mays
  Clone ID: LIB3067-032-Q1-K1-E3
gctcgctgtcggcaggccatccccattttccgaggggtcttcgtatcgtcaatggcacggggcgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgtaaaaaaaaaacaacaaca

SEQ ID NO: 52822 - DNA, 314 bp, Zea mays
  unsure at all n locations
  Clone ID: LIB3067-032-Q1-K1-G7
tttttntttcatgaatcggtcaaaaggccgttctgacgagggtgaacacgatcaccggcgtggcatacaaggacgacccgacgatcatggcgtgggagctgatgaacgagccgcgttgccagtccgacgtgtcgggccacgccatccagtcgtggatcacggagatggcggcgcacgtgaagtccatcgacgggaaccacctgctggaggccggcctggagggcttctacggcgcgtcgtcggcccgcaggtccgcgaacccgtcggggtaccaggtgggcaccgacttcatcgccaacaaccgggcgcccggg

SEQ ID NO: 52823 - DNA, 238 bp, Zea mays
  Clone ID: LIB3067-032-Q1-K1-H3
taggccttgatgctagtgccgtccagttgttaaaaatacgctcaagcatgatgcataggggctatagatcgcggctgtctgaaattcccatgatagaactaacatataaacatggatattcaacacaggatagtacagttacacctccaaaattcatttcccgaagcgagcacatagacattcagattacatatctacctgcaggacaatgcactgaacgtgcatatacagaatcacc

SEQ ID NO: 52824 - DNA, 394 bp, Zea mays
  unsure at all n locations
  Clone ID: LIB3067-033-Q1-K1-A2
agtcgcaacactgtatgttggttgcctcaaaacggtatcaaggtaagcaaagtacaaaactatccagcagcacatgaggctcgaaaagaacaagcatgaaaatttgagcaaaccgtatggaaacacctctctcctctccatacaacactagcacctagaaggttctgggacaccttaatataggcatgccatcatttgcaaagcgttcttggcactcgtcactcgatcagttctcacctggctggtggcgtcgggggaggcatgcttgctcttgccaatccaacccaagcaacaatgccggcgccaaggatcacccatccacaaacatcgtaccagaagtcattgtccttcttcttccttgattgcctnggatttgaggctgaggatgcttgtg

SEQ ID NO: 52825 - DNA, 427 bp, Zea mays
  Clone ID: LIB3067-033-Q1-K1-B1
atgcagtggcaagggttggggttgctgctgacctccggggaatcgtgtgcagtcgccgggtgggccggatcgtccagcactggctgcacgccggagaacctgacccgttctacgacccgctgagcgactatgtcatactgccaacactctacgaaatcgagaagcatcgtgagaaacacggggatgtcacgtcagtagcggaggactgggagatcatctgcccgaacgacggcaagaccatgaggccaggcgagtttcctcctatggtcagcacactgaccacgagcctggaaggcaaggagggtgcactggaagaggcgcaagccactgtggtcgttcacccggagaagaaggggctgcagcatgtgcaagttagggctgtgggtgtcagtcatggtgggctaagccgtatgagccactttggttg

SEQ ID NO: 52826 - DNA, 445 bp, Zea mays
  Clone ID: LIB3067-033-Q1-K1-B5
aaaaaaaaaaaaaaaaaaaaaaaaaaaaattaaaaaaaaaaaaaaaaaaaaaaatggaggggttccttactaacgaaacacatgcatgcgacttcaataaatcttctatagtgttacctaaacttaattcactgtccctagctttacaacttcaacactggtaaaactcctactttacccaacctaatctccttgcactacatcctcatttcccttgctggctgtatagcaatgacgcctagacctttcgccctttccaacagttgctcatcctcaatgtcaaatggtactcgccctgtatctgtgcattaacattcggcgctgtcgttgtttcgctctatttgaccgttacatttgccatttccatttctcttgctcctttttctttctttcttttcttttttctcactttctcctatctttttcttttcatgctttaaatttt

SEQ ID NO: 52827 - DNA, 334 bp, Zea mays
  Clone ID: LIB3067-033-Q1-K1-C5
ggctacacggcgctttggaatctgtttgctcagaaagagagttcgcgagtagtattattggtatgctactacagacagagaccagcagaggccactgtcacgctccatttcgactgcggaggaaccgtttttgagactcgtgagatggccagagagttcaggttgttgccgtcgccgaagccagagaccagtgccccggctgagcgaaggccccgtagcttaacgcgttggcgccgcccttctcgtcgtccgtgtcccacaggaacgcggttttcgctgctagcacctggctgttcttcggggaccccttggccgcccgctcgaagtatcttga

SEQ ID NO: 52828 - DNA, 62 bp, Zea mays
  Clone ID: LIB3067-033-Q1-K1-C8
cggactcgtgggaaaaaaaaaaaaaaaatttaaaaaaaaaaaaaaaaaaaaaaaaaagaaag

SEQ ID NO: 52829 - DNA, 403 bp, Zea mays
  Clone ID: LIB3067-033-Q1-K1-D9
ttgtgtttgtgtacctcggtgcagtttttttattacaaaaaaaaaaggaaggagcaggggtcataggtgtagcttacagcaccgatcaacttgaaaccaaaaccaaagaaagaaaaaatcacaggtggtctgggtgatttgcaatgcctcaaaggttatcgtcgatcaggcctacaggaagtttcggatgtccagtttcctgacatcaggcatctgctaatcttggaactcctccctcttgagtcgagtctccattgcctcaacacattccttcttaagttcagtcagctcacttttggcaatctccaattcaagttctttctcgatcttaggaagatcctacttacgaatgccaagctatgcgttaatcttgtcaaactctgccataagggtggccatgttc

SEQ ID NO: 52830 - DNA, 365 bp, Zea mays
  Clone ID: LIB3067-033-Q1-K1-E9
cccacgcgtccgggcttaacataggaaaggaggtgcttagccacgctagctagctgatggttttctcctatattacagatattcaaactgtactatggactctgtaagaatgagcaataaactaagcagacagaagttaaaaatagaagtaacagaaatttaaaagtggcgccgttgccggggatcccgggtcgcccgcgtgacaggcgggagtctcaccactgtaacgactgggatgcctagggtttagtggatgtattgttccacgactaatgtttagtattggaagtatgatatatagtgtaattataaaactaatcgtatgaaggaggaaagataaacgaattgatcaagtctaaaaactt

SEQ ID NO: 52831 - DNA, 419 bp, Zea mays
  Clone ID: LIB3067-033-Q1-K1-G10
taaacacccagcggttaatgatattactgctgcagtttgcaagcaaaagatggatattcaagaagcagaaacacttgtaaaacagtggcaagacataaaatctgaagctcttggccctgactatcaaactgacatgctacctgagattcttgatggttcaatgctctctaagtgggaagacttagcgttattagcaaaggaccagtcttgctattggagatttgtgctgctaaatcttaatgttgttcgagccgagataatcttggatgaaataggtgctggtgaggcagcagaaattgatgctgtacttgaggaagcggctgagcttgttgacgattcccagcccaagaaaccgagttattacagcacatatgaagttcagtacgtattgaagaggcagaatgatggatcttggaaaa

SEQ ID NO: 52832 - DNA, 51 bp, Zea mays
  Clone ID: LIB3067-033-Q1-K1-G8
aaagaaaaaaaaaaaaaaaaaaaaataaattaaaaaaaaaaaaaaaaaaaa

SEQ ID NO: 52833 - DNA, 97 bp, Zea mays
  Clone ID: LIB3067-033-Q1-K1-H1
aaagaaaaaaaaaaaaaaaaaaaaaaaaattataaaaaaaaaaaaaaaaaaaaaaaaaaacagaagggttttaaaaaaaaaaaaaaaaaaaacaaaa

SEQ ID NO: 52834 - DNA, 55 bp, Zea mays
  Clone ID: LIB3067-033-Q1-K1-H2
aacaccaaaactcaaataaagggccacctaaatccaattcactgcccgacaaacc

SEQ ID NO: 52835 - DNA, 396 bp, Zea mays
  Clone ID: LIB3067-033-Q1-K1-H4
cccacgcgttcggtcgtctcctggctgcaggctgctcgctcgctcgtgtggactgctggctcatcgttgatcaacaaagcaagttgcaagcggtgaaagcgactgcgccggtgtctctgtccggctagctcaagctcctcgctcctgcggctacaagtaggaccatgacagggagagatgaaagctccgaccgtagttcggcgtgcttgttgttgggaacaccggctctactagctgctcttagaactgctgctcacttctggataaattatcagttaattagtatgtttgtatgtgacatgagtgtagatataatttctcactcaaataatgtcactatgtaattatgttgatgctataaacttaatatatattaatgtttgaattaaggcattc

SEQ ID NO: 52836 - DNA, 447 bp, Zea mays
  Clone ID: LIB3067-033-Q1-K1-H8
tgcaaagttagacgagatggaaatggtcgatggtttcgagatagctctcaagaaactaaccgaatggctgggggagaatattgacaagaacaagactaggatatttttcgcaggatcgtcaccaacacattcctgggctagcaactggtgtggagaagacaagaacaagtgccttaacgaaacagagccgatctacaaaaccggatacaaagctgcaactacagactacagcttgatggccaaagctaagcactactttcgaacattggagccgaaaggcatacatgttcagatactgaacatcaccgagctgtctgactaccgcaaggacgggcatcctacggtgtacaggaaacagtttgctcctctgacgaaagagcaaatcgcagacccagccagttacgcggattgcacgcactggttgcctcccggagttccagatgtctg

SEQ ID NO: 52837 - DNA, 130 bp, Zea mays
  Clone ID: LIB3067-034-Q1-K1-A12
cccacgcgtccgaaaaaaaaaaaaaaaataaaaaaaaaaaaaaaaagacaaacaaaaagggagaaaccaagcaaacatacacgagcatgcaacctcacaaccctactaatagcgacaccaaaacacaaca

SEQ ID NO: 52838 - DNA, 295 bp, Zea mays
  Clone ID: LIB3067-034-Q1-K1-C1
cgtcaattacactgcgggattagcaacaagcaagagcgatcgaaaactgttacacaggcgctacaccaagtaggtaaaaacaagtttgcggctgcctgccgccataccatgccatactctggccggtatagctgcagcagattgtatacaagggaaaaaaaagaagatacacatacagtacgaagaaggcaaatgaaatgccgttcgggcggtagcctaggcgtgtacagctgacgcagacagaccccgccttgggcggtagcctaagcgtgtacagctgacgcgcagacagacc

SEQ ID NO: 52839 - DNA, 235 bp, Zea mays
  unsure at all n locations
  Clone ID: LIB3067-034-Q1-K1-C2
ttntatattatatgctcttcatctgcgacgcccactagcagctacccttcaccgactactaaaagccgaagccgaccgacccaggggtgcgcagcgcaatgcaactagcatccagctctctctccccggaccgttcgccgacgtttagtttctattgtgcacgtgcatgcatcgtagactgtttcaggccgacgctgcgccggcgccgttcgcattggttgcttttacttggacc

SEQ ID NO: 52840 - DNA, 296 bp, Zea mays
  Clone ID: LIB3067-034-Q1-K1-E2
tcacaaccaaggagcttggaactgtcatgcgttcactgggtcagaacccaacggacgctgggctacaagacatgatcaatgaggttgatgcccactgcaatggcacgatcgacttacccgagtttctcaacctcatggcccgcaagatgaaggacaccgactcctaggaggaactcaaggaggcgttcacggcgttcgacacggaccagaacagattgatatctgccgcggagctgcgacacgtgatgaccaacctatgccagaagctgacactcgaggaagtacacgagatgatc

SEQ ID NO: 52841 - DNA, 450 bp, Zea mays
  Clone ID: LIB3067-034-Q1-K1-E5
tgttccgtctatccggaaccggttctgttggtgccaccatccgtgtctacatcgagcggtacgagaaggattcctccaagaccggcagggattcacaggaggcccttgctccactggttgatgttgcgctcaagctctccaagatgcaagagtacactggccgctctgcccccaccgttatcacataaatttttgaagagtgatttacaatgagttgaggcgcttacacaaattttcattcaagcctcttgttctatagttctacttcctgttgcatctcaccaatgaataaaatgtatgtatcagactcgccccgtttttttttttgtccatgtactgcaatgcagcggactgaaccggtggcacagcatgcggtaataatcttgtcacaatgacagtgctgtaatcgggagcgtgtttcttgtaatcttgttaggaagtgtttctggt

SEQ ID NO: 52842 - DNA, 66 bp, Zea mays
  Clone ID: LIB3067-034-Q1-K1-F4
gcttccgttgcaaaaaaaaaaaaaaaaataaaaaaaaaaaaaaaaaaaaaaaaaaaaaggaagaaa

SEQ ID NO: 52843 - DNA, 393 bp, Zea mays
  Clone ID: LIB3067-034-Q1-K1-F6
tgttcattgcttgcgctatttgtcacgttaccatacttccattatacccaaacactttgtatgaagtacgtaccaacagtgaatagaagcacgttgtggagttagctaggcagcaatggcagcatttgtttttaactgagcatgcatactggagaggtgggcaaagaccaaaggagcatgcatactggagaggtgggcaaaagatcaaagagccatttgaatctatcgttgtgacattgtctaccattctgatgcattgcaaccttctctttctgttgtatcctagttacatactgcactattatgtggatgttgtgttgggggctcggtgcaaattggtggatttcaggatctgttcttgttagactgcacttgtttataaagtagcgtttg

SEQ ID NO: 52844 - DNA, 343 bp, Zea mays
  Clone ID: LIB3067-034-Q1-K1-G10
agcctatcaaagctattgatgtgcctcgtatcttgagctatatttgataagatgatgggggaagagaatatagaacaagacaactcactatagggatctattttcaatagtaaaagaattattctaagaagacctattatggtcttgaattatgtcattaattctatgtaatttgcatcaacttcaagaatatcattgtagttatgtccaaataagtccatatatgtgagatccatatgatggacgctattttatccgcttaatatcatattgcatccatatatatagatatcaaatgttaaaaaggtggacctaatctaaaaaagaaaagacctggtaaaac

SEQ ID NO: 52845 - DNA, 399 bp, Zea mays
  Clone ID: LIB3067-034-Q1-K1-H6
tgtttgtgtgcgtgtctcggagaagctctccctcgcctcgcagatccgcggcctgctgtgttgctgctttgccagcaagctgccgcgctcatcctcgcgcgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtggg

SEQ ID NO: 52846 - DNA, 450 bp, Zea mays
  Clone ID: LIB3067-035-Q1-K1-A5
tccaagtctaacaggaagaggacagctaaacgaactgcattttctgattcagattcagaagacctagacctatcaaaggaggaccttgtgaagctgcttcttgagaaagacgaatcattgaagtctaaagatgaagagtttaaagatatgaaggataaggtcctacgcagctatgctgagatggagaatgtccttgccagaacaaagcgtgagtcagagaacaccaagaagtatgccatacagagcttctccaagagcttgttagatgttgcagacaatttgtctcgggcatcatctgttgtcaaggcaagtttctcaaagatagattcatctaacgattctgatgaagctgtaacactactgaaaaccctactagagggtgttgagatgactgagaagcaacttggagaggtctttaagaagtttggagttgaaaagtttgatcctttg

SEQ ID NO: 52847 - DNA, 367 bp, Zea mays
  Clone ID: LIB3067-035-Q1-K1-B6
caggcacacaagctgtactttgtcatgtccctttgagtacgcatcagtgtcatgcaggtggtaatgtcttgtagtggtccgtttaggcggtgtagtcatgggaacgcgacctcagatacctggtttcttttgattgtgatgttatcttgcattattgcacctgtaggatttgttgaagctcatattttccagggttttggatcttttgtgctagtcttgtgtctttgtgtatgcagaggctgagctaggattatggtatgtaagggagccaactaattcatcaatactatatgatgttatcaaaaaaaaaataaataaatttaataaaattttatataaaaattttaataaattaattatataataa

SEQ ID NO: 52848 - DNA, 144 bp, Zea mays
  unsure at all n locations
  Clone ID: LIB3067-035-Q1-K1-C1
tcgaagcaggcctagtacgccgnctgcgcgttcctcctattacacatacacgcagggaggggccgatatgtgtaataggaggctccatcgaacatcgatggcttgcttctttatcagaacatgtttgaataaacgctatttggt

SEQ ID NO: 52849 - DNA, 126 bp, Zea mays
  Clone ID: LIB3067-035-Q1-K1-C10
aaaaaaaaaaaaaaaaaaaaaaaaaaaaaaattaaaaataagggcggcacgatattaatgaggcgggcttacatacacgtccatgcgacatgcgtggctcttctatagtgccacctatttccaact

SEQ ID NO: 52850 - DNA, 356 bp, Zea mays
  Clone ID: LIB3067-035-Q1-K1-E11
gactctgctactgccctgcattctttcgcgccgccaccttgggtgctcggtcgccggaaccgtgtgggcgaacaagccgtcgtggaggagagagatgcaagaagagagaaaatagagcagggcttcagctacgcgattgctggtcaagaacaggtaccacaggatgaggcgcatggaggatgctgtgcgagttcgtgagaggtctaggccgtcgtctcccagtcaactttgggttgctggaccgttgtctccttataatgtaatcatgtattacgtatagaactcctgctatgtagtaaagatgtgacatttgatcctgtgccatgattcatcatatgtgtgaaaaaaacaataac

SEQ ID NO: 52851 - DNA, 191 bp, Zea mays
  Clone ID: LIB3067-035-Q1-K1-E7
ggttcaggtgatacatacgaaaagccgaacttctgtgtcgagaagaggcataaggatttagctatactgaccattgcaggaaaaaactgcctgcgttatcaattataaaatttcacagatcagacatgaaggtaaagacatgaccgaagtgtttgaaatcacagtcatcaagaaaagaaaaaaatgatact

SEQ ID NO: 52852 - DNA, 392 bp, Zea mays
  Clone ID: LIB3067-035-Q1-K1-F12
tccactcgtccgggtgaggcagctcaacccgtggcagtatactgcagatatcccgctgatggcaaatttggaggtttggtttcaaaggcctaaggacattgttcgtaaacttcagtcaggcgatcttgaccttggtgttgtgggttttgacatagttagtgaattcggaatctgcaatgaagatttagtggttgttcatgatgctcttgagtttggacattgtcgtttgtcccttgcggtacctaaggaaggcatctttgagaacatacatactatggaagatttgctaaagatgtctgaatggacagaagaaaggccactacgtgttgttactggatttggatatctaagcgataagttcttaagagagaaagggttttaagcatgttcgt

SEQ ID NO: 52853 - DNA, 434 bp, Zea mays
  unsure at all n locations
  Clone ID: LIB3067-036-Q1-K1-A11
taatcttattcagttcaagcatttatttaatacgccaattgccaaatgtcttacaaaagcaagagcacctacaagatatcgtaacacattggaacgctccggcatttggaatagcaactctacaatcggtagcgcaacgcttgcaacatttcgtgttttgccgaaaagatgcaaaagaaaaaagaacagggaaagtccgttggaccgcatgcatattccgatacattccatccgaataatatacagagcactaacggtaaggatcaagcttttgctggccatgtcgcctgagatgacataatgatgcccacaatgactccgaacagtcccagagcgctgccgaagatctcaatcaccaaaatctttacaaagagtgatgagttctgagcatcagacagtgcacagctgcttncgattatccccacacatacccc

SEQ ID NO: 52854 - DNA, 65 bp, Zea mays
  Clone ID: LIB3067-036-Q1-K1-B5
aaaaaaaaaaaaaaaaaaaaaaaattagaaaaaaaagaaaaaaaaaaaaaaaaaagggaaagggt

SEQ ID NO: 52855 - DNA, 332 bp, Zea mays
  Clone ID: LIB3067-036-Q1-K1-B8
aagcaatgtgttagctcctcgccagaggagaggccgacaatgcacagggtggtacagatggtggagtcggatgtaattacaccgtgccctagcgacttctatgattcagagtagtctcctggacaagccacgctgctgctagtttcccgtgggggcgcattcctttattctttgcgtatattgtgtaaatgcattgccgcggtgtttggtctccaatcggctggctcaacgggtgactcttttttgcgtctgtatacctatgtatgtatctgtcatgctacaagttggctatatgctgatttaataataagagagaactagaacttactagt

SEQ ID NO: 52856 - DNA, 102 bp, Zea mays
  Clone ID: LIB3067-036-Q1-K1-C1
aaaaaaaaaaaaaaaaaaaaaaaaaaaaaaattaaaaataaaacaacaacaaaaaaaaaaaaggaaaaggaaaaaaaaaaaaaaaaaaacaaaaaataaaaa

SEQ ID NO: 52857 - DNA, 306 bp, Zea mays
  Clone ID: LIB3067-036-Q1-K1-C7
cccacgcgtccgggcggattccttctcttctcatgtgtgttgctcttggactacctgaaggaattcgagaagtacctgcttgctcagaggcaccgagctggagatgatggcggcaacgggctgttgcaggcatgattgctttccgctggtctcactggcactagcagctactagtttctgatctgaagtgcttccttttgaacataacatgtgtctctgggttaaaatccaactgcaattgattgttctgagaacttgctctgccaaaaaaaaatgtaatgtattatattacgaaaaatttataaa

SEQ ID NO: 52858 - DNA, 160 bp, Zea mays
  unsure at all n locations
  Clone ID: LIB3067-036-Q1-K1-D4
tccacgcgtncgtccacgcgttcgttcacgcttgcgggaatggattcattacgattgtaccagcatggcttgttggtgtattctgttttttcttctattctaaataatctgattgttgtatccaatactgtactttttagcttaagaaagaaatacttta

SEQ ID NO: 52859 - DNA, 185 bp, Zea mays
  Clone ID: LIB3067-036-Q1-K1-F11
tgattagtaacactaatctagagaactgaatttaaacattttaaaactagtaacacgcatagggatctggtgacattcattgtgcacctgtaattatttcattacctataactatattcaacctcatatggtctaattttacgactttcttcacatcttcttttcaatcatatcatttttaaatt

SEQ ID NO: 52860 - DNA, 459 bp, Zea mays
  Clone ID: LIB3067-036-Q1-K1-F8
taacaagtttggatacagagggccgctaccttctgttgaatgcaatcgctaaccaactgcgctatccaaatagccatacacactactactccttcatcactctgtatctattttccgaggctacccaggaaattacccaggatcaaatcacaagggttcttcgttagcgtctcatagtgaaccgtcctcatccttgggggttacttattactttcattgaattgataaagaatccgtgttacaacttttggagccggtctgttacacactgtgcacctgagatcgagaaactgttcgagtcggtggcaaggtcatgtggcgcaaaagttgtggacgaaggaatcagcgtgcatgatggcagccactaaagccatctgctttgttcaagtgttggttttgagctatttcttctcttgcactgaaaatttctgggcttgtacagatcgtctgtatagtaaa

SEQ ID NO: 52861 - DNA, 395 bp, Zea mays
  unsure at all n locations
  Clone ID: LIB3067-036-Q1-K1-G6
aagaagaggaataaccctggagttgagctggcactcgaattctttcatgcattgtgagcgcaggatctgatttgagtgggtctctcggtgagttctcgcgagcagcaagttttgcaacctgtaattgcctgtacatcaacacaacacaattttgtccctaaccgcaactggtggagagtagcaaggagcgatttggcgtgaatgaaccaaaatgatcccagtgtagatgacatgctataactgtgctatctttgcttggttgacgcttgggcgaagtcttcgccacatttgtttaactggccatcacctgtttcttggcacccatccggcactcgcacagatctttaataaaagcttgtttagataaaaaaaaaanaaatatattattttaataa

SEQ ID NO: 52862 - DNA, 183 bp, Zea mays
  Clone ID: LIB3067-037-Q1-K1-A2
aaaaaaaaaaaaaaaaaaaaaaaaaaaaaaaattaaaaaaaaaaaaaaaaaaaaaaaaaaaaaaagagaaataaaaaaaaaaaaaagggccatcccttctttaggaatccaaacttacttaccctttcttccaacaatataactcttttatattgtcccctaaattcatttcactggcctgtt

SEQ ID NO: 52863 - DNA, 349 bp, Zea mays
  Clone ID: LIB3067-037-Q1-K1-B8
ggagaattctattaagtctcccttcattttcgcttgagaaacaatccaagataattatggcgggtatgacattgcataacttcattagagatagtgctctacacgatagagattttgatgaagtaggagctaatagcctaagtcatgatgtacctgcaggtgagagtagtactagtacatctgatgagttagacatgagtgattttcaagatgcaattgctaatgcattagtgtcgtagttaacttagtgattgtaacagaacttatgatgtaatcaactccactaattattgtgtaaaaaaaaaatatagtataatgaagatagtataagcaatatatgaactaaaat

SEQ ID NO: 52864 - DNA, 366 bp, Zea mays
  Clone ID: LIB3067-037-Q1-K1-D2
actaattatggagtgcctattatccattgcttatttattacaagctaaacttggtcgtacaatacttaacttgtatagttaaacacaccaccgtatactactagcctactaacttggaccgtttaccgtaaaccgtttaactagctaaatccccgatggatccatcggcggtgaatttcccctaccccctgattagtcgtcgtcgcttgccggatcattcccgcaggaacaactttacccgggcaacgtttttgcaacccgttaaaatgctcgcccggaccaacgccaggtacatttggtccattgcttggttgaatgcctttaacaatacccccttcgggtaccccgggtttactccgtaagttt

SEQ ID NO: 52865 - DNA, 365 bp, Zea mays
  Clone ID: LIB3067-037-Q1-K1-E12
cccacgcgtccgtaagcatttggagaaaaaagagactgaatatatgcgcttgcagagacacaggatgggagttgaagattttgaacttctgactattattgggagaggtgcatttggagaggtgcgtctttgtagagagaagacatctaagaatgtttacgcaatgaaaaaactcaagaaatctgaaatgcttcgtaggggccaggtagaacatgtcaaagctgaaaggaaccttcttgctgaagttgatagtgcttacatagttaagctctattattctttccaagacgaagagttcttatatctcatcatggaataccttcctggcggggacatgatgactttacttatgcgcaaggacatac

SEQ ID NO: 52866 - DNA, 287 bp, Zea mays
  Clone ID: LIB3067-037-Q1-K1-E4
gctgctgctacggctaaccgaagaaaacaacgatatctccgcgtaccggatggcatcgtccgatggtttataggtagcttatgtcatagggtttaggataactggtagcatgtgataacctttgcattcttctagtccacgcttcctcgatttgccgttgagccgaaacgatgtattctatgctcgacgtgctataatagattacagcaattatgattatttactttacctgttcaatattagtggaaaaggacgaaaagggtaaactcaaaaaaaaaaaaaaatat

SEQ ID NO: 52867 - DNA, 361 bp, Zea mays
  Clone ID: LIB3067-037-Q1-K1-H11
cctcggcaatgttctcaagaagctggcttacaagcactgatcagagacggtccactgtcatttgtgtgttagtcctagtaccgagatgtaactttgttctctggaataagtggattaataaagggcactttcgtttgtgtgtcgtcctgagctgccttgtccgtagattcttacaaactgttctgtgcgaaagctaccatgatagatatgcgtcgtcgcgtcgaattgattgattctatagcctgataattgattgagtatcgcccatgtcgcacaggagaacgataaatttgttccaaactaaaggggcatgacgactgggaaatcaaagatccaagccaaattccccgttgtagaacga

SEQ ID NO: 52868 - DNA, 178 bp, Zea mays
  Clone ID: LIB3067-038-Q1-K1-B12
gcgcagacgcgtgggtcggtcttgtacgggttcacaaacattgatgttttcaaataactgtggttgatcgggatactttacggtgaattcatgagattaaatctgcaaagcactttaactctgctgttctatcgactttttaattccaacctacatcaacttgctcaggaaactcaac

SEQ ID NO: 52869 - DNA, 85 bp, Zea mays
  Clone ID: LIB3067-038-Q1-K1-B5
cggacgcgtgggcggacgcgtgggcggattcttgggcggacgcgtgggaaaaaaaaaggggagaatttaaaaaaaaaaaaaaaca

SEQ ID NO: 52870 - DNA, 394 bp, Zea mays
  Clone ID: LIB3067-038-Q1-K1-C1
tggcaacatggagatggcacaacaacaaggtggatttattggccatcgcccaagacttgcatgggtcaataaggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattgggctggtgtttggtaacatgaagcaataactttctcttatcgaaaaaaaaaatttaagat

SEQ ID NO: 52871 - DNA, 397 bp, Zea mays
  Clone ID: LIB3067-038-Q1-K1-F1
tccacgcgttcgtccacgcgttcgcagatcctccctaagattgccatggcggaccagctcacggacgaccagatcgccgagttcaaggaagcattcagcctcttcgacaaggactgcgactgctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacagactctgaggaggagctcaaggaggccttccgcgtgttcgacaaggaccagaacggcttcatctctgctgctgaacttcgacatgtcatgaccaacctaggtgagaaactga

SEQ ID NO: 52872 - DNA, 102 bp, Zea mays
  Clone ID: LIB3067-038-Q1-K1-F2
ttttcatcaaaccaacacactgctaattaatgtttatggatggatctatccaacaaaaaaatcgtctgttcttacgatgagcagggaatccccttaccgatc

SEQ ID NO: 52873 - DNA, 178 bp, Zea mays
  Clone ID: LIB3067-038-Q1-K1-F7
tggagttttacattaaaaaataaaaaaaaacttaaaaaaaaaaaataaaaaaaaaaaaaaggggggcacatccaacatgttgggtgggtaatcattcttgtactacgacatggttcctattattttcaagtacttaacttcactcttatttcctttatttttacatctgtcgcactgc

SEQ ID NO: 52874 - DNA, 286 bp, Zea mays
  Clone ID: LIB3067-038-Q1-K1-H10
cccacgcgtccgcccacgcgtccggtcatatgaagatcatgtatttgtgattaaaccaagatagcatagcaaatgactcccctaagaatgagcacttacaacttctcgtgatgctataaggacgcacttacagatttttgcgtaaacaacgagcatcctagttgtgttttttaccagcaggcgctgctactcctgtcatacttcaaccatttgtattcacatggtcttaatggtttgatgacagctatcctgttttttgttcttatctaaaacacagtcacgcttc

SEQ ID NO: 52875 - DNA, 371 bp, Zea mays
  Clone ID: LIB3067-038-Q1-K1-H5
gttgtttaaaagcaaaacatagacaatttttcttgacacacttgattgtttgtaatgacattttttaaggtccaattacggttgggcacagtagcagcataaatagacttattttgtcggacggtttaaaatccagtcctgatcgccggccgagagcagaggaagcagcatcacaagtcgggcaggattcccagggccttgccgtactcgaccatgtcgtcgtatatgtcatccagcgtcctgtacctgaactcgaaaccttccttcaccagcttcgccgacgacaggcacactctcggcttttaagccgctcgccggaaagcaggttcgttttgacgccgtactgcgggtacttgttcgtcaggaaacgc

SEQ ID NO: 52876 - DNA, 439 bp, Zea mays
  Clone ID: LIB3067-039-Q1-K1-B3
tccacgcgtgcgcacacacacacacagacatttggtttccaaaaccaagtgtgtgtactatgaacgagctagctcgggcggcggcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaagccggcgccatcggcgtcggcgccttcgcactctacgagaaacacgaggcgaataatgaccccgagcacgcgcacaagcaccagaatcacggaggaggtcgctgccgcggccgccgtcggctccggcggctacttattccacgagcaccacgagaagaagaaggaccac

SEQ ID NO: 52877 - DNA, 322 bp, Zea mays
  Clone ID: LIB3067-039-Q1-K1-C4
caggctgcgcagcccagccagaaccagattcgacccgagttcgcgacgagagcacgagatggcgaggcggaccgcgctgacctccctccccgcgcgcctgcgcgcccctgcgccccccgcggcgacgggcggccggcgcctcctcagcgacgggaaggggcgcgtgctcagcgaggaggagcgcgccaaggagagcgtctacatccagaagatggagagggagcggcatgagaagctcaagaagaggctcgagcaggagaaggccgactccgacaaggccaagcccgccgacgccgacaagaaggccgaaggatctacctag

SEQ ID NO: 52878 - DNA, 69 bp, Zea mays
  Clone ID: LIB3067-039-Q1-K1-D12
tcccactctttctcggactcttgggaaattaaaaaaaaaaaaaaaaaaaaagaaaaaaaagaaaaattt

SEQ ID NO: 52879 - DNA, 202 bp, Zea mays
  Clone ID: LIB3067-039-Q1-K1-D4
cccacgcgttcgcccacgcgtccgcccacgcgtcctcactcctagtatatagtagtgagtgactgcttggtatgtgtagtactgtactatcttttctccatatgcatgttttgccagcgcgtaatgaatgtaatgtcagtactgctaaaaaaaaaaaaaataaaaaaaaaaaaataaaaaaaaaaaaaataaaaaaaaataa

SEQ ID NO: 52880 - DNA, 300 bp, Zea mays
  Clone ID: LIB3067-039-Q1-K1-F1
tggttgggaaatctcgagccaactagccaattgaactcaatgccaatttcacaagttcgcacacagacacagtgtgcagtttttgacattgctggtcacatttgcagtttgaattgcaaaaccatattgccagcattattgccacaactcatattccatgatcacatcgaatgaccgaaattgatgacaagaactagcccatctcaacaactaaacccctctttcgctggtggcacggaacaacaacgacacctttggagcaaccactgcatatgcataaagcaacccaatctctagtac

SEQ ID NO: 52881 - DNA, 377 bp, Zea mays
  Clone ID: LIB3067-039-Q1-K1-F2
tccacgcgtccgcccacgcgttcgatcgctggaagatcgtcccctggtaaatgtgctgttgtgtggctgcactggtcatcacgatgatctggagctttgaaggcatagccacctgtggtcagcaactgctgccgtgttgctagaataaagttggtggcgatcgatcgatcgatctttggtgatgggtgtccctccctgtgtgtttgtgtttagttccagtcgtttgtgaggaagtcagttatgtttgagtgagaggggtacttcgctcttcggttaactctgtacttgtcatgaggagagttttcatacccggagtgtacgatccgagtacatactcggatccttcctttttcatcgaaatgggttttatcttatca

SEQ ID NO: 52882 - DNA, 405 bp, Zea mays
  Clone ID: LIB3067-039-Q1-K1-G7
aaaaagcgaacatgttatagtgattgaacagtcggtgacgcaacgtcagtttcaggcacaccagcagaaaactcggcccaaatatcgatcaaagaccaacaatacgcatgtttggatacgatctggtttggacttacacgttacactagccaacctgtcaatactcagagcaatgcatgcatttggattacccacacgggacaccaaatcacttgttacctgaagatggtagatatggattcggtacagcaacgtaattgagatgtctaggtcaagagcaggtaccacaggatgaggcgcgtggaggatgctgtgatgagttcgtgagtggtctaggccgtcgtctcccagtcaactttgggttgctggaccgttgtctccttataatgtaattacttatttatt

SEQ ID NO: 52883 - DNA, 55 bp, Zea mays
  Clone ID: LIB3067-039-Q1-K1-H9
cccacgcgtccgaaaaaaaaaaaaaaaaaaaaaaaaaaaaaaaaaaaaaagggaa

SEQ ID NO: 52884 - DNA, 395 bp, Zea mays
  Clone ID: LIB3067-040-Q1-K1-A9
tccaggcgtccgatctctacagaaatgggtttgattccgaaagaggtggacacagattcaggagtggtgatatgacaaacgaccgggggagaatgaggagcagatcacgttctccaacaaggcatggctatggaagatctggaagtccaaatcattagctgaatatctagatagttctattcacagttgggactcatgagctctgttggaaccctacagtcttgctttttacatgagataaaaaaaattctcagttaaactcgtaagggcggttctggactttatgagtggatgatgatgtttacagaattacagtctatagcaggtaaaccttgaacattaatgttttctgagacacatatcttttatttcccttgacaactttgctataaacc

SEQ ID NO: 52885 - DNA, 336 bp, Zea mays
  Clone ID: LIB3067-040-Q1-K1-C4
ttgggtggtttttttttttttttttttttttttttaagtactcacaaaagcatggctcttcattagacgatcaattcaaaatgagatacagtagttattatttagcaagaaaaagtcatgatcgtcagaacattcttccttaacagaagtcgtagggcttcttagtttagtacatacagtagcatgcataaagctaggaccgatatgggtatatatagaggatttatcaaaagcattacgtccaacatatattgaagatccatggccactagagcacacagcgcacaaagaagcaacttaatcattgttcaagtggtccatgtaagcttgataccc

SEQ ID NO: 52886 - DNA, 91 bp, Zea mays
  Clone ID: LIB3067-040-Q1-K1-C6
cccacgcgtccgcccacgcgtccgcggactcgtgggaaaaaaaaaaaaaaaaaaaagaaggaaaaggacgaccgatactatacagcatcca

SEQ ID NO: 52887 - DNA, 374 bp, Zea mays
  Clone ID: LIB3067-040-Q1-K1-D5
gtgttgtttttttttaggccgacgaaggagattgctcggccaattgttctgtagatcaagctgacacaaattgccatagtggcacggcattgtacccagctgtggccgctgggttcgtgcacgctcagctcagttagttccgatctagttttgtaaatttgcgcgctcaaattagtttgttttcctgggacaaattggagcggaagaaacacacggacatcaagatgggtccgcgaggagcatctggagcagcatgtcgttccagacgtcgatggggccggggaggcaccagtgcacgcagtcgttgtacagcgtcacgttctcgtgcggccagtggccgtaccggctcgggtggccgtccggccgaagcacca

SEQ ID NO: 52888 - DNA, 340 bp, Zea mays
  Clone ID: LIB3067-040-Q1-K1-E7
cggacgcgtgggggggttcacatcatcctgcggactgcctgaggaggggatcacactgtcctctcaggctttcagttagtgcttatggcgttctgttagaacctgtatttgtattcctgctgggagcctgagttccattccgtgcaaagataaatcatgtgtgacgacacgtttgcaacagcatttatgcttaaactgcattaatgatgatgcgttgagctcctgaatgcctagtttttctggcgacaaaaaaaaaaaaaaaaaaaaaaaaataaaaaaaaaaaaaaaaaaaaaaaaaagaaaaaaaaaaaaaaaaaaaaaaaaaaaaaaaaaataaaaa

SEQ ID NO: 52889 - DNA, 372 bp, Zea mays
  unsure at all n locations
  Clone ID: LIB3067-040-Q1-K1-G10
ataaggcaaatgctttcaggtttaggtttctacgcgtaagagattctcattctaatccaaggtttcagataggatcaattgatctatatgggaaaaccatatgaactccccccggagctgtgtttcacttttcggctttctgaactgctcggtctcacgagcctgtgtagtatcataaattcataatattgtaatgcgagcatttactgtggacgcaacgctctcttcagtatgaatagatactgaataattaagagcatgatatatattgtttgcgcgcgcgattgagttctgaaatataagtgaagtccctcgacatgatcaaaaaanaaaaaaaaaaaaaaatagaagaaaaaaatttaaaaaagaata

SEQ ID NO: 52890 - DNA, 432 bp, Zea mays
  Clone ID: LIB3067-040-Q1-K1-G7
ttcttttcgtctctctcgctctcgccttctcggcgcagcgcagtactacgagctggcagcgccaggaacctctttccacacttccgcgctcctgcctctgtctcgagactcgagaatggttgtgtaggcgggcgcaggagggagggaggcgagagggggagctagggtttttcgccagccgccttctgttatcctcaggctctgaaccccctcctgtccggtgcgcggcggattagactccgatggggaagtctccggcgaagtggatcaagtccgtgctcttcgtgaagaagtcgtcgtccaggtccggctacaccaaggccaaagatttatcgaaaggtgcgagtaacaaaggagctgctgctgcggcgaaagagcccgtgttctctgagagctccccagtgatctcggagcctgtacttgttagcgccc

SEQ ID NO: 52891 - DNA, 438 bp, Zea mays
  unsure at all n locations
  Clone ID: LIB3067-040-Q1-K1-G8
tgtcaaagaaaatattgccaacaaatcagtattctgtcacggagtattttcttgccattcgcccaactgagagggcctggccagcggtttacttcctgtatgatctctcaccaattacagtcaccatcaaagaggaaagaaggaacttccttcattttataactcgtctttgtgcagttcttggtggcacatttgccatgacaggaatgcttgaccgatggatgtaccggcttgtcgagtcagtcaccaactcgaagaccagaagtgtactgcggtaactgcacaattcatgttaggcggaaaacagctggtaccgtggctaatgaagccaatagacggacctttgctcccaagctaacggatgaagcaatgctgatttgcatgttntattttcttcgtacatgactaactttatcatcagttatgttaaattgacac

SEQ ID NO: 52892 - DNA, 419 bp, Zea mays
  Clone ID: LIB3067-042-Q1-K1-C4
cccacgcgttcgcccactcgtccgcccaccttccgtttcacgcgtccgcccacgcgtccgtgcaaatcatgggatgcaaattagtaacagataatttattgactgctctatcaaagagctgcctgcaattggtagaacttggagctgcgggatgtaacagcataacagatgctggtatatctgctctggctgatggctgtcatcacataaaatcactagacataagcaaatgcatgaatttcctaactgaagagggagggagagagagagagagaatgttcctgtttatgtagagatggagtccaaaatttgtgtgcctgatgagttcttccccatatgatattaactgaaatagtatatcaattgaatgtattacattttaagttttaattcaatcgatcttaagagattaaaaataa

SEQ ID NO: 52893 - DNA, 349 bp, Zea mays
  Clone ID: LIB3067-042-Q1-K1-D2
ttcaagatgcgggatgttgacctacgggttttccttctaatcgggaaggtaatggatatgtgcagaccaccactcattatctatatgaccctgattaacttctgacattcgcgtttgacacgagtgggtcaatgccaacaaatacaatcacaaaggaaaggaaaaagcacgagactgttgtcctggctgagcttgatcaaagaacaagacggctgagttcactcaagatggatggatagtttgtaaaatacaagttcttgaaagctgtagtcttggcctattctgcacctggttccacagcgtatgcttcactgagcgaaaaatcattggtctaccgaatactgcgaga

SEQ ID NO: 52894 - DNA, 410 bp, Zea mays
  Clone ID: LIB3067-042-Q1-K1-D8
tgaagacgatggtgcctgcggtggtggcgtcgctggtgggcggcgtggagcggctgctggacgagggcgcccgccacgtcgtggtgccgggcaacctccccgccggatgcatccccatcacgctcaccatgtacccgtccgaggaccgctccgagtacgacccgcgcaccggctgcctcaagaagtacaacagcgtcgcgctctaccacaacgccatgctccgcgtcgcgctcgaccgcctgcagcgccgccgcccggagtcccgcgtcgtctacgccgactactacacgccctacatacagttcgcgcgcacaccgcacctctacggctacaagcgcggcgctctgcgggcttgctgcggcggcggcgggccgtacaactacaacgtgagcgcgtcgtgcgggctcccc

SEQ ID NO: 52895 - DNA, 134 bp, Zea mays
  Clone ID: LIB3067-042-Q1-K1-E12
gttctagatcgcgggctgcctctcgcgaactagaactagtctctagatcgcgcgcgggggctctttattatcaaatgttggctgcgctggcattccacttgttagcccgtttatagtgttacctaaattcaatt

SEQ ID NO: 52896 - DNA, 303 bp, Zea mays
  Clone ID: LIB3067-042-Q1-K1-G6
tttttgttttttttttttttttttttgattaagcagatgcattccttattgctccataacaagaaacaactgtcgctatgcaacccactacaaggttccagcccagcactttactgaaataaagtttgaaaatatactgtatattggacactgccatcaccatcctcaccgtcgttacaaccagcagcatctgctaattcttcctggatttcagttcttcaatccgttccttcgtggccttcaaagcatcgccgaatttgcttatgatttcttcgacttcattgggagtcatgatcaacgggg

SEQ ID NO: 52897 - DNA, 111 bp, Zea mays
  Clone ID: LIB3067-042-Q1-K1-G7
acagcggataaggtgaatgaacaaatagggacgagcaaacagaagcatacgccaccgcgacaaaacacgaaacaactgacgaatagcgagccgctaccaggtagcagccca

SEQ ID NO: 52898 - DNA, 332 bp, Zea mays
  Clone ID: LIB3067-043-Q1-K1-B6
aagccttcttatgaacaaaatttacgttttgttggtaaaatagctggtttggaaccaatcaattttattacatctgctacacctcacttgggctcaaggttgaataagcaacttcccttcctttttggtgtcccacttttggagaaaactgctgcaggaacagcacattttatagttggaagaactggtaaacatctattccttacagacaacgatgatggtaagactgctcttctcctacgaatggttgaagattgttactgactgtaattcatgtctgctatgcgctggttcaagcgtcgtgttgcctatgctaatgtaacatatgatca

SEQ ID NO: 52899 - DNA, 436 bp, Zea mays
  Clone ID: LIB3067-043-Q1-K1-B9
tacctctggcgtttaattagggaaagtagtaggacaaaaggctggaatctctttctgccgtagaagagaaaataagagtagttctctctgttctaggattgctaccttcaagttatcatgaggctttgcaacagctgcgggataaggcactgagacgagcttccatcaccgaggagcttgtggtgcagaagattgaagagaggactgcagcaaggaaggcaaagcagtatgaaaaatccgacgagatccggaaagaactggctgccataggaattgccctcatggatggccccgacggaaccacttggagaccatctttgccaattttagaggaagcggtggttgcgaaaacatgatctgtgcaagggattccaattcgacccatggacaccagttctagtcgtgtatcatggatttgctatatgtgacgaacttg

SEQ ID NO: 52900 - DNA, 291 bp, Zea mays
  Clone ID: LIB3067-043-Q1-K1-C10
tagttctagatcgcgatcggccgccctattatattcccttttttttttttttttttgtgggttttttttttaaacgaagggtgacaaaaaaataattctaatcttattcagttcaagcatttatttaataccccaattgccaaatgtcttacaaaagcaatagcacctacaagatatcgtaacacattggaacgctccggcatttggaatagcaactttacaatcggtagcgcaacgcttgcaacatttcgtgttttgcccaaaagatgcataaaaaaaaaaaaagggcgg

SEQ ID NO: 52901 - DNA, 444 bp, Zea mays
  Clone ID: LIB3067-043-Q1-K1-D9
tccacgcgtccgctttgttatacaaatcttccatttttttgcttgtagcatctgcccgggttttccctgacaaacgtgtcatcaattaatttgtaaaaaaaatgatagattaagcggcgatcggcatgctctgccgtagcgccgactcgacacacgagacagcgtgtgagcagaagaccgaggtgagatttcgtacacactcatcccaaacggtctgaatcagaaggggaatcgctggcgcgtaggctatgaatactgtgagccaaagagatttgatattttattgctagctgcagatcagagaacctgaagtatattgatttcataggtggttcttgctggatcatgttaagctccatctcttataatagcttgaacttatacatatttggtacttgttttaaatttataatgcacagattattgatattcgtatagattgag

SEQ ID NO: 52902 - DNA, 442 bp, Zea mays
  Clone ID: LIB3067-043-Q1-K1-H11
cccacgcgtccgaagcgtttgccgaggcctgcgacgccgggaacatggagcacgcgttcaaccagatgcgttccgagggcatgaggccggacactaagaccttctgctgcctgatcgacgggttcagcagggcaggccaattccataaggtggtaggcatggtgaagctcgccgagaggctcgacgtgcccgtgaacacgcctttccacaacgctgttcttggcgcgtgcgctagagcggatgatcttgtggagatggagagggtgttcaggcgcatgaagcatacgcagtgcgagcctgatgcttcgacgtactctatcttggtggaggcttatcgcaaggagggaatgaccgacaagatctatgctctgcattaggagaacccggctctggtttcagcttgatttgtcatggtttgaatgacccagtgacttgagtcacg

SEQ ID NO: 52903 - DNA, 222 bp, Zea mays
  Clone ID: LIB3067-043-Q1-K1-H6
tgattcacctgcccatagtgattgttgatggagatgtttcagagaaaaaagtagaagttcaagaccagaatgaagtgggtgggatgccctcacgacaagaggaggaggcagcaattaagaaaaagtatggaggaatattgcccagaaagactccacttatatctaaggatcatgaacgtgcttactttgattctgctgattgggctctaggaaagcaaggtg

SEQ ID NO: 52904 - DNA, 193 bp, Zea mays
  unsure at all n locations
  Clone ID: LIB3067-044-Q1-K1-B2
gacccactcgtccgcctacgcgtccgatgtgactgtctngctggaatccctgagtaccagaggtttgatatggtgtgttatactgtgaacgtgggctagcctatgatctatgtctgcagtctgcaccatatgttgaactgctggactacaacagctcggatcaaaagccgaatgtacaaaattaaccaagaac

SEQ ID NO: 52905 - DNA, 296 bp, Zea mays
  Clone ID: LIB3067-044-Q1-K1-B4
tgtcaacttacgccttgacgtcacaacatagcattcgcagctactaaacccatggccggggtcgtggtggtgttcgacttcgacaagactatcatcgacgtcgacagcgacaactgggtcgtggacagcctcggcttcaccgagccgttcgagcgcctgctgcccaccatgctctggaacacgctcatggacaccatgatgggggagctgcacgcgcacggcaggaccctggacgacgtccccgaggcgctccgtgcagcgcccgtcgtcgcgggcgttctcggcagcatcaatgc

SEQ ID NO: 52906 - DNA, 414 bp, Zea mays
  Clone ID: LIB3067-044-Q1-K1-B8
tatatgctgaagttttaggctattgaattctggtgatgcacaccacataactcagccacaaagtggtggtagaggtgctattttagccatgaagcgtgctttggaccagtcaggtcttcatgtaaatgaaattggttatgtgaatgcgcatgccacgtcgactcctcttggtgatgctgtggaggcgaacgcgatcaaatctgtatttggcgaccacgcagcatccggtgatcttgcaatatcctcaacaaagggagcaattggtcatctgctaggggcagctggatcagtggaagcaatcttcactgtgctagcaattcaccacggactcgctccgtctactcttaacctggagcggccggacccgctgttcgaaggggcattcacgccactagctgcgcccaagaagatgtc

SEQ ID NO: 52907 - DNA, 397 bp, Zea mays
  Clone ID: LIB3067-044-Q1-K1-E7
tgttgctcttctctatgcatcgtatgagtgcgataagttgcagacagcaaattttgatcagaagattggtgtgcaaatcattcagaatgctttgaagacacctgtacacaccattgcctccaatgctggggtggagggagcagtagttgtgggcaagcttttggagctaggaaacactgaccttggttatgatgctgctaaagacgaatacgttgacatggtgaaggctggtatcattgatccgctaaaggtcatcagaactgcattggtggatgctgctagtgtgtcgtccctgatgaccaccacggaatccataattgtagagatccccaaggaagaagcaccggctccagcaatgggtggcatgggtggaatggattactaagtgttaagcaca

SEQ ID NO: 52908 - DNA, 308 bp, Zea mays
  Clone ID: LIB3067-044-Q1-K1-F7
tggtagtttccgcacctccaccatcaccatggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcccgaagtcggcgacgagaggccttacta

SEQ ID NO: 52909 - DNA, 289 bp, Zea mays
  Clone ID: LIB3067-044-Q1-K1-H3
tactttcttgagctgttgaatgaggaatttgatgtacttttaaagctcccaactgacaaggcactgttatcagatcctgaatttaagcgctacgtggagctctatgcaaaggatgaaaattccttcctcaaagattattctgaatcacacaagaaactctctgaacttggcttcacgccttgcaacacaacaccattcaaatcagatctttcaaccggcggcgtgcttgcacagaatgcctttggggtaacaattgctgcaaccgcaattattgctggctacttgtacc

SEQ ID NO: 52910 - DNA, 440 bp, Zea mays
  unsure at all n locations
  Clone ID: LIB3067-045-Q1-K1-A10
tctagtgcacctgattgtatttctcagtgttagatgctttacatggggtattaacaagatagtactgtaacactagagacaactgttgctaacttgatatacagaagagttccactgttggagcagcaagagtgcagtaattcagattctgtgatttgactcaataattgacatgattgcattattgagattataacttggagctgattatattcgttatctatgatagaaacctccaaatatgataagtttccctgtgaaaccatgctattttagccacgctggagttggttaaagcaccagttaacaacttccttttatgcataaaacaggagatgaacctggaggcacctncagcattgggaggtggatgtgcagcccccatgctaggagattcgatggaaaaggctccaagctcaccttggatgcctntctccatg

SEQ ID NO: 52911 - DNA, 91 bp, Zea mays
  Clone ID: LIB3067-045-Q1-K1-A2
cccacgcgtccgcccacgcgtccgcggatgcgtgtgaaaaaaaaaaaaaaaaaaaaaaagggagaataaaaaaaaaaacagaagagacaaa

SEQ ID NO: 52912 - DNA, 76 bp, Zea mays
  Clone ID: LIB3067-045-Q1-K1-A4
aaaaaaaaaaaaaaaataaaaaaaaaatttaaatttaccaaaaaaaaaaaaaaaaaaaaagggaaagaaaaaaaaa

SEQ ID NO: 52913 - DNA, 70 bp, Zea mays
  Clone ID: LIB3067-045-Q1-K1-B12
aataaaaaaatcactttaaaaatttaaataataaaagcaaaacaaaaaaaaaacaggaaaggaaaactga

SEQ ID NO: 52914 - DNA, 267 bp, Zea mays
  Clone ID: LIB3067-045-Q1-K1-B2
ttctagatcgcgagcgtacgtccgagattgatttgctggctcagaaggtagcgatcaggaatgttcttgtactaaagcgatcgtctgtatgggggatcaggaacgtacttggaacaacccaaggtttggtgacgatgacaatgtaaataatagaggtggctttggacgcggaaatcaaggcagagggagagggaggagttttgggggtggtggtggatcatcatggaatgaaggcaacagaaacggtgaattacgtggggtaaggtc

SEQ ID NO: 52915 - DNA, 363 bp, Zea mays
  Clone ID: LIB3067-045-Q1-K1-F7
ggcaagctgcataatttgggcgctgcgttagagctcaccgagcagcaggccaggcagctcaacttcgacctcgactcggcctacagtgcctttttggctgcgctgcccgccgctggtctgtaaccgggcgtggacctggttcgttctttacttctattacagtactatagatatctgtaatttcggtactgctattttattgttaataagaaagttctgttttctttatatactgtaaatatgtttatcgcatgatatacattcacatgacaacgcttgcaaatggcctgtagcctgtttacttgggtaaaaaaaaatatgggtataaggtgaaatgataagaagataggtagtggtaggtga

SEQ ID NO: 52916 - DNA, 175 bp, Zea mays
  Clone ID: LIB3067-045-Q1-K1-H10
aaaaaaaaaaaaaaataacaaattgaaataaaaaaacaaaaaaaaaaaaaaacagacaaggggcaaccaaagaaagggacgcgcaagaaaacacacgcacgcaggcaacaaaagcagcgcgaacagagggagaccaaaaaagcaacaagccgggccaacgattgacagcggcggc

SEQ ID NO: 52917 - DNA, 438 bp, Zea mays
  Clone ID: LIB3067-045-Q1-K1-H7
tcatcagctaacagttcacgccttgcgctgccacaaagctcgcttatgtccattgccttcacgcggcacgcggcggccgggcttccgacgtcatggccaccaccaccggtgccgtcctgctcgtcttcctcgttgccattgccacgtgcgtctgccgctcaccattccccatcctgacgatggctgcggacgcggacaacggcaccagccacctgagcttcttcatgcacgacatcacgtaaggcgccagcccgaccgaagtgaaggtgatcaaggggcccggcgcggggtccacgctgaccgcgccggcgctgggcatgacgttcggcgacaccatggtgatcgacgacccgctgacggaggaggcgtcgcccgcgtacgccgagctgggccgcatgcatggcttctacatgctggcgtaccagaccggggcggtgc

SEQ ID NO: 52918 - DNA, 64 bp, Zea mays
  Clone ID: LIB3067-046-Q1-K1-A7
cccacgcgtccgcccacgcgtccgaaaaaaaaaaaaaaaaaaaaaaaaaaaaaagaaaagggaa

SEQ ID NO: 52919 - DNA, 215 bp, Zea mays
  Clone ID: LIB3067-046-Q1-K1-C10
ctttgaatgactggttcatcaacatgtgtctgtgtagtacgttaggtgttcgttgtatctgggtatgtgggttgctgtaacactgctaaactaagttactcttgtgtttgctaaggattaagttctgtatttgttgctataaaaggtgcatactttgaatgactggttcatcaaaaaaaaaaataaaaaatggaatgaaaataataaattaaaaa

SEQ ID NO: 52920 - DNA, 226 bp, Zea mays
  Clone ID: LIB3067-046-Q1-K1-D2
taacatcgtcctatttgtctctcacccaattcgtttcaaaaggttacgctagctcactcgagctggacgtccttagctctccacttactgtactattctacatctgataattcccgattgctaagctccatcgctgcagctactccgaccactttgagggcactctctcttacattacgtgtgattcctcgatgaccagtaagaccaggttatatctccaccatgg

SEQ ID NO: 52921 - DNA, 96 bp, Zea mays
  Clone ID: LIB3067-046-Q1-K1-G5
aaaaaaaaaaaaaaaaaaaaaaaattaaacaaaaaaaaaaaaaaaaaaaaaaaaaggagaagggaaaagaaaaaggagtaagaataaagaaaatac

SEQ ID NO: 52922 - DNA, 434 bp, Zea mays
  Clone ID: LIB3067-047-Q1-K1-A12
tttcgcccgtcgcgcccctgcgactgcgactgcgacggagagccagtggggtctgggatgagacatcgaaatgacgctttgtgattcttaagctcatccatttcttgtcagctgcacggatgacaaactaagttctctattgtgttgacgggtgcagttggatgactgggtcctgtgccgcatctacaacaagaagggcggcgggctggagaaggcgccggcggccggcggcgaccacaagcctgtgttcgccacggcggcggtgagctccccgccggagcagaagccgttcgtggcggcggcgggcgggctgcccccggcgttcccggaacttgcggcgtactacgaccggccgtcggactcgatgccgcggctgcacgcggactactccagctgctcggagcaggtgctgtccccggagcagctggcgtgcg

SEQ ID NO: 52923 - DNA, 236 bp, Zea mays
  Clone ID: LIB3067-047-Q1-K1-A8
cccacgcgtccgcttgggccgggccggccggtccgcctcacggcgagaaccgaccggcgcgacccttctgccggcgatgcgctcctggccttaactggccgggtcgtgcctccggcgccgttactttgaagaaattagagtgctcaaagcaagccatcgctctggatctttagcatgggatatcatcataggattccggtctctatcgtgttggccttcgggatctggttcggaac

SEQ ID NO: 52924 - DNA, 425 bp, Zea mays
  Clone ID: LIB3067-047-Q1-K1-C12
taagaacccaaaggatcccctttggctggctgttttcccagaaggcactgattatactgagaagaagtgtatcaaaagtcaagaatatgcagcagagcatggtttgcctgttctgaaaaacgtactccttcccaagacaaagggtttcaattgctgtttgcaagtgctgaggagtaccatagatgctgtgtacgacatcacgatcgcctacaaacaccggccgccgacatttctggacaacgtctacggcgtgggtccttcggaagtccacatccacatcagcagcatccaggtctccgacataccggcgtccgaagacggggtggctggctggctggtggaacggttcaggctcaaggacgagctgctgtcgggcttcttcgcgctgggccactttcccgacgaaaggaaaaggacccgagggg

SEQ ID NO: 52925 - DNA, 66 bp, Zea mays
  Clone ID: LIB3067-047-Q1-K1-D6
tgactcgccctgtaacggtgcattaaactctgcgggagtcgtggttacacgcagcttgaccactac

SEQ ID NO: 52926 - DNA, 290 bp, Zea mays
  Clone ID: LIB3067-047-Q1-K1-G3
cccaggcgctgcgagccgaagaagttcggtggtcgtggcgcccgcgccaggttccagaagtcctagggttgagcgctcggctgcccgcgcttgccgtaccgatgcctgtgttgtcccaacttgccagttcgatgcctgtacccgtggcttaattctctatcatcggagctacttatgtggttctattactagatgctgacttactttcaacttgtgctgttgtaccttcatatttggactttttaagccttgtgtcggacgcctttggcattgaaatatgagagatcttg

SEQ ID NO: 52927 - DNA, 54 bp, Zea mays
  Clone ID: LIB3067-047-Q1-K1-G6
cctacgcgttcgcccacgcgtcctcccattcgtccgatcactcattctgatcgc

SEQ ID NO: 52928 - DNA, 337 bp, Zea mays
  Clone ID: LIB3067-047-Q1-K1-H11
cggacgcgtgggcggacgcgtgggcgaccgtaccggattccgtggtttcttttggaaaggtgccaggataggtgagcgattgagcccttgggtatcagtcgggtgcttggctatgggaatatccactattttcttctaaggccgaagtgttaatctccacatatttagtctaggacgcagcaccttgtttcacttgtagagaaaaaaaaactatcgtaagcattttgcttcagtttttaatggaatgggcactgtaagatctgtatctgcactgagatttctgagattaacaaaaatgttttctcataagatttctgagaaaaaaaacaactacata

SEQ ID NO: 52929 - DNA, 442 bp, Zea mays
  unsure at all n locations
  Clone ID: LIB3067-047-Q1-K1-H5
cccacgcgtccgtatgaacttaactgatgcatttgataatatgatgatttcttttgagcctgttcattagatgtaaattaacacagtatccatttacaaccaattcttttgcatttttacaattgaccttttcattttcatataaaatattggcatattcacaatatactgaattgtgaacttgtcaaggattcaagggcatgcaattcttgaacgttttagtggaatatgaaagtctcatctggtcatacaatatgtgagtctgagatgattcatattttatgccacttttttacattttcaaatgtctctgttgtgttgattggtcacctatatcctgctgattttgcacacatcangagttccaagtaggtatttacaccattcttcctactagtaagttttctataatctgacaaatttcgtggtgcctatgctaatg

SEQ ID NO: 52930 - DNA, 433 bp, Zea mays
  Clone ID: LIB3067-048-Q1-K1-A12
gcgcccacgcgtccgaagccggagaattcgcccttaggagcacaagccgacgccgaccgcgtacgcccatagccccaaacccacgccgacgacgtacactcccaccccgacgccccccaagccgacgccacccacatacactcccgaccctacgccccacaaacccacaccaaaacccactcccactaatacgacgtacaccccgacccacaaggctccgacacctaagccgaccccaccaacgtacactccaaaccccaaacgctagacgcccaaaccgaccccagctacttacaccccttgccgcaagccttcgacacctaatccgaccaactctacgtacactccaaaccctaagccacctgataccaagcccttcacgcccaatccgaccacgtcaacgtacacccattcgccaaagcctacgacaccc

SEQ ID NO: 52931 - DNA, 422 bp, Zea mays
  unsure at all n locations
  Clone ID: LIB3067-048-Q1-K1-D5
cccacgcgtccgcggacgcgtccgcccacgcgtccgtacccgccgccgcagccatggcggggaccaaggtccagcgtattatgacccagcccatcaacctcatcttccggttcctacagagcaaagcgcgcatccagatctggctattcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaggaacgatgtttggtgctcgcttcgattatctgtgacacaatgtactccattcatgcgtncagacttaaatgatgtatcatggtcatg

SEQ ID NO: 52932 - DNA, 66 bp, Zea mays
  Clone ID: LIB3067-048-Q1-K1-E7
aaaaaaaaaaaaaaaaaaaaaaataaaaattaaaaaaaaaaaaaaaaaaaaaaaaggaaaagaaaa

SEQ ID NO: 52933 - DNA, 447 bp, Zea mays
  Clone ID: LIB3067-048-Q1-K1-G11
tggatgggaaagaaacaagagtcagttgaggatgttccttgtggtaacactgttgctatggttggtctggatcagttcatcacgaagaacgctacactcactaatgagaaggaggttgatgcatgcccaatcagagcaatgaagttctctgtctcccctgttgtgcgtgttgctgttcagtgcaaggttgcttccgaccttcccaagctagtagaaggtttgaagcgtctggcgaagtccgatcctatggttctgtgtacaatggaagaatctggtgagcatatcattgctggagctggtgagcttcatcttgagatttgcctgaaggatctgcaagaggacttcatgggaggtgctgaaattattgtttctcctcctgttgtgtccttccgtgaaaccgttcttgagaagtcctgccgcactgtcatgagcaagtcacctaacaag

SEQ ID NO: 52934 - DNA, 448 bp, Zea mays
  Clone ID: LIB3067-048-Q1-K1-G4
tttaacttatttaagctggattatataatctagagggtaaacaaacaaggcaagtttatgatgtggttctattagtcattgaacacatttttacagatagacagtgaattaagcaaagagatagaacaatggaatgacatgctgaggactgaagtagtaaagttgtgtcaagacaacaattttcaaacaggtttttttgaaggcactgataatagcactgttgttgatgcttacgagttgaaggtaaatctaaatgtacactctgtactaactacgtgtacacattaattgaacctatcgagcaattctgttgttaggttcgacttgagcacattctcgagaggatatctttgatctctgatgctgcaagtactgagcgtccatcacagatcacagattacctgtatattggtggtgctcttgctgctcggtcaacacacacacttaa

SEQ ID NO: 52935 - DNA, 254 bp, Zea mays
  Clone ID: LIB3067-048-Q1-K1-H5
aagagacgtccagctggctgccatacatatgtatcgtgtggtgtgtgtgtgagagagagggaaacagagttcttcagtttgctatctctctctgcatgtttggcgtcagtctttgtgctcatgtacgtgtgtctacatgcatgttggttgatccgattgcgtctgctgctaccatatattaattggaccacgatgatatgatttgatactatatatatatactaaaaccggacttattattatgaaaatacaat

SEQ ID NO: 52936 - DNA, 273 bp, Zea mays
  Clone ID: LIB3067-049-Q1-K1-A12
cggacgcgtgggatgagatgtttctataggattgtaggtggggccatagcagaaagagggtgccggggtaaaatgcccacgagtttacttttgcagtgagtatgtcaatctaagctggcagatacttgatttgtaatagtctttgcgtgtgtttcgctcttcatgtggcatgttcagtttgatctatagttgtatctttcactttcacactgaaattgaaaagtaaagcgcaaatttccttgtaaaaaaaatgaacagaaaaaaaaagagaag

SEQ ID NO: 52937 - DNA, 434 bp, Zea mays
  Clone ID: LIB3067-049-Q1-K1-A3
gacgggccggctcggcggcggcgtcagcatttccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgcttgagcacgtacgctagcagagcagcaccttaatgtccttgggtttgctttgctggctctctggtttcgtcttggggtgcttttaatctggca

SEQ ID NO: 52938 - DNA, 458 bp, Zea mays
  unsure at all n locations
  Clone ID: LIB3067-049-Q1-K1-A5
gacgggccggctcggcggcggcgtcagcatttccaacgccgccaacatcccnacaggtgggctatttccgtcggtgtgcccatcatccccaccagcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaa

SEQ ID NO: 52939 - DNA, 448 bp, Zea mays
  Clone ID: LIB3067-049-Q1-K1-B12
tattatctcaaaaaaaagtcttgagtcccctctctccttccccttcccaacgctctcgctggagaggaaatgcgaagatggcgatgaccgtcgaagtgcttgctgcactcgcgttcatgttctccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcatgctggcttaatcgagaccggggccatgttcatcgagttcacgttcttcttcatcctttgatgcacagtgctgtgcttccataaggcgactctggatga

SEQ ID NO: 52940 - DNA, 275 bp, Zea mays
  Clone ID: LIB3067-050-Q1-K1-A1
ctttttttttattatatggggctacagttacaggccgtcaccaccaatgggctacaggagaagggcgcgctttccaagtactcatgatcattatggtggtcgttgtagggatctttcaacccgaattctgtcacgaatctccgtcgggactgtttttcacaaaaccttcgtagaccatttggacactttgttcgagttccagatttatatcttccaagagattattacactggacgcaacacatgcctacaagattattgttgaagaccacgatt

SEQ ID NO: 52941 - DNA, 101 bp, Zea mays
  Clone ID: LIB3067-050-Q1-K1-B10
tccagttttaaaacaactgagaaattgttgttttctccaaactgacaaatgcttacgggcgggtaattattgaaaggtcagagaacttctacagtgccttt

SEQ ID NO: 52942 - DNA, 276 bp, Zea mays
  Clone ID: LIB3067-050-Q1-K1-D7
ggcgtgccggctcaagcgcaactgcttcattgaggaggacgactccgcctactacggggtgcttctgctcgcctgcgtcgtctgcgccccctccctttgatggtgataaaaatacttttgtttacttcggccgcctgcttgtaactaatcaacatgtggatcaccatgccgcatgcatgtcagtctgtcgcatcggaaacgttcgctatgtaatgctgtactggtcgtcgattcgtctctctgaatgagtgtttggcagcataaaaacatgaacat

SEQ ID NO: 52943 - DNA, 273 bp, Zea mays
  Clone ID: LIB3067-050-Q1-K1-D8
gccgggcctgctcaagcgcagacacttcatttaggaggacgactccgcctcctacgggtgcttctgttcgcctgcgtcgtgtgcgccccctccatttgatcgtgataaaaatactttagtttactttgcccgactgcttgtaactaatcaacatgtggatcaccatgccgcatgcatgtcagtctgtcgcatcagaaacgttcgctatgtaatgctgtactggacgaccattcgtctctctgaatgaatgttcggcaccatactaaaatatac

SEQ ID NO: 52944 - DNA, 63 bp, Zea mays
  Clone ID: LIB3067-050-Q1-K1-F9
cccacgcgtccggtaaaaaaaaaaaaataattaaaaaaaaaaaaaaaaaaaaaaaaagggaag

SEQ ID NO: 52945 - DNA, 449 bp, Zea mays
  unsure at all n locations
  Clone ID: LIB3067-050-Q1-K1-G9
tcaaagagcgtttttcaaaaaagtaccgacacccattgttggactcgaagttgactctaaagcgcttaaatgctgaagctcggtgcatgacaaaagcaagaaggcttggtgttcctaccccagtactttatgctgtggatccagttctgcatactttgacctttgagcatgtggatggcttgtctgtcaaggatatacttcttaggtttggttcagatggggtcaatgaggaacgcctgaatgatattgccacacaaataggaaatgccattggcaaacaacatgatggaggccttgttcatggtgatttgaccacgtcaaacatgataattaagaacagtaacaatcaattggttcttattgattttgggctgagtttcacttcgacaattcccgaggacaaagcggtggacctatatgtgctagagagagctntgatttccatgcat

SEQ ID NO: 52946 - DNA, 229 bp, Zea mays
  Clone ID: LIB3067-050-Q1-K1-H11
cggacgcgtgggggggctgtcatgaattgatttccctgatggtatcattcagagaacgtagattctgggcattcctggatcgagttaaataagagccgttcctggcatcctgcaagttcagtgccgcttccttttacttgattttgtaaaccggagactgtaaatgtgcttgaaccgtgcttttagacccatgcctgaaatcctgcatccaataagcgtctttgaagtg

SEQ ID NO: 52947 - DNA, 183 bp, Zea mays
  Clone ID: LIB3067-051-Q1-K1-B2
cgtgtatgctactagccagttgtattgcacgaccggtcctaaagaagaggtttctttctggtcgctaaaaaaaaaaaaaaaaaaaaaaaaaaaaaaaaagggccccccaaaaaaaagaacacaaacatacatacacgtccatgcaacaccataactctacaataaagccacctaaataaaatt

SEQ ID NO: 52948 - DNA, 327 bp, Zea mays
  Clone ID: LIB3067-051-Q1-K1-C1
tgacgcgtgggcggacgcctgggaacaggatatggtgcacgtgtgaccccttatgacgagggagctgttgtaaatgacatcaatccatacaacaaggatatgttccctgattttttgagatggctaccggagagaaacctttcaagcgatgatcggacaatgcgcctaaaagaaggatacatcaaggaaggtatcactgtgagtgtgatgggggttgtccaaaagaatgacaatgttctgatgattgttccttcatcaaagcccatctcaactggttgtaagtgggccaaatgcaatttcccaaccaaccttaaagggcttatttta

SEQ ID NO: 52949 - DNA, 442 bp, Zea mays
  Clone ID: LIB3067-051-Q1-K1-F6
tccacgcttatcatgccagcgctgtcgattggcaacgtgggtcagctcgccgtcgagctgctcatatcctcgtcgagggcgaggcgggtggcctacctcgacgagccctccgtgctgccctgcgccggtaacgacgccttcggccctgacgccgtcggcgacctcgcactcgctctcgaagcttatgaatctacatctcataagctgggtttcattcagcaaaggtctccagttactacaggaatgatggtttcatttgcaaaaaatgttgctgatttcataagcagcatcgggaagaaccatattgtcattatatcaagtttagattctggaaagaggagagtgattgatgcatccagtgacatgcaggtgtattacctttcaagttgcaatgaagatggttctgatccagaatatgagaaattggggtggaaaaagcttg

SEQ ID NO: 52950 - DNA, 241 bp, Zea mays
  unsure at all n locations
  Clone ID: LIB3067-051-Q1-K1-H4
tcacaacccagtcgctcaaaaccctagagctctcgcctgctcgcctccgccgccggagcgagctgcccatcttcatccgtcaaccatggcgacccanatcagcaagaagaagaagttcgtcagcgacggtgttttctacgccgagctcaatgagatgcttaccccggaacttgccgaggatggctactctggcgtggaggtgcgcgtcacgcccatgcgcacggagatcattattcgcgcc

SEQ ID NO: 52951 - DNA, 89 bp, Zea mays
  Clone ID: LIB3067-052-Q1-K1-A8
tttttaattaccgtgccccgtggtaattaattatgtacgtacttatatatgtatatacattacgccgaagaggaaggagcactttgtat

SEQ ID NO: 52952 - DNA, 554 bp, Zea mays
  unsure at all n locations
  Clone ID: LIB3067-052-Q1-K1-C12
gacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttacatcttaagctgctgatagacttcaaataaaatcttgtccaagaaaacattctgtgagcgtacatgttgtcgtcgagctgtgtaattgagcaaatcgtcagattgaaactcggtgtctgccttgttcttcaaataccgcttatccagacggtgcttttgttttgaaaaaaaaaaannnaaa

SEQ ID NO: 52953 - DNA, 228 bp, Zea mays
  Clone ID: LIB3067-052-Q1-K1-C2
tccacgcctccgagcacgccttgccggccgcctccgtatgagcgcggcgcgccctggggtccatcgcgcattaaaaacggctcccgaaggcaccctgcgtgatgcgtgccggctgtgttcaacctagcagcgcgttctctaattccacggcgctgaacggctgctaatcttcgaccttctcgccgacgcctatgaattagactgacacctgtcgttgccgctctatcg

SEQ ID NO: 52954 - DNA, 273 bp, Zea mays
  Clone ID: LIB3067-052-Q1-K1-F3
gtgcagcattctggacaatgaggaaagatgcatctcggtcaaaagcttgtgagcctcggtggagtgaagatcatccatggcggacgatcaatttgtgccatcattattcactggcgcattcaaactccacacaagccgtgccagactaagttagatagatatatcagatgagctgcctgattcacagaatataattggcttaacataggaaaggaggtgctgagccacgctagctagctcatccttttctcctaaaaaaaaaaaaaattttaa

SEQ ID NO: 52955 - DNA, 579 bp, Zea mays
  unsure at all n locations
  Clone ID: LIB3067-052-Q1-K1-F9
tccaacttagaggttgagaaccaagttcttcgtcaacatgcaacttcaactccaccgtctacgtgctaaatctccagcttcacgctcaaagatctcaaggatccatagaagtccagagaatggccatattttgaatggtgacattaggcaaactgaaatgaagccctcaactggcacatcagcagcaattacctcagtagctaatgttcctgacttgggcgaccaaaaggagtttgaacatggagaaaaactgcaaagaataccaaaacagaaatatcagccttcccataaccagcagccccaagacgatcagcagtggctagtcacttgtatttcacaatatcttggattttctgggagcaaacctgttgcagctctccttatataccaatgtcttctccattggaaatcatttgaagccatgaagacgggtgtctttgatagcattttgcatgctataaactcagccacagaggttcaaaatgacatgagaacattggcgtattggttgttcaacttatctacattaacagttttncttcaacggtcattcaaaactactaggaccacaatcttaac

SEQ ID NO: 52956 - DNA, 422 bp, Zea mays
  Clone ID: LIB3067-053-Q1-K1-A11
tcgactcgcatcgacattgctagagttgcgattcctgaggccatggagcagcagacaatatctattgccaaagctgccattacaataatactcattttagggacttcatttcttgcagctgccaatccaattgcaagatgctatgacgctcttaagatcagttctcatattctataagcatttatctcgagtcagcaattaggaactgtgatggtttttaggtcaccgggaaggttgttgagaagatcttggactgggagagaagtgcacagaagcaagttaaaatcctgttgaagcccgctcatgtcatcctgcaacgtctattcaattttttcttattccattttgtgacgttatgactaagcatgccaactggcatccttagcccacttcttatcgagcttgggtgcataccacatgta

SEQ ID NO: 52957 - DNA, 172 bp, Zea mays
  Clone ID: LIB3067-053-Q1-K1-B8
ctgacgcgtgggaaaaaaaaaaaaaaaaaattaaaaaaaaaaaaaaaccattataaaaaaatcgcaacttgggaacacatacatgcaaacatcctacctctcctatactgtcacctaaattcaactcacttgccgtcacctaacaacttcttaactgccaaaaaccttaacc

SEQ ID NO: 52958 - DNA, 373 bp, Zea mays
  Clone ID: LIB3067-053-Q1-K1-C11
gcaagaaacacactgtactgcttgtatggcacagtctgacgcgatatacagaaatacaacgagtgtcaaaacagtagtaaaacatcacaagtctaaaaacgacgtgttctccagcgacaacagtgggctggactggacacaatcggcagggaaatgtacgtcgaaatcaacagaaggcacccgagctttatttttctgtgatggaaatgatgaacgtctcaggaaatagtttgccagaagcccagaactgtgtgctctagggctcgaccaccatgctctccgcttccttcttgatggactggaacagcaccgatgagaggtagcgctcgccgaagctcgggaacacgtactcaaatagctttccggcgttttc

SEQ ID NO: 52959 - DNA, 226 bp, Zea mays
  Clone ID: LIB3067-053-Q1-K1-C2
taaaaccacggtattgcttaaaatcgagatgtctttggtttcattagaaaactgaagtattgatagagtatttcttttttttactgatgtcctgagtggagtttccaaaactcctaaaataccaagtttccaaacagtgtcatatgacaactgactttgctttttagcgtttttcaagattaaagttttccattcttttctatttaccttttacatgcggttattt

SEQ ID NO: 52960 - DNA, 188 bp, Zea mays
  Clone ID: LIB3067-053-Q1-K1-D12
tttcccgtgtctacccactcgtcctcccactcttcctataagttgctttgttcaaaaaaaaaaaaaaaaaaaaaaaaaaaaaaaaaaagaaggataaaatataaaaattcacaatcttacatacacttacatactacttcataaacactactatagtatcacctaaatttaaattcactgtctctaat

SEQ ID NO: 52961 - DNA, 299 bp, Zea mays
  Clone ID: LIB3067-053-Q1-K1-F4
cccctcttctccgaatctggaacgtgttgttcatcttggaccaccccctaggcggggcatgttattactagtataatgctagtgtccgcccattgcttaatctggaatgctaccagccagatctccatgctctcctgttagccactcggcagagtgaggattactaggtagggtggcatgtcatgtgctccaccctccactggtacgagtcaatcaactaaagctacccccggattgatgaggaacatcccgcgcgattagtggggcatgtcattaaaaaaaaaaaatataaattaaaa

SEQ ID NO: 52962 - DNA, 376 bp, Zea mays
  Clone ID: LIB3067-053-Q1-K1-G5
actagttctagatcggcgccccgcacatgctccactactgatgattgcctccaccaaccacggcaccatgcatctgaggctgtcagctggggctggttggcaacaagacaagaagaattggctgcctctcaacaacattcacatctactacctacctggctgctttgagaattacagggcctctactatctgctgctgtgttaaatctacctcctggtttctccaataattgtcgctgttctgtactcttctcttatgttctgtctgtcagtgtgtatgagatgatgctcatcttatgttataaggcttaatcatgtgtctagttgtactttctgtcttgtaatgttatcagttatatgaataataagtgttatgt

SEQ ID NO: 52963 - DNA, 446 bp, Zea mays
  Clone ID: LIB3067-053-Q1-K1-G7
tccaaagctgctctcgcccccataaataaagcagctcctccgggggcggcgaactactcctggtcgcctgaaccctagtcctgcttctttgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagaattggcatccgaatggttatcctgatggacgtgtttgcatttctattcttcatccacctggtgaagatcccaatggttatgagcttgcaagcgaacgattgacaccagtgcacac

SEQ ID NO: 52964 - DNA, 415 bp, Zea mays
  Clone ID: LIB3067-054-Q1-K1-B7
tgatctccaactccaccagcgtcgtcgaggtgttctcccgcatcaacagcaaggtcgacgtcatgtacgccaagcgcgcgttcgtgcactggtacgtcggcgagggcatggaggagggggagttctccgaggcacgcgaggacctggccgccctggagaaggactacgaggaggtcgccgcagagggcggcagtgatgacggcgacgaggaggaggaatactgatctgcttgcatgaatctgtttggctgtcgagccaggttgtggtgttgaaaaacctttgtttgtgtcctgggtaatgtttgggtgtttccttccatcatcacttgctgaactgctctagtatttgcatttgtaattgaagtctgtcgctttaagcactcttggttctaaagatctctgtgcttttggggggt

SEQ ID NO: 52965 - DNA, 65 bp, Zea mays
  Clone ID: LIB3067-054-Q1-K1-F11
cggacgcgtgggttgttttgtttttttttgtctgtttcttgctgaaaaataagcaaaaaaaggag

SEQ ID NO: 52966 - DNA, 218 bp, Zea mays
  Clone ID: LIB3067-054-Q1-K1-F2
gttgctacattgtcgctttcaacaagatctagagttcagtttctgagtttgggcaactgcagctgctcatctcgtcaagtttgtgctgtgatgccagtttatcccttctagtctattacataaatgttgttcggatctgagtctattataaacatctttgtctgagtttattgtttactgatgccagtttttttcaatatacatttatcttaaataaa

SEQ ID NO: 52967 - DNA, 439 bp, Zea mays
  Clone ID: LIB3067-054-Q1-K1-G1
tgctccttgatgtcgtggagggcgttcaagagatttacagccagcgcgtgtatgtcgtactgtccaggtgttccctttcgtgccattatattccccaaaagcgagaatggaggcattattgatctccggttagggcatgaatttttgcagacgatggccagctgacgtagggttttgaggtatcagaatgtgcataatcatgtttatgttgtacaggtgtaaatcagccaagttattgattacaagtgtgacatgagaaatacacattaataaaaactccagctcggttgtacagagattgtgtttgaacccagaaattcatgtggttatgtcgtttgataatatatgtacctggcaggggtgaagctaggccttttttttgtcagctggccttgataattttctggatatctaatgaaaaaacgatgtcaataacaag

SEQ ID NO: 52968 - DNA, 309 bp, Zea mays
  Clone ID: LIB3067-055-Q1-K1-B10
cccacgcgtccgtaaaattccccattccaactcacacagatctcgtacccggcagtggggacgaatctcgcggggcggaggtggtggcccgactgaagcggtgtcgactccgacgaactcgcagccaccgggggatacgcagcagcagcaccggcgtactccatcgacgttcatatttaaggacttggtttggataattctactcgtcaacaaaagtgattaaaaatggggggtcttgcagcttcaatcgtttcaaagtcgggaaaagcacttgtttcaagacagattgttgacatgtctcgcataaaa

SEQ ID NO: 52969 - DNA, 66 bp, Zea mays
  Clone ID: LIB3067-055-Q1-K1-C11
cccacgcgtccgaaaaaaaaaaaaaaataaaaaaaaaaaaaaaaaaaaaaaaaaaatttgtaaatt

SEQ ID NO: 52970 - DNA, 202 bp, Zea mays
  Clone ID: LIB3067-055-Q1-K1-D2
cccacgcgtccggacccacgcgtccgttcacgcgtccgaaatcacaggaatccctcggggaactatatgtgatgaatgatggcatatcagaggaagctgcgaaagctctatctgagcttattcctgcaactgagaagcttaaggttctccacttccacaacaacatgacgggagatgaaggtgctattgatattgctgagat

SEQ ID NO: 52971 - DNA, 325 bp, Zea mays
  Clone ID: LIB3067-055-Q1-K1-G7
gaccgctgctccggcggtggagaccgtggtcgtcgtcgctaaggagccggtgccggggcgggccgagactgagtccaaggaggtcgaggtcaaggctgaggccgaggccgaggccgtagctgaggctgagccgaccgaggcagagcccgaggccgccttgccggcagcagagacggaggccaaggaagcagagccggaggccgccttgccggcagcagagacggaggctgctgctgccccggtcgaggctgctgagccggagatagccgccgagaccaaagaggtggcggctgtggaggctaacgaggaagaagaggaggcagcg

SEQ ID NO: 52972 - DNA, 117 bp, Zea mays
  Clone ID: LIB3067-055-Q1-K1-H2
cggaaacccggggggacccacgcgtccgggcacgcgtacgcgagcctgcattgttctccaggataaaaagaaaaggacaaacagtgtctaatacaaaaagaggtgaagggacatcca

SEQ ID NO: 52973 - DNA, 430 bp, Zea mays
  Clone ID: LIB3067-056-Q1-K1-A10
tccagatcatccaggctcccagaatcagcctaagtgtgtcgtgccagcatgaaaggcacggccacggcgtgcccgtgtcggccccgaaaaatcaaatacacaaacttataggctcttaagcgtgttgcgcggacgggaggggtgtaagaggagcctcagaggggaggaaggagagggaagcggtggctgggaggtgagcaggtggcgtcgtgatggatgggggcaagggcgagtatgggagaggtgatagttggagtcaggagatggggatgggatgagcctatctcgacaggagtggggagtttagtaggttagactatagttaatgcgggagccaaatggctaggagaaaatttacctttgccataagcctttttccctcttttgtcttgaaggcctaaatccctcatttgggcctattggtgtttta

SEQ ID NO: 52974 - DNA, 175 bp, Zea mays
  Clone ID: LIB3067-056-Q1-K1-B12
taaccctctctcttcacgagaaggttacgctggtgctgctatctgctgtgctgtaacatgtaggctcctttgtttctgggagttcaacggaaggtctctgtatttttacatatatcgagtgtgacagcaaattcaagagaaaaaaatatcatctgcaaatgttataggcttgtct

SEQ ID NO: 52975 - DNA, 263 bp, Zea mays
  Clone ID: LIB3067-056-Q1-K1-C12
tgtgtagtatttgttgttatttttatcaagattatttctcaaattgtagttttccatcagggtctagttactttttcttggtgggtagttagtggggacacatattagcgcaccattctttttggcagaatatttagcaagtttgtatacttcaggggtatgcagaatgaagtgctgttgcaaacttgctgtgtaactgccaatggcacaattgtttgtattttgcactataatgttgcacaaaatgtcggattgcaatcctc

SEQ ID NO: 52976 - DNA, 419 bp, Zea mays
  unsure at all n locations
  Clone ID: LIB3067-056-Q1-K1-D10
taattcttgaagtccttggtgctgcagattcagactcacttaccaaactgcagattgataccttttcttcagaaaaacttttttggagcaatgttgtgttccaaaaattatctaagcctgcaatccacttgtcaatattttgaagtaaatctttttaaggtgttgccgaatagagagattgaatacctatcggtagaatataattcataatcacaactgatgatgatggcatcaccttctccgagacaaacttcagaccacaagacaacaagttgaggaagcaagggaggggaatggacttggcttgactcacgttgggtacggtcatcggtgtaggtgcgaccggacttgggttgactcatgtcgcggctttgtcttggactgcggngctggtggaagccactggcgaggagacggcg

SEQ ID NO: 52977 - DNA, 298 bp, Zea mays
  Clone ID: LIB3067-056-Q1-K1-D2
tgctttctaaacaaacgcaggtgcagtgtggtttcgggcgcacaggccacctctgggcgcacgaggcgtacggagtggaaccagacataatgaccttagcgaagccactggccaacggcattcccatcggcgttgtcctggtgaaggagaaggtcgccgcagccataaactacggcgaccacggcacgacgttcggcggcgggcctctcgcctgccagaccgcgataacggtgttcgacaagatcacgagacccggtttcctggccgaggtgtccaggaaaggggagagcttgaagct

SEQ ID NO: 52978 - DNA, 99 bp, Zea mays
  Clone ID: LIB3067-056-Q1-K1-H6
aaaaaaaaaaaaaaaaaattataaaaaaattaaaaaaaaaaaataaaaaagggaaaaaagaagaaaaaaaaaaaaaaaaaaaaacaaaaaaaaaaaaaa

SEQ ID NO: 52979 - DNA, 297 bp, Zea mays
  Clone ID: LIB3067-057-Q1-K1-B1
gtcgatcatgaggacccgttaataccatggaatttggatgaacccttgtattttaagccaaaagttggttggtagcctttaaaaactctgtatataatactgtggttttatcaatactatggtaattttggggtatagaaaaaaaaaaaaaaaaaaaaaaaaaaaaaaaaaaaaaaaaaaaaaaagaaaaaaaaataaaaaaaaaaaaaaaaaaaaaaaaaaacaaaagaaaaaataaataattgaaatcaagtaaaaataaatttaattaactggcacattaattaacaacagtta

SEQ ID NO: 52980 - DNA, 253 bp, Zea mays
  Clone ID: LIB3067-057-Q1-K1-D12
tggagaaagaaatgatatccaatcacatgcttttattggttcacatggaaaattcagggcgggctaacatgcttgtagatgaccaattcaaagattcgggtcggatgtattcattgttccgaagggttccagatcgactatcaactattagagatgccatgacttgttacttatgggccacaagttagcagtctgtgacaaatcaaaatcgtcggtctcagctatcgaacttaatgtgagcattgtcaaatgc

SEQ ID NO: 52981 - DNA, 59 bp, Zea mays
  Clone ID: LIB3067-057-Q1-K1-F11
aaaaaacaaaaaaaaaaaaaaaaaaaaaaattttaaaaaaaaaaaaaaaaaataaaagt

SEQ ID NO: 52982 - DNA, 299 bp, Zea mays
  Clone ID: LIB3067-057-Q1-K1-H3
aagcttcggtctgcaggttctgcttgtgctttgtaatgggcattgtagagtgagtttatgtgttagtgataggaaatagtctaaggactgttctacgataaagcctggagaaagctgaagtggctggtgattataagaactggtggcaactcccattcctgtggtagtcctggctgactgtaaatatcgtttgacagagcattaccatgccaactcaatctgttgtgatcctcttgtaatgactagtgagttaagttgaactgttgggtagatacgagatactaggttattatcgcgtt

SEQ ID NO: 52983 - DNA, 409 bp, Zea mays
  unsure at all n locations
  Clone ID: LIB3067-058-Q1-K1-A7
ttttggtttgaacggtgcggttttatttcgactttgggaaatcgaaaacggagacagatgattatacagattgtttccgtggattacacacagatatggtacacgaaggcagagcacctcgtggcgtgggtaggagggtaccttcctgcttggctgcttgctttactgaacgaagcacgaacccgggccgaccggcggcctccgagcgtagtagttcgtgacaggagccgcggcgaccccacggtggttcagcaggcacctgaagcggtgtagccgtgacagcacggtcgtctcgacgtcctgggcggatatggcctncagctggctccacagacgctctgccgctgctgcggctcggggccagattgtctgcaggacgtctgacgtgtcggccgtctcgccccacatg

SEQ ID NO: 52984 - DNA, 416 bp, Zea mays
  Clone ID: LIB3067-058-Q1-K1-B11
aaagcaatggtcagatgcgtgcattatggtttacccgagagcaaagcctcatcaggcgcggtcccaggaatccggcaaggaggagatcaagaagcacgtactcatctgccgcgtgaagcgctcacccagcagcgtgctctcgaagcggtcgccgttccaggagataggcaacatcagcttgccacggcatcggtgaggaccgacgagcatgggtggcgatgttgctctgcgacctgtgtgagtgatggggctactgcagcggaactacgaagggttcagctgtaagcgggagagagagtagcatcgtgatcgatctgatcagcatctacgcaataaataatttatgtatgacccactgatgaataacgaagcctgacttctcgtcagatcggtagtaataatcataagcagtcagt

SEQ ID NO: 52985 - DNA, 403 bp, Zea mays
  Clone ID: LIB3067-058-Q1-K1-B9
gcgcaggacttcaagacagaccttcggttccagagccacgccgtgctggcgctccaggaggccgccgaggcctacctcgtcggcctcttcgaggacaccaacctctgcgccatccacgccaagcgtgtcaccatcatgcccaaggacatccagctcgcccgccgcatccgtggcgagcgcgcgtagccatcatctccgaggatctgatgaatgtctagttaccaaaaaataggccgtattagcgtcgttgttctgtattcgttattttggattcggttgcagtgaaaaacagctttactaatcttatttgtggcctctggtggttgcttcgcttctaagcgatcatctgtggtgcaaaattcgtgctggctattttgtcaaaaaaaaactaaaaaaattgaaa

SEQ ID NO: 52986 - DNA, 53 bp, Zea mays
  Clone ID: LIB3067-058-Q1-K1-C4
cccacgcgtccgcccacgcgtccgaaaaaaaattaaaaaaaaaaaaataaatt

SEQ ID NO: 52987 - DNA, 72 bp, Zea mays
  Clone ID: LIB3067-058-Q1-K1-C9
aaaaaaaaaaaaaaaaaaaaaaaaaaaaaaaaaaaaaaaaaaaaaaaaaaaaaaggaaaaggggaaaaaaaa

SEQ ID NO: 52988 - DNA, 200 bp, Zea mays
  Clone ID: LIB3067-058-Q1-K1-E4
ttgagactctgatgattcttggactgatctgcgtgtcgattagccagactgtaaatctgaggaactctgttttgaaaaatcattccttgagtggcataattttccaggctatggatgctagaatggattaaggagaactgatgtgatagaccttttctttaacgttttttttatccctgaagtaaagtcagtttggacgt

SEQ ID NO: 52989 - DNA, 338 bp, Zea mays
  Clone ID: LIB3067-058-Q1-K1-G1
gactggtgttccgcctctctgggaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagtgttttagaatgagttgaggcgcttacacaaactttcattccggcctcttgttccatagtttttcttgcatgttacatctcaccgatgaataaaatgtatgtatcagacttgtctcgttaaaaaaaaaaagaaat

SEQ ID NO: 52990 - DNA, 264 bp, Zea mays
  Clone ID: LIB3067-058-Q1-K1-G8
cccacgcgtccggaactgtaatagtaaggttacaataaattttcacataggtgatcaagggtctgtttgtgtaaagccaacagatggtctgacctgacatgtgtttttccaggagtcactacttatagaaaaagcttgatcctagaggtggtttctcccggcaatgcagaatcttgaagcacgtctaaagtggcttgatgatagttctaaatttcaactccctgtcattaccaggtgcaaaaaagaaaaataaaaaataatatc

SEQ ID NO: 52991 - DNA, 69 bp, Zea mays
  Clone ID: LIB3067-059-Q1-K1-D11
cccacgcgtccgaaaaaaaaaaaaaaaaattttaaaaaaaaaaaaaaaaaaaaaaaaaaaagggggaat

SEQ ID NO: 52992 - DNA, 429 bp, Zea mays
  Clone ID: LIB3067-059-Q1-K1-F7
gaaatagaaagctcatgggcatgacaacgatttataaagttcgaagcttcgcacacaacacaacacacacgaggtcttagcctcaatacatagtctcgcgtcctgcagggtgaatccctgctgtgcatcaactttatttggggtcatcagagcatttcatatccatccagatcgaccatgctcattcgggtccaccaggtcctcgttgttcagctgatccatgtaggcttgatgatggtacccgaactgcagggaaggatcgttgtccaggtgctgaaggagcccctgataaggatcaagaacatttccacttgcgccactgtgcccaccttcctcccaggagacacggaacgcgttctctggccttgtttcttgcagctgcttccttaggtcttttattgagatccaacaattcttggtccctgcttt

SEQ ID NO: 52993 - DNA, 210 bp, Zea mays
  Clone ID: LIB3067-059-Q1-K1-G3
ttaatcttcatttgattttatcttgttagtaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaatatataaaaaataaacaaaaaaaaaataaaaacaacaacaatcaat

SEQ ID NO: 52994 - DNA, 440 bp, Zea mays
  Clone ID: LIB3067-059-Q1-K1-G6
aactgtcgtgacaacgtatggacatatacctagttgtttaagatgaccctagaactcatgcagtttgatgccatgtttgatccttatgttaaatgtcggtctccaccaaagatacttgtcatcttgaatcctcgatctggacatggtagatctagcaaagtttttcatggaaaagtggaacccatatttaaggtatgtctagctgagtagaagcatgcatcttatctcaagattggatctgtgttgtcgcttctactaggaactttggtatgatctagtcatgcttcccaagatcatatttagtccggtgtttcatacaacctaagatgtttataaatgagttgtagacaattttataagctttccaccttcacaaggtactatccttttttcctggtcatattctggattcctgtattttcctggtgtgtgcaagaaat

SEQ ID NO: 52995 - DNA, 116 bp, Zea mays
  Clone ID: LIB3067-059-Q1-K1-H7
tttagttcaaaaacacactatccggcgtctaatatataagattggaggtagtaccagacatgccgtggcttatttgtactgtcttcacctggtggaatttttgcacgtgagctacc

SEQ ID NO: 52996 - DNA, 226 bp, Zea mays
  Clone ID: LIB3067-060-Q1-K1-B12
agagaaggaaggcatgtgtctactagagtacctttttcgtattggtgttgatagtggtgttggttaactactgctgctgcttggttgattgtttgttcgttcttaggtggtctccttgtatagtgattagtgagtcatatatacttgccgtcacacatatgccggtgtacatcatgtgtgctcagcatgtctattctaaaaaaaaaaaaaaaaaaaaaaccataga

SEQ ID NO: 52997 - DNA, 328 bp, Zea mays
  Clone ID: LIB3067-060-Q1-K1-F4
cccacgcgtccggactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcatgcttcttaaatctttgacctctgcggttgtgccaaagaaaaaaaaaaaaaaaaaaaaaaaaaaaaaaaaaaaaaaaaaaaaaaataaaaaaaaaaaaaaaaaaaataaa

SEQ ID NO: 52998 - DNA, 439 bp, Zea mays
  Clone ID: LIB3067-060-Q1-K1-F8
tgcagattgtaggagatgatcttctcgttaccaaccccaccagggtcgccaaggccatcggtgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaagatggggatgttttcttgtggagctatactagctcgctgctgccttttgttacaatg

SEQ ID NO: 52999 - DNA, 232 bp, Zea mays
  Clone ID: LIB3067-060-Q1-K1-G4
ctcaatgtcaattggtacgttgactttggataagatacaggagcttaatgctgagaaacgagaattagtggatgatgttgaggaattggagaatatgtcaccaaaatcactatggttgaaagatcttgatgcttttgagaaagaactggatgtgcttgatcaaaatggatctagcataggaactgcaaagtgaaaagaggataaatgctggctcaagaaaaacctcttatat

SEQ ID NO: 53000 - DNA, 136 bp, Zea mays
  Clone ID: LIB3067-060-Q1-K1-G7
cccacgcgtccgaaaaaaaaaaaaaaaaattaaaaaaaaaaaaaaaaaaaagacaaaagagggtaaagaatccaagcttacatacacatacatgcaacgaaaatgggctcttctatactgagacctaaattcaatt

SEQ ID NO: 53001 - DNA, 432 bp, Zea mays
  Clone ID: LIB3067-060-Q1-K1-H6
cgcgtccagtgtgtacgctccccctcagtcctagcggtagcgttcgcgcgggagacgtagatggcggcttcggcggcggcagcgagaacaccggtggcgccgacagaggggacggtgatcgcgatccacaggctggaggagtggagcatccatatcgaggaggccaacagcgccaacaagctggtggtgattgacttcactgcaacatggtgtgctccgtgccgcgccatggctccaatttttgctgatatgtgcaagaagtccccaaatgttggtttcctgaaagttgatgtccatgaaatgaagaccattgctgagcaattcagcgtataggccatgccaacatttctgtgcatgaggcaaggcgacgtccatgacagggtctgtggcgcaccacatgaagagctagcacggaagcttgaactacacatg

SEQ ID NO: 53002 - DNA, 991 bp, Zea mays
  Clone ID: CPR9095_LIB3067-005-A5
ggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctaaaaaaaaaaaaaaa

SEQ ID NO: 53003 - DNA, 987 bp, Zea mays
  Clone ID: CPR9096_LIB3067-018-F7
cgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacctagagggggcgcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccttttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaa

SEQ ID NO: 53004 - DNA, 468 bp, Zea mays
  Clone ID: LIB3067-002-D4-F1A
attaaaattttttaaatatgaaaaaaacaggggttgtaaatctccggtagcaactcaatttacagaactttgatcccggcaggaagttaggagaaacaatcacagcgcctgaggcagtgccatggattttataaaaaaaaaaaccacccaaaaaaaaaaaaagaaaaaaacataaaccccccccaaaaaaaccccctcccaaaaaaccccaaaaaacccgtccaaaaaaccaaaaggaaaaaagccacccaaaaccggcaacccaataagcatgtccattgtgaccaaaactgtacgaaaaacccccccaaccgaaaaaaagaaaaacccccaaaaaaaaaagcccaacccctttgaacaaacccccaaaaaagggatgaaccccccaaaaaaaaaaaagcccaaaaaacccccccgccttcccccccccccccgcaatcaaaaacaaccccccccccacggaaaaac

SEQ ID NO: 53005 - DNA, 427 bp, Zea mays
  Clone ID: LIB3067-002-D4-R1A
cccacgcgtccgatctcggagcttgaacggagcgtcaccagtctccacatggaggtgtcggcgctgtccccaaaacggtcaagaccatattggcaaacaggcagtcggctcacacgtcacgagtgaggaagctgcagtacatctcggagcttgaacggagcgtcaccagtctccagatggaggtgtcggcgctgtcccctcgcgtggccttcctcgaccaccaccgctcactgctcaccgtcggcaacagccatctcaagcaaagaatcgcggcgctcgcccaggacaagatcttcaaagacgctcaccaagaggcgctcgcgaaggagatccagcggctgcgccaagtgtaccagcagcagcaggtcaacgtggccaccaacggcggctgcgacatcgccaccgccgctcgccgtcgatgcaggcc

SEQ ID NO: 53006 - DNA, 258 bp, Zea mays
  Clone ID: LIB3067-032-B1-F1A
gaaatacaacagtatgggcatgaacacgctttataaagttccaagcttcggaaacaacaaaacacacacggggtcttagcctcaataaatagccccgggccctgcagggtgaatctctgctgtgcatcaactttatttggggcaacaagcgcctttcatacccattcacatggcccatgctcattccgggcccacaaggtcccgctcgttcagccgactcacgcaggcttcacgctggcaccgaactgcagggaagga

SEQ ID NO: 53007 - DNA, 477 bp, Zea mays
  Clone ID: LIB3067-032-B1-R1A
cccacgcgtccgcgcactccaactactcacaagaagtaaaaactccactggacactgaaattaactaccaggattatctcaagttgaggacaagggtcgaattcctccaaactacacaaagaaatattcttggcgaggatctgggtccgcttagcatgaaggagctagagcagctggaggaccaaatagagatatctctgaagcatatcagctcaagaaagaatcaaatgctacttgaccagctatttgatctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatccagcctacatggatcagctgaaca

SEQ ID NO: 53008 - DNA, 400 bp, Zea mays
  Clone ID: LIB3067-032-F8-F1A
gcaaaatgccgcaaacctgtagcattaagggggcacagtctttgctgttcatgacatgtaaagtttcttggggcaacaacgggggtacagtaatgcagtagggttctttctcgatctccagttcattgggcagatcatccatatttataggctaattaagctacggcatgcatgcaggttttcaggggcacacttcaaaacttcatggtaacgtgcgtgggctgaatcaattgtgccagaggccatgatgagccccatgatccggccgggcgtagaacatcgccggcgttgctcccacgaggcgtgcgtcgacgtaaaacgcggcggcgttgggcggggccgggtggaaccatccatcaccgcgaactgcatctcctccgaggggttccagtgccgcttc

SEQ ID NO: 53009 - DNA, 477 bp, Zea mays
  Clone ID: LIB3067-032-F8-R1A
cggacgcgtggacggacgcgtgggcggacgcgtgggcggacgcgtgggcactggcggagtcgacggggctggagcagaagcagatcaacaactggttcatcaaccagcggaagcggcactggaagccgtcggaggagatgcagttcgcggtgatggatgggttccacccggccccgcccaacgccgccgcgttctacgtcgacgcacgcctcgtgggagcaacgccggcgatgttctacgcccggccggatcatggggctcatcatggcctctggcacaattgattcagcccacgcacgctaccatgaagtattgaagtgtgcgcctgaaaacctgcatgcatgccgtagcttaattagcctataaatatgaatgatctgcacaatgaactggagatcgagaaagaaccctactgcattactgtacccccgttgttgcaccaagaactttacatgtcatgaacagcaaagactgtgc

SEQ ID NO: 53010 - DNA, 432 bp, Zea mays
  Clone ID: LIB3067-045-B5-F1A
cttgcggttctcaataagcaccagctgctgccagcatgagcagctcgtcgaggctccagatatccccggcgctcgcgccatcctgtggagctggagcatcatcagcctgctgcagaagaccgaggttgcccaccgacgcgttgctgctcccgacgtaataaggaggcaacgcctgagtcgtggtggcagctcactttatcaaggccaaagccaggcatggccgcgtcatgtgcgatgctgcgcggcgcccgccgtagctgctcctcattctcttcggcgctccgccttgcatgtaagactaagacgccggagcgaagaccgatgaggtgtagtccgaggtcatggcggcagaatcgagcgacgtcgtctaacgagcaggacgccacgaagttgcaggatcctgatccgtacgagttgctgctctggtcgtcg

SEQ ID NO: 53011 - DNA, 380 bp, Zea mays
  Clone ID: LIB3067-045-B5-R1A
ctcaccaactcggactctcaactcccaagtctcaccccacgtccctcgctcaccataggcactagcggacaggcaatagccgagccgcaaccgcgaagatcttgcgtggcctccttttcccagctcgtcactgtggcgctcgtgtccttcactcccggtccggacaacgcaataatccatcgatgcatccagcaacagcaccccgctacggcgatgtacggcggtgccatcctctcgggattcatccaggcgtccggggtagccgtagcagcagaggaggtggtcaagaagaagcagcagcagcggttccgtctgaatgcggatctgatatggacggagctcgatattaacggcagtccccatgacaatgatgatgactt

SEQ ID NO: 53012 - DNA, 490 bp, Zea mays
  Clone ID: LIB3067-047-C2-F1A
gattattcgagaattaagtggatagtttccatgttcatcacaaatgttacacacatacttgccatgcaagaaccttaaagtacactccaagcacaacgtatagcacaggcagctgcatgcggccatgcttattaattcggaattgcgcagtagttcgatctcatggcaaccacgggggcaggaaggtggtcatgcatgagctagtcagtgcctctgaaggataccctatctgaagggtgggttcaccagcaccatcgaggggatggaagaagttattgccattgagctgctgcggctgcacttcagaatgccgctcgctttgctcccacgcatgctgccatataacctggttgctctcctccagtcttcttcgaagacacttatttgcttcacaaaacatttgttcttttttctgaagttctgtcagttgatcaaccatgtgttgcggacgcgtgggcggacgcgtggagcgacgcgtgggcggacgcgt

SEQ ID NO: 53013 - DNA, 310 bp, Zea mays
  Clone ID: LIB3067-047-C2-R1A
gtccgcccgacagatccgcccacgcggtccggcccgacagatcggcccacgcggccgcccactcgtccgcccacgcgtcgggccacgcgtccgggccacgcggtgcggaacacatggttgatcaactgacagaacttcaggagaaagagcagatgttttgtgaagcaagtaagtgtcttcgaagaagactggcaggagagcgaccagggttatatggcagcatgcgtgggggcaaagcgagcggcattctgaagtgcagccgcagcagctcaatggcaataacttcttccatcccctcgatggggctggt

SEQ ID NO: 53014 - DNA, 519 bp, Zea mays
  Clone ID: LIB3067-004-H9-F1A
aaaccgaatagcagtagtcacataactaaataagcatccaggtttgcacccctgaagttaacaactcaacacaaacacaataaccaaataactgatgaagcagtaccaggcaagcgttacacagaggagctccaacctgacagctcaactaaaacctacaggatgacaaggactcgccgaggagcgcacagaagtctagtttaaactaaagatgcacatcccctagtcttcactccttggaggacttgttgatcagggacttgtgaatgtgcgggatgacacctccgcctgcgatggtgcccttgatgagggtgtccagctcctcgtctccacgaatggctagctgcaaatggcgaggggtgatacgcttcaccttcagatccttgctagcattcccagccagctccagaacctcggcagtcaagtactccaggatggcagcggagtagacggctgcggtggcaccaacacgtccatttgcctgagtcctttgcttcagctgacggtggatacgtcaac

SEQ ID NO: 53015 - DNA, 547 bp, Zea mays
  unsure at all n locations
  Clone ID: LIB3067-004-H9-R1A
tgtttgttagcgtgacgtgaggagtctggagtcggacggaaccgagaaggcgaaaactcagtgtctcgagtttcctcggagctgaggcgatggctgggaagggagggaaaggcttgctcgccgcgaagactacggcggccaagtccgccgagaaggacaaggggaagaaggccccaatttcacgctcttcccgcgccggcctccagttccctgttggacgtatccaccgtcagctgaagcaaaggactcaggcaaatggacgtgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagntcctgatcaacaagtcctccaaggagtgaagactaggggatgtgcatctttagtttaaactagacttctgtgc

SEQ ID NO: 53016 - DNA, 493 bp, Zea mays
  Clone ID: LIB3067-025-B4-R1A
cccacgcgtccgcccacgcgtccggaaccgcagaagtgcagcagaacgatcggatctagcagaattctctcaacctcatcggcggcggcgaagagcgtgcggatcggagatggagacaagcgggtggacgaggagaacggcggcgcgggactcctggagccccgccacggtgtacctgtggctcgcgctcgccgcagcagcactgacgctcgcccaggctaagaaggacctaacggaggttacccacaaggtctacttcgatgtcgagattgacggcaagcccgcagtccggattgtcatggggctttttgggaagactgttcctaagacagcagagaacttccgagctctttgcacaggagagaaaggaattggcaagactggcaaagctctccactacaagggaagtacattccacagaatcattcccagcttcatgctccaaggaagtgacttcactcttggggattggacgggctgtgaatctatctat

SEQ ID NO: 53017 - DNA, 549 bp, Zea mays
  Clone ID: LIB3067-025-B5-R1A
cgtttgatgcgaccgcgggagctccgcccgaccgccaccgcgtccgcctcagctcccctcgcttccctctaatttccagcccagtagtagggagactagaatcgtcggcgcgacgccttggcagattcgtccgccccgatcccaccaccaccgtgccccgcgggtgacgtcggaccggcggcgatggcaacgtcggcggcggcgggatcgcgcaggaaggcgccgagccctccgaagcaccgccacgacggtacctcgccgctgcctctcggcatggactggagccctcccccgaagagatgggagggaaggaacaccatatggccacacaaccctcaaacaagttggagttactgtgtgatgatgcttcttggatcaccaaacacctgaaactggtgtcacagccgatagctttttgaaatctgtcggtttttacaggatacatgttggtatacaatcttcagaaggctttagctctatccatggaatcctcagaaggtttagtgactttctgaagctatcttctgatcttaagagcgcgtttcccag

SEQ ID NO: 53018 - DNA, 546 bp, Zea mays
  unsure at all n locations
  Clone ID: LIB3067-025-D5-R1A
cccacgcgtccgcccacgcgtccgcccacgcgtccgcccacgcgtccgccccatctcgcccgccgttttcgtccttatcgatctcctcgcacctcgtggcggcacctctccccttcgatccaccaagggtttaggatcggcggcgatggcggcgaggctggcacacttgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttattttgagttgagctttatgcatgggnctgcgtagcgagattgttggcagaagtttcaccttaagcggctataaagtctagttgatttccagtgatttagacctgctttataaa

SEQ ID NO: 53019 - DNA, 111 bp, Zea mays
  Clone ID: LIB3067-026-C11-F1A
aacacagaacaatacatccaatttgagttgatgcatcactgttcaacgccttcgattgcgacaacacgccaccaaatgggcgttcccctggtaccctaggggggaagccac

SEQ ID NO: 53020 - DNA, 512 bp, Zea mays
  Clone ID: LIB3067-026-C11-R1A
agctgctgcagcgctgtccaaggaggaggaggccgtgcgggcgcgccttcgccgccgggcccgcgcctcccgccagtccgcgcacaacgtcctcgccctcgccgccgcgctcgagattgttgccgttggatacgccatcatgaccacgagatcgccggacatcagctggcagatgagggcagtcagggtgctacccatgttcttggttcctgctctagctgctctcatctactcgaccattacaaacctcacgaaaatgcttgacaacagagaccaacaaactcttgaaaagctacgaactgaaaggcaagccaagattgacgaattgaaggagagaacaaattactacactactcagcaacttatacagagatatgatcttgacccagctgcaaaggcggcagcggcaacagttttggcatcaaagttgggtgccgattctggactgagagtctttttgggagatgaaacaagccaggatgcagcaataggtagaagtaatggtaacaatc

SEQ ID NO: 53021 - DNA, 421 bp, Zea mays
  Clone ID: LIB3067-028-B10-F1A
gtaataataatgatatttataacagagacaggatcatcgaaaaacaacaacaacaacaacaacatgcgatagacgacgagatgcatggacatatatataatactacatcatatatatcaacgtacgtacgtatactagcagcttggagaaattatttagcctccagatcgatcgatcgatgggcgtgtgatagtcagaagcactggaagcccgaggggacgcgcctgccgcagtagttgacgaggaggctgaggttgatgggcaggttgaggttgatgcccaggacgttggccctgaggacggtgcagaggcacaccgccgcctccaggtccgccagcccctggatcagcgtgcagcacggcgtcctgggcggcggcgaggtggtggggtacagcgtcgtcgcctctgctggggttggggt

SEQ ID NO: 53022 - DNA, 607 bp, Zea mays
  Clone ID: LIB3067-028-B10-R1A
cccacgcgtccgccaagttccatttattattttctccgaggaagccctttccccaggcacagatccggctcctcgccgccgccatggccgcccgcctccccctcctggtcctcgccgttgtcgctgcgtccctcctcgctgccgacgcgcggccgtgccacaccttcttcgtcgccttccgcgccgaccccaaccccagcagaggcgacgacgctgtaccccaccacctcgccgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtcgatgcatctcgtcgtctatcgcatgttgttgttagtgttggtgtttttcgatgatcctgtctccgttataaatatcattaattatac

SEQ ID NO: 53023 - DNA, 597 bp, Zea mays
  unsure at all n locations
  Clone ID: LIB3067-028-B4-F1A
gaggagaatgcaacgggggtaggagtgccaccatccttcatatcatatttacaaaagaactggattgtatccatctataccatatcccaaacagtcaccatgtcggcagcttatacaggggtacgacatcgtaaacaaccaacaggtcttgtgttgtcctgcttggtttatgccgatcctaaccaacgcctgaggttgcgtcctctcacatgacaagaaagagaacagcatcaacggttgcaggcttggggcgggcgcacaagtagacacgtgtgccgcttgctgggaataagaaagcctgttgctgagaaaatcagcaccacggctttctgctgcagaacgatgtcagctacttctgctgagtgatagcatcgctgcagaacttcttgaaattttggcactcgtcggtcaggaagtcgtagatccgttcaaccatctctgcctggtcccatctaggactccagggatagtcatttatcggaggcgacgtgataggcatcccatcggcattacagtgctgagaactctgcagtgtgacgacaggttgttgctttgggaattgaanggggatggcaaaagtgaccagaaatgtgaaca

SEQ ID NO: 53024 - DNA, 522 bp, Zea mays
  unsure at all n locations
  Clone ID: LIB3067-028-B4-R1A
gtttgctagtgagtcgagaagagagagagacgcgtccggaattcatcgccagcgatgtctccgtccgncgacgcccccggcccggcctcctccgcctcggcgcccccgatcgcgcccctcatcgccgcgcacgtcaactacctcctctcgcactccaagctgcccattagggtggtacagatctggtccggctgccgcaacggtcgccctgccgatcggttcaggctcgccatccccttctgcctcgactacgtccactgggatttcgtgtacaatgcgctgtctcccaaggtggcaccagacgtggtgttcggtccggaagatgagaggtctcagccgctggtcgattacgctgctgctggaaatggcgataagagctgcttggcgcgttgggattgccgcgcccccgagggactccatgggctcgtacaggagcttcgagaattgtacattgaataccaaaaggagcgggttcacatggttgatgacgcgagactagcgtttgaaataagcacagttctc

SEQ ID NO: 53025 - DNA, 563 bp, Zea mays
  unsure at all n locations
  Clone ID: LIB3067-028-B9-R1A
cccacgcgtccgcccacgcgtccgagaagggcttggacgcggatggcgatttgctcgatgtgatattgaaaggtctgtgtagccatgaaaaggttgaagaggcttactctttgtttgttgagatggtggataaggctgagttgaggccttggcaagcacttgcagcatttaattggtgacttgctgagggtaaacaaacttgaggaggccctggcccttctcaagacaatgaaaacctgcaagttcccaccttttgcggacccgttccctccttacattgccaagtatgggacagttgaagatgcaaggaactttttcaaggcattgacagtgaaaacttctccagcacctgctgcctacctgcatgttctcaagttgttctttgcggagggaagatattctgaagctcaagatttactgtacaaatgccctatttacatccgcaagcacccccacgtcgccaaactgtttgaatcaataaaaattgagagtgcctctggctcttgattggggtccaacaagcaatgattggtngagctatggtgaaccttacctttgcctgc

SEQ ID NO: 53026 - DNA, 536 bp, Zea mays
  Clone ID: LIB3067-038-F12-F1A
gtcaaaaaaggtgataatttgcaaatgcaaccctcaattcgttttacaaaatcatcgtacatttctatgaagctaccgggatctccaactggaggcaccttctccccccacaagaaacataaacaggtagcagaaccattgaagcgaacatgactttcacattcttgtatcttcacggcctcaatgaaatgtcatttctcaatgtgccgccccctctttcgggatttatatggccgttcagatttcaccataccatcttcattcttgagtattctatgttcttgttcattctgctcaattttgatgcttgtatcccttgatctactttcaccacttttgagttctgatgcatatttaggatcatgtactgacaaccaacgcatgcatccagtgtgaggtgggattaaagatccagtaatatgacaactcatttctgtatccacccttttgacagaaaaccttatcattgttcctctttcaatcacatgttttttatctgtgaggctcacaaatttgtctccatcacttttccattt

SEQ ID NO: 53027 - DNA, 548 bp, Zea mays
  unsure at all n locations
  Clone ID: LIB3067-038-F12-R1A
ccacgcgtccgcccactagtccgcccacgcgtccgcccacgcgtccgcccacgcgtccggctcgggaaggagtcaattcatgccattgtattaggggttttctcagtggcaattatgtctgaagatattaagttcaaattcaaatggaaaagtgatggaggaaaatttgtgagcctcacagataaaaaacatgtgattgaaagaggaacaatgataaggttttctgtcaaaagggtggatacagaaatgagttgtcatattactggatctttaatcccacctcacactggatgcatgcgttggttgtcagtacatgatcctaaatatgcatcagaactcaaaagtggtgaaagtagatcaagggatacaagcatcaaaattgagcagaatgaacaaggacatagaatactcaagaatgaagatggtatggtgaaatctngacggccatataaatcccgaaagaggggggcgcacatttgagaatgacatttcattggaggcgtgaaaataccagaatgtgaaaagtcatgttcccttcaaagggttct

SEQ ID NO: 53028 - DNA, 151 bp, Zea mays
  unsure at all n locations
  Clone ID: LIB3067-039-C11-F1A
tagtatcgtttttctagttggctttcggcgggctcctttcttactgatgggctgcgcttggtcggtggtctgctgggatctttattagcttggtcgatattgttaatacggtgatccagagaatcagggtgatgggcttntaagtacatgg

SEQ ID NO: 53029 - DNA, 507 bp, Zea mays
  Clone ID: LIB3067-039-C11-R1A
atcgccacgcgtccgcccacagagtccgcccacgcgtccgcccacgcgtccgcccacgcgtccgcaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcatttggagggactgtttcatgggaaggagaaggagctccatttaaagaaatagacgaagatatcactcaccaggttgattccatttgcaataatttattacaccaaagtttaactatatagacggagacattgtgtaccatccctaaagtaagatgccactctaagtaccacgacagcaatgccatactagggcaatagttactacaatacaatttttgtatgtggctaaactgtcatattttacactctaccatcatatgatcatatctagcgaagtaaaat

SEQ ID NO: 53030 - DNA, 458 bp, Zea mays
  unsure at all n locations
  Clone ID: LIB3067-039-G7-F1A
ttttttttggatcgaatgtcacatctttactatttaacaggagttctatacaaaataaataagtaattacattataaggagacaacggtccagcaacccaaagttgactgggagacgacggcctagaccactcacgaactcatcacagcatcctccacgcgcctcatcctgtggtacctgctcttgacctagacatctcaattacgttgctgtaccgaatccatatctaccatcttcaggtaacaagtgatttggtgtcccgtgtgggtaatccaaatgcatgcattgctctgagtattgacaggttggctagtgtaacgngtaagtccaaaccagatcgtatccaaacatgcgtattgttggtctttgatcgatatttgggccgagttttctgctggtgtgcctgaaactgacgttgcgtcaccgactgttcaattactataacatgttcgcttttt

SEQ ID NO: 53031 - DNA, 461 bp, Zea mays
  Clone ID: LIB3067-039-G7-R1A
attatgtttttaaaaagcgaacatgttatagtaattgaccagtcggtgacgcaacgtcagtttcaggcacaccagcagaaaactcggcccaaatatcgatcaaagaccaacaatacgcatgtttggatacgatctggtttggacttacacgttacactagccaacctgtcaatactcagagcaatgcatgcatttggattacccacacgggacaccaaatcacttgttacctgaagatggtagatatggattcggtacagcaacgtaattgagatgtctaggtcaagagcaggtaccacaggatgaggcgcgtggaggatgctgtgatgagttcgtgagtggtctaggccgtcgtctcccagtcaactttgggttgctggaccgttgtctccttataatgtaattacttatttattttgtatagaactcctgttaaatagtaaagatgtgacattcgatcc

SEQ ID NO: 53032 - DNA, 247 bp, Zea mays
  unsure at all n locations
  Clone ID: LIB3067-042-D12-F1A
gcaaccatcacgaaaacatcagtccctggtaaacccanntgcatanccatacccagcagtcaggctnnaanccatnncgcgtcataatncaaccgctatacacgcatctggatcatgtaatcaaagccacgaatagtatcaggactaccaacaagcaaacaaccacagcatagtaacctgcaatcacagtaggcccccatagtcaaaaaacaagtatgtcaggccaactcatcatcacatcccaagc

SEQ ID NO: 53033 - DNA, 564 bp, Zea mays
  Clone ID: LIB3067-042-D12-R1A
cgagcacccgctcgctctcgctctcgggccccagtccgatcgggtcggtgcctacacacccccgctggccgccgcacccaggcgaggcgaggcaaggcgcgtcccgaacaacggaaccaactgcaccgaccgagtcaatcaatccggcgagtgaccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggagcagaggctgttttggttgctgcgataagactgtaaagcaactgggtgaactgtccagaaacttgatcacccaggaccaaattaccattggagagccattttggagcacaaccaccatcgaggttgaaccagcagatctcagtggtgttacttcagtcaatacatctaacttgggctctggaactggtagcagtcataaccttcctggacttggtaataatggacttgttctgttgggacatac

SEQ ID NO: 53034 - DNA, 305 bp, Zea mays
  Clone ID: LIB3067-043-A5-F1A
gttatagacgctttacagagatcgaatacttccgatgtaatttactgcaggaggtgtaaccccacgaagtcagcgcagtcaaacaaggggatcatacgcgaagagggaataacgaaggaagggacgccccaaacgacacgggcgacagactatagaggggaagggaaaaaggagacaagcgcaagacgcaaaatctcccgcatggagtagacggcccagagaagaaaacggaaagaaaaggcccaccaaaggaaccgttgcgggacttgcaaaaagggcccgacgaaacggggcgccacaagaaa

SEQ ID NO: 53035 - DNA, 92 bp, Zea mays
  Clone ID: LIB3067-043-A5-R1A
gctgcattaacaccactccagagcagtacatatggtgtaggtccgcaacagaaggattggtctgtgagctgggtggccactagcgtctcagg

SEQ ID NO: 53036 - DNA, 576 bp, Zea mays
  Clone ID: LIB3067-043-B2-R1A
gttcgagacaccaagataaagtttctttccagcgttaagcaactaactgaggaggacaagtctgcctggtcagaacttgtggtttctctgaagtcagaatatccgaagtacacacctttgctttctaagattttgcaatgtgtcctccagaaaggaactgatggtgataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagaaacgcgggatcagttggctgatgcactatatcaaaagtgtcttgcattggcagagattgaatcactgaagtctgatgagtcaattgaggtatctgctaaagatatttttgaggagaattacaaagaattgattaaatgggttgatgtcaaatctgcaaaatatggcacttcgactgtattgcgtgaaaaacgctgtgggaagacctggtacagcattggaagatctaaatggttttgattccaaatgaatctggaccaaaggaaa

SEQ ID NO: 53037 - DNA, 424 bp, Zea mays
  Clone ID: LIB3067-052-D2-R1A
cccacgcgtccgcccacgcgtccgcccacgcgtccgcccacgcgtccgcccacgcgtccgctgagatgattggcagcattgttggggtctacaacggcaagaccttcaaccaggttgagatcaagcctgagatgatcggccactaccttgctgagttctccatctcctacaagccggtcaagcacggcaggcccggtatcggtgccacccactcctcgcggtttattcctctgaaatgagctgttactcggctctttagtatcccaagagtccgttggcaatgttcattcagattttactacttctttagtatcccaagacatttgtgttgttccattccagctcaagaattcaaagctaagcattgcacaattatgctgttttgttggaagtatttgagataatcatatctaagctgagttgc

SEQ ID NO: 53038 - DNA, 531 bp, Zea mays
  Clone ID: LIB3067-052-D9-F1A
gccttgactttcagtatgtataagaaagagacaggttacatccaaaggatttctacaaggagggccgactgtgggcatgtcataactcctgccgcttttatatctccaaaaaattgtggagccaaaaaaaaagagagagactcgagcctatctatacatgatgacgatacagcccaggatgaaaatgtttaccacttcaacaacacaaatcgacgtctagacaaaaggatgcaacctgatggattcctcagtgcccaaccagcacattactgaacaacctgagggagcagtaatttgcggacgacggcatgcaatgttacgaggatccctatctgcagaatcacgaatcacccttgaccagccagacatcttaacgaggatctgcattagagtaataagctccaccatgattggtaaagtccagtgatatcagaaagattaaacttcaagagtttttcccagaaaatttgcacaattgcagttcacctgttcttctgaaaagggtacttcagtatcgaatctggactgggg

SEQ ID NO: 53039 - DNA, 572 bp, Zea mays
  Clone ID: LIB3067-052-D9-R1A
gctcaaggaaatggccttgcttttacggtatcttcccttacaataacattggtggttcacagctaatttggattgcaccgagtggtggtagagatcgcccaaatccttcaacaggagagtggtacccgggcaggcgccttttgattcatccacagtggacaatatgaggaggcttctggagcatgctggtgttcctgggcacatatatccactattattactgtgctacgaggttatgcctccaccacaacaggtcgagaaagagattggtgaacagagggtgatatccttccatggagtaggcttgtcagcaactgaagaaacaaagtatggggatattacttgtcataccaagaatgctgatgagggaagggagctattcacaaatactttgtacaactcagttgttaatcagtacaatgtcctcaaatctgctatctttagagatcgtggagcagctgtatcaaacaatgccatctcactgtcacaaccatggcgatgaatgttagctttcccagtccagattcggtactgaagttaacttttcagaaagacaggtgaactgcaattgt

SEQ ID NO: 53040 - DNA, 57 bp, Zea mays
  Clone ID: LIB3067-053-B6-F1A
attattttatatttattcctaatatatcatttcttatacacttaccattaactttta

SEQ ID NO: 53041 - DNA, 483 bp, Zea mays
  Clone ID: LIB3067-053-B6-R1A
ctccagcgccgcgagtcacaacacagcacaggcagctcgagagagagagtgagagaaagatgtcgtggttcgggcaccaccaccacaaccagccggctcccccggcgtcgggccccaaccaggtgttcaagatcttctgccgcgccaacgagaactactgcctggccgtccgcgacgcgaccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgttggcaaaggcttccgctgcatccgcatggtcaacaacaaccgcctcaacttcgacgctttccacggcgaca

SEQ ID NO: 53042 - DNA, 532 bp, Zea mays
  unsure at all n locations
  Clone ID: LIB3067-053-C7-R1A
gggacggtananagaaaaatgcaggtgagggagttaaccaatttcgtaacaaacgggaaagtagagcgctataccgcagaagccctccttgcgctgcaagaggcagcagaattccacttgatagaactgtttgaaatggcgaatctgtgtgccatccatgccaagcgtgtcacaatcatgcaaaaggacatacaacttgcaaggcgtatcggaggaaggcgttgggcatgatatataatatccattctgattgcatcattcttgtgaatttgtttgtaggagctagacattagtgttgttgaatgctgcatggttcctaatccttttcgcagtctaacatctgtggagttagtatgttacatggcaacagctgaacatctgtggactataactatatggcaacagccgaagattgtgtctgtgggataactggttgttttggttgctcttcagtagtttgtttgcttcagtctgcagtatatggactatggagtaaactgcatgctgaaacccgaaccactgctgaaacggc

SEQ ID NO: 53043 - DNA, 497 bp, Zea mays
  Clone ID: LIB3067-054-E3-R1A
cccacgcgtccgcccacgcgtccgcccacgcgtccgagctagatcattggacacatatcgaaacagctctagctagcgcgctcgtcgtctaacctgacttccagcatggcttccaagcagatcggagtcttgacctgcttcattgccatcaccgctctcgccttccgtccctgcgcatccgccgtgcccatggacggtagctggtcgaacggcggcgccacctggtacggcccagccaagggcgctggatccgacggtggtgcgtgtaggtacagggtgccgtcgaccagcctccgttctcgtcaatgatcaccgccggcagccaatccatcttccaggacggcaagggctgcggcacctgctaccaggtgaagtgcatcggacacgcgtcgtgctccggcagcccggtgacagtggtcatcaccgacctgtgccccggcgctgcgtgccatgtggagcccgtgcactttgacctgagcgggacggcgttcggtgcc

SEQ ID NO: 53044 - DNA, 540 bp, Zea mays
  Clone ID: LIB3067-054-F10-F1A
gcaaataactcccttaaacaccttaagagactccacattaaacatcactgtacatgccctaaggcggcgcggatggacgtatgtgaaccattaacatgctgaactcgagcgtacaggccagcacttttatcgtgaagtccgtccatatgctagaacctcgaagcggttaactatatttggtggtgctcggtgcagctcatgcatctatctttcatcatgcagtcatgccatgcacaagcgaacaattaacacgttctcaccctagctaataatcgcgtcctgggcgatatacctgtgacctgtccttggataagcagacgcggtcttgcagtgttcctcctacttgagcttctcatccagctggccgtgaagccagtgtgccctccaaagaatcgaatgcgacagaaggcgttccgtcgagtaaccttcagtctgcagcttcgagataaaactggtatacatctcgtccatccatcgacgggcctctaagtgctgaggtttgctgttctgtgtcgagctagctagcacgagcccgtgtac

SEQ ID NO: 53045 - DNA, 504 bp, Zea mays
  Clone ID: LIB3067-054-F10-R1A
cccacgcgtccggcgcggcgtgctctccgttcgatccgatgcccatctgctgaatcggatcggatcgtgcgatcggccgccacgccacggcccgcgggtgaggcgtggtctccgggaggcagccaacctatcccacccggtctagcctctagcgatcccggcgccggcagcggcacgagaggaatggacgcgtcgcacccggagggcgaggccacggcggggtggctgacggtcgaggagtggagcggctcgtcagcctccgcgctctcccgcaccgccgtcctcaccgcctccgcctcctctctcaccgcacacaggttcggcagccggtgggaacggatcgggagccgcatgctcggcgccttcgtgcctgagggcttttcctggggaccgttaactcgggatttatgtcccgttccaagatgtggggataacgttgcggggtcttctccacattacatccggtgcaaatgtttgtctaacacaagcttctttctagggggc

SEQ ID NO: 53046 - DNA, 479 bp, Zea mays
  Clone ID: LIB3067-008-Q1-K1-G7-M1
cggacgcttggtttccgctcgcggtcgcgggcggttcgagtcggaccccagagcccaatgcgccccgccgcgccgctctatgtcgcggaacggaagctaagtgcgtcacacgccagggccggtcgcgggcaccggaccggaagcacaggggcgccgtacgtgcagacatcggtcatgaaggtgctcgtcctcgccgtgctggcgctcgtctgcggcgtctccggcgctggtcagggcgaggaggatggcagaccgacgctgacggtcgcggtgggcgcggcgacggcgggctgagacgtctcgcagcgcgagaggatgcgacaagacaacgcacacccatggtaccagggatgggactgccactacatccatccgcacctgacgagccacatgcacggccgagccgacaaggttgaccagagatggggctggtaggcgcggggctgcacagtgaccaacttcgacgggacgctgatgct

SEQ ID NO: 53047 - DNA, 610 bp, Zea mays
  Clone ID: LIB3067-018-Q1-K1-H10-M1
cccacgcgtccgactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatgttgcgtttgttctgcatcggcttcacgaagaggcgcccaaaccaggtcaagagaacctgctatgctcaggcatcccagatccgtcagatccgccgtaagatggttgagattatgatcaaccaggcttctacatgtgacctgaaagaa

SEQ ID NO: 53048 - DNA, 548 bp, Zea mays
  Clone ID: LIB3067-018-Q1-K1-H10-N1
gcaaggaacttaggacagcagtactcgaactcagaagatcaccacgagtaatcttaaacacttggtgagaataatcttaattttaaacttgtttccagacaaaatcttaggggcggatgaaaacaagtggacaactctaagttcacgtcataagcaacctcatgtgcagactcagcctagatatagaagtagcaaacaaactactcgggagcagcaacctcctgcacagcctcatctccctcgacaggcctttcaagcttcacaccaacatcctctttgtagtcgccatgaacctccatgagcttcccaagatcgaacttgggggccttgagtatcttcaccttgcggatgaagacgttttgaagggggaagatgctggaggtagacttctcaatctccttaccaataacttctggaatgaacttcgaaacaagttctttcagggcacatgtagaagcctggtggatcataatcttaaccatcttacggcggatctgacggatctgggatgcctgaccatagcaggttcttttgacctggtttgggcg

SEQ ID NO: 53049 - DNA, 586 bp, Zea mays
  Clone ID: LIB3067-014-Q1-K1-D4-121a
gacctgcacctggcgctgaagctgtgcaagaaggccctgctctgggggaagacatcgacggagaagctgggcaagcagttcgaggcgagggtgttcgagatcccggagcagaaggtgtgcgtggcgttcctctccaaccacaacaccaaggacgacgtgacgctgacgttccggggccagtcctacttcgtgccgcgccactccatcagcatcctcgccgactgcaagaccgtcgtcttcggcacccagcacgtgaacgcgcagcacaaccagaggacgttccacttcgcggaccagacgacgcagaacaacgtgtggcagatgttcgacgaggagaaggtgcccaagtacaagcagtccaagatcaggctgcgcaaggccggcgatctctacaacctcaccaaggacaagaccgactacgtctggtacacctccagcttcaagttggaggcggacgacatgccgatccgccgcgacatcaagacggtgctcgaggtcaacagccacgggcacgccagcgtggcgtttgtgaacaccaaattcgtaggatgtgggcacgggaccaagatgaacaaggcgttcacgc

SEQ ID NO: 53050 - DNA, 677 bp, Zea mays
  unsure at all n locations
  Clone ID: LIB3067-018-Q1-K1-G6-123a
agacgcaactagccactactgatgttgaggctggagcgaaactcggcgaaggtcgaggacggaagacccttggtgaagatatcagcaaactgggaggtggtcgggacgtggaggacccgaacagcaccggcggcgacataatcgcggacgaaatgtagattgatctctacatgcttggtccgctggtgctgcactgggttgggggagaggtagaccgcactgacgttgtcgcagtagaccaatgtgctcctggagaggggactgtgaagctcggcgaggagctgccggagccaggcagactccgccacgccgttggccacgacacggtactccggctcggcgcttgagcgggagaccgacggcttgcgcttcgacgaccagaaccacagtttgccggcttagaagacagcgtanccngaggtggagcgtacagtgtctgtgcacccggccaatcagcgtcgtatagacgaccaactcgaggaggtagaccggtaagaagcagctcgtagtcgacagtgccccggaggtagcggaggaggcgcttgagagccgcgaggtggggctcccggtggtcgtgcatatggagacagatctgctgcactgcgtangagatgtccggccctgtgtatgtgaggtactgaagagcaccagcgagactcctgtacccggtggggtcc

SEQ ID NO: 53051 - DNA, 681 bp, Zea mays
  Clone ID: LIB3067-018-Q1-K1-G6-Fa
agcggatatgccatcacatctctctatatccactaagatgctaccaccacccctgaagagcatgctgccactgccacccagaagcatgcccccaccaccacctaagagcatgcctccaccgccaccaaaatttccttcagatgagtttttgtcaagaaacgagaacaagttttttcctttaaaggagccaacagcacctccaaggtcctttgatgcaatatcagtcttgccatctgaacgacgaccaagggagcctaaggaggaaaaaacaaaaggcacacctgtgtctgatactttgctgaaacttattgattatggagatgacgacgatgacgacgatattgatgtgacagacaacatacctaagggcaatccaactcctggttcagagcagaaaccattttgggctgtttaaaactgggtctgctaacgtagtctagtgtgaattcttgttgataaggatgcttgctgccttggtgcatcttctgaattgaagaggcaatcgagctccttgttcgtgtactgtagtaattctaacaggcaatgagatttctttgaacttgtattcattctggcgtagtcaaaatgaaccgtttgttgttttggttcagatacgatgatgtttcgtttttagattcgacgttggttgctgaactcgtagcattttattgtcggtattat

SEQ ID NO: 53052 - DNA, 580 bp, Zea mays
  Clone ID: LIB3067-019-Q1-K1-D5-124a
caagccactctgcccttgttcttagttgaagcacggccaataaaggaggagtggaatataagcccatactttggtgtgttccctcgagttttcagtgctctgaatagggccttctcagcaccaagtatttgaagggtggaggctgcacacttagcaaggtttgaaagactgccagcatgagagattaggcgagctccaactacttcaccaatcaacgatgtcaggttgggtgcaatatcattcatcttagtcacaagatactcataaaggtttttgcgatactcagagagattcataaccctttgggcaaattgctggacattgatcaaatcaactggtgacagatcctggcccattgaagcctttgctgcttcaacaatttctttagccttgtcctcgtcgccaactatatcagccaaagcaggaatatctttttccgtcaaatcagaatttgttcacgataaaactaacaagcttggcatataggtaattgtcgttcacaatcttgacaagctcagggaagtgccatgagaaccattccctgactctcatggagaaagaatgatgtccttgtcaagcg

SEQ ID NO: 53053 - DNA, 650 bp, Zea mays
  Clone ID: LIB3067-019-Q1-K1-D5-125a
gacttggctggcacaggttccgccatggagaagagggggattgccaggtttgcaaatgtgttccggtagtcttcgaccttgtgcccaccagcgaggactttgtaaagctccaggcagacaaggccagtggccattgcagttgaggtggcgatggctgggatgattcttcccgctatgaacttcgccttcaacttgtcaacttcagggatgctgtagttcctagcccgcatgttggcaaaaccagcgatcaagtccatatggaaattggtatcatcatccttctcaaactgtatagggttcatatggaatcttggtggcaatgttttaaaaattgcttccagctttgcaataagctcttcaatgacagcagcatcatcaacagacgcagaggataggctagtagccttctcatctgtctctatcttaacaccttgttttggttggaaatctggaacaatgaccttgtgcacagcttcagccagtttttttgggttcttagcccaatcaggtatggggattccaaatgtctcttgccttaatacggacgcagccaacaagaagttaaggtgacttgagtcggaagacgagaactccagaggtcgtgggaaccgcttaggagcagaccagaaaggagcaccagagctagtcat

SEQ ID NO: 53054 - DNA, 485 bp, Zea mays
  Clone ID: LIB3067-058-Q1-K1-C7-Fa
cttaggggtagtatctgctgcaccgttctcctcctgtgcctcctcctccagcttatgcttctttttcttcttcttcttctcagttccaggctcagcttctccaccagcaacgttggagggtttatccacgtccattgcatcaccatcagccttggttttggtcttctttttcttgcttttcttgggagatgcatcggtcttctcgatatcatcatcatccattgaggtgccattgaccatgctgtcaatagcggctttcatcacatcaaggtttttacgaggcgcaacacccttgtcatagaattccagtctctcctcgacttgctcacgcaacttttgcccaaagacagaggtgctagccttcgagtagcaatcaatgcgtgaagcaatcgaacattttgtttgcaagtaacgagccattctgcccttgttcttagttgaagcacggccaataaaggaggagtggaatataagcccatactttg

SEQ ID NO: 53055 - DNA, 571 bp, Zea mays
  Clone ID: LIB3067-060-Q1-K1-C4-128a
ataggctagtagccttctcatctgtctctatcttaacaccttgttttggttggaaatctggaacaatgaccttgtccacagcttcagccagtttttttgggttcttagcccaatcaggtatggggattccaaatgtctctgcccttaatacggacgcagccaacaagaagttaaggtgacttgagtcggaagacgagaactccagaggtcgtgggaaccgcttaggagcagaccagaaaggagcaccagagctagtcattgcatcttcggggaaagtgaatgtcagctgctttacacggttcgagaaataatcctcaaacttaagccgggcccaggtaatacaatcttggaatgtctcacacttgtctgtctcaaggcattcaataactcgctcaagttgatccctagcctgtgcatcaccagcagttcttgctgcggttgcatatccaccagggtttgacaggaaagcatttacttcagtgggagtcttctcaagtagaccctcaaactagacctggcccacgtaaggcagtgatcaatattgtgaggaaaatgaatgtacagtgcacat

SEQ ID NO: 53056 - DNA, 446 bp, Zea mays
  Clone ID: LIB3067-022-Q1-K1-B12-F4A
gcgcgtctccgccgtcctcgaagtcgaagatcgacgcgatcgatcgatccatggggatgaagttaatgataattaggatcctcttctctcttgtacatattgctcatcaggtttatttcccgtcgttcttgtttccttagatccggcgctatagagggtgggcaggaagaagaactagaaggggttttaggatgcagaattttgctggcctttgctgtggccctgctgccgatgccgatgatgatgatgaaaacctgcgtgaaatgcagaacttgtatccaaagcttgcgtcgatttccctgtccagtacagtactccgatgtcttgcatctgccagtggacagctctcagtggtggtagctctagccgcgtcaatgtcatggcgttgcttcatggaatggaagacccgatgcgcttctgctgtcgcgtcgcttcgtcttttcgcc

SEQ ID NO: 53057 - DNA, 433 bp, Zea mays
  Clone ID: LIB3067-022-Q1-K1-B12-R3A
actgccaatgaaggatctagcccaaggagccctccttggcggagagccgcttgaggaactcgtaggtggtcaccatggtggccgcggacagcgacatggacccccacctgggccccagcccacggtagcacgccgcccagccgccctccttgagcagcccgcgcacggtgctggccagcgtgggccgcgccgccgcgtcggcctccatcacctgcagccgcgttttcacggtgtccagcggcatcgtcaccagcgccgcggtgcccccggccagggccgcgctcgcgccctgcacagccatcatgcaggcgcagctttcggagcgctcggtccccacggtgcgccacaagcaccgctgctccacggtgtaggtggaccaccacaccgcgttcgacggcgcgtaggtgatgatggacaggccaaacccgcggta

SEQ ID NO: 53058 - DNA, 485 bp, Zea mays
  Clone ID: LIB3067-023-Q1-K1-F10-F4A
ataatggcctctctctgtgtggtggtaaagaaatgatggtcgccaggctgcttaacttggaagaggctgagaaggaacgaatatacgagaaagatgttgacatgaaatatgtgcagggtgaacagcatgtggttggaagagaggacagtggtgtgaatgctcatagtacttcaaggtttggtgaaggttctaatggtgatgaattagatgtctctcggaacagtatgagagctggtaaaggacgttctggtggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctattcatccggaagcgatattgctgatggtctcggaaaggtcgatacaacagaagctagtactgaccacacaagtcatcatcatgatacgatt

SEQ ID NO: 53059 - DNA, 356 bp, Zea mays
  Clone ID: LIB3067-025-Q1-K1-B2-F4A
gtccttcgtgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtacttctggaagcaaaatccaaaccgttcatggtgtgatactgtgatgcatctgtttgcccgcctttgtgatgtgtggtatagtggtggtgcataatgacatggaaatgcttctctaactgtatcattcattccataaatcctaaacgaggaatgggaagtggattgttaagcag

SEQ ID NO: 53060 - DNA, 538 bp, Zea mays
  Clone ID: LIB3067-025-Q1-K1-B2-R5A
ttaagccaccaccacatcaagtcaagcacatctttggaaatagtgttggccgacgtagcctccagccatggctcttctcacatttgcctcaaacatctttggattgtcacgaaggacaactgcagcttcgtggttcagaggatcctcgtcgtttggttgcgtaaaaagaagattcaggccataaataacagtgttgatgttgagaacaggcttccaatcttcgcgcagaatgttcagacatacattgccttccagatcaatatttggatggtacaccttggtcttgcatttgaccttcggaggatcatgaggataagatgaggacacttgaaaggtgaaaacgaaagtgcctcccatgtaatatccttcatcaggtcggatggtggtctcaaaattcatcagatcatccttgccattgggaaaagaaattgacgtggtcttcgccagttgagctcactaatatctttatgaaaacggagctccccagcagactgttttttacaggggcctttccagcacactggctgcttcctttttt

SEQ ID NO: 53061 - DNA, 382 bp, Zea mays
  Clone ID: LIB3067-025-Q1-K1-B2-R6A
gtgtctcaaattatcagatcatccttgccattgggaaaagaaattgacgtggtcttcggcaggttgagctcactaatatctttatgaagacggagctccccagcagactgtttcttaacaggggcctttccagcagcacttgctgcctcctctttcttttgaccctttattttgaaaagattaatcatctttcttgccgcttcagaacggagctcgctagaggagcggtgtccttgcttgcactaagggaccaggaaacgccggagagaatcggttttcgccggaggggggagggcgaggcctctaggcggcgggagtaggacccggaacaaggaggcgtccgcgtgcgtcgttccgccggacgcgtgggcggacgcgtggg

SEQ ID NO: 53062 - DNA, 544 bp, Zea mays
  unsure at all n locations
  Clone ID: LIB3067-034-Q1-K1-H1-F4B
atttctttgaggtcattctgcgagctaggcagaggaaagagattgtcattgggtaccgtcttgaggcagctgagcgtgccataatcaatccaatagacaaagtttcaaggcgaaggtggtcacccaaggatgtttttgttgttatatccgagaaagaatgaggtttatcagatcacagttgacacaaaagcaagctcctgaccagtgaccacacctaatgaagaacaggcagctgcgccgnacacacacacacacaccgaccagcgcatagagctatttgattcagatgcgcatttggcagaaggcaagcgctgagcgcgaaggagtaaaagcatgatcagatattcagatctttgatcagtctagactgacaccttaggtcgccctttacaaatatgacttaaaaaggatgtgaacagagtagtacagcacatgctttggaagtttggatattcttgtccgtgtaactttccacatgaacaacgagcaaagcatcttctgcatatgcatcaattaatggcttaaaaaaaaaaaanaanaaaaa

SEQ ID NO: 53063 - DNA, 450 bp, Zea mays
  Clone ID: LIB3067-034-Q1-K1-H1-R5B
gtccctgcgacaacatgtaaaactaatgattgcttgcatgcaagacgactctccaggatatctgttatcagcagtaaagttgcaagtgacctagagtcagttcggattgctgaatgttgtacagattcatctgccaaaatcaggatagaatcgaatgattctaaaggaaggctctccaagtgacggtgaataacagtattgccctcacgatgcaccaaagtaatatcatcgaggcgactgaagtccaaacctgcatgaattagctttctttctctgtcaacctcagggacatcattaaacatccacaactctgatcctggcgcaaggaaagcatcaagtaccattatcatatcttctatatcacggcgccaaccacaaaacaatattctttctggagactttggaacaacaaaatctttaggcagataccctctcctaacctgcacaatt

SEQ ID NO: 53064 - DNA, 305 bp, Zea mays
  Clone ID: LIB3067-049-Q1-K1-D8-R3B
cgcttactgaaggtcccctcatgaaactgctctggctgcctgcaggcgactctggaggacgcccggcatccgctctcgaacacctgctatagggaggcgggtcacaacatagtgggcgtgccgttacagacgggtgcactggtagcaccctctggcgaccgagatgaatgcgcttgtgcacgatacgactttggcgagctgcgatgctaccacagaggcgtgcaccgatcgcacttgcgaaacgttgcccgcgctggccggggagtggacgcgccctgtcgccgcccgatggcgccacgcgcacg

SEQ ID NO: 53065 - DNA, 462 bp, Zea mays
  unsure at all n locations
  Clone ID: LIB3067-060-Q1-K1-F3-F3A
aggtatacaatttctcggtgctttctgtcttaccaatctactctaagctcatcaaagcaggactgagagtgtggctctacagtggggatgcagatggtagggtcccggtgatcggatcgcggtattgcgtggaagccctgggcctgcctgtcaagacgcagtggcaaccatggtacctgaacaaacaggttgcgggcagatttgtggagtaccatggcatgacgatggtgacgatcagaggagcagggcatttggtgcctctcaacaaacctgcagaagggctcgcactcatcgacacattccttcagggcaaacagcttcccacacacagatgacaagagtacttagggttgtgattgtgatgagggttattgttttcaaaaaaaaaatcaaggattggacaaactatgtgccccacacacacgggctaatcagtaaggatttcatttncagtttctgcat

SEQ ID NO: 53066 - DNA, 687 bp, Zea mays
  Clone ID: LIB3067-034-Q1-K1-H1-R3CA
gcaaggccaataacactgcagcaaccaacatggcaactagggaaggggaacttgcttacacctgagctgcctcccgctctcggttccactgctcaatctttgccctccgctcctcgctgccttccctcaccgggctccggctccggctcctcgaccgcccgcgtcgacggcggctcccgtcgctgtcgtggctgcggtgtctctcgctgctcctgcggctgccactgccactacggtagtagtggtagtagtagtcgtggtaatcgtcgcggtccctggacctggacgagctaccgcggcggcggtatgggctcgggctgcggctgcctcggctgtggctccggagggagcgatgcaggtggccaaacagcttccgccgcaggtcccggccgacctgcttgacgtgcataaagttgcagtatccgccgcggttgcagctgtgctcctcgaactggcggcaggtggcctcccggaagtccgtcaccggcgagaactcggcgatgatgggtcggcccgagtagtagcggccctgcagcgcctgcagggcgcgggccgcctgctcctcctcgcggaactccacgtacacgttcccgatcatgtggtccgcgaggttgtcgcagacgtggaggctctcgatctcgccgtgcttgctcagctccacgaagatgtcctcgtagaaagtcctcg

SEQ ID NO: 53067 - DNA, 407 bp, Zea mays; identical to SEQ ID NO: 38657
  Clone ID: LIB3067-049-Q1-K1-D8-R5C

SEQ ID NO: 53068 - DNA, 404 bp, Zea mays
  Clone ID: LIB3067-049-Q1-K1-D8-TA
acacgaagggtggcttagctcgcaacagaagaaaaacgcggatatttgatttaaaacaaaaacataacagaaaatttatggaataaccttttggcctaacggaaaagccccccccatgggcccatccagaaaaacaccgcttacttgatatttaaagaccagcggataacaggcggacctggaggtggcccttccttttaaaagctttattactaaaaggccatacgaaacggaaccacttaacacacggtgcctggcgggggtggcctatccaccggtgccgcaacggaaggatggaggcgccaagggcttcacgaggcgacctccttcatcgattcatgccgccgagggcccccccggtggatttcttttagccccatgggcacacattgcagggggaactc

SEQ ID NO: 53069 - DNA, 114 bp, Zea mays
  Clone ID: LIB3067-034-Q1-K1-H1-R3DA
ttcgagctgtaccggggatacttttaaacaacttgcacctacaacacactgcatgatgtcttttctgcataattgcacataagcatccgatgccatgtctggactcggtaccta

SEQ ID NO: 53070 - DNA, 627 bp, Zea mays
  unsure at all n locations
  Clone ID: LIB3067-049-Q1-K1-D8-R3C
tattcgacgtggaaggtccggagcaggtgaaggtgctggtggcgtcgtcgtaggcgtagctgtaggccgacgggcatgcgctcttgaacacctgcgagtagttggtcgggccgcacatcgccggcgtgccgtactgcccggtgcagcagtagcgcgcgctgccgtaggcgatgcacgcgctcttgcacgctacgacgccgccgccggacgatgcgacgacgcggaggtccccggggcacacggcgtttacgtcgcccgcgcaagccgcggggcggcagtcgccgccgccgcccgagggcgccacgcgcaccggcacgttgaagccgtcgacgaggctgacgtcgtagaagtccggcctgccgctgcccggcgcggcgagcgtgacctcgacgagcgagaccggaggcgccggcccgcggccctggcacgcgacgtcgcccgtgccgcagtcggccgtggcgcangagaagcgcccggtggcggngtcggccacgcagcccgtgcgcgcccacaacgtgccggaccatgtccccgacgacggcgcgtccatgctggacgtggcggacggcgccaggtagaagcccgaccgcgcgagcggcggcgagctggcgccgtggagcgcgccca

SEQ ID NO: 53071 - DNA, 520 bp, Zea mays
  Clone ID: LIB3067-049-Q1-K1-D8-R3D
agtccggagcaggtgaaggtgctggtggcgtcgtcgtaggcgtagctgtaggccgacgggcatgcgctcttgaacacttgtgagtagttggtcgggccgcacatcgccggcgtgccgtactgcccggtgcagcagtagcgcgcgctgccgtaggcgatgcacgcgctcttgcacgctacgacgccgccgccggacgatgcgacgacgcggaggtccccggggcacacggcgtttacgtcgcccgcgcaagccgcggggcggcagtcgccgacgccgaccgagggcgccacgcgcaccggtacgttgaagccgtcgacgaggctgacgtcgtagaagtccggcctgccgatgcccggcgcggcgagcgtgacctcgacgagcgagaccggaggcgccggcccgcggtcctggcacgcgacgtcacccgtgccgcagtcggccgtggcgcacgagaagcgcccggtggcggagtcggccacgcagcccgtgcgcgcccacaacgtgccggaccatgtccccg

SEQ ID NO: 53072 - DNA, 329 bp, Zea mays
  unsure at all n locations
  Clone ID: LIB3067-049-Q1-K1-D8-R5D
gcatacataagtaaataaacaataccctcagaatttacatgttgcacattccgagggcaaaancaaaacanggttggcctatgttatctgctgctctagtctggttattctaggctagagcacagtacaagtgcaaaccttacagtatccttccaacgatatcccatgcatctcacgaaatttacgctggcaagtcggctggtttatatacatatatctggtccggggtaccggtgaggtataataaattaattattaattgggctactggcccgcgccggctttagcttggagccgaaattccgagcttactttacgcggtgcaattg

SEQ ID NO: 53073 - DNA, 270 bp, Zea mays
  Clone ID: LIB3067-049-Q1-K1-D8-TCA
attgggctcgagctaagaccgtgcgggcagtagcctatttataattaatttgatatacctactacggaccacggaccagatagatgtatattaaccagccggctcgccaccgtatatggcgtgagaggcatgggatatcgttggaaggatactggaaggttagcacttgtactgtactctagcctagaattaccagactagaacagcagataacataggccgtgcatgtatgatatggacctctaatgtgcacatgaaatctgagggatt

SEQ ID NO: 53074 - DNA, 90 bp, Zea mays
  Clone ID: LIB3067-049-Q1-K1-D8-TGA
gagcactgacgcgtgccgaatatgagctgaacctatacatcaacatggaatgtgtgatcgcagcttcacatgtacggctggtacagcgac

SEQ ID NO: 53075 - DNA, 285 bp, Zea mays
  Clone ID: LIB3067-007-H4-F3B
tgaattaaatctgatcatggatggatttggactggacaaggaggggccgggtcagcctaaattaggtgtgattgcaagggcgcgacctgtaataatctctctttcatctcctagattccttcttttcatctttacttcttccagaatttggttaattcctgctttatgtgattggaatcattccttaggaattgctgcttctcatatgtctttgcattgcatgtttgatgtggctatcttgaggcatgtgatccatgcctaattcgatcctcttagattgctagc

SEQ ID NO: 53076 - DNA, 644 bp, Zea mays
  Clone ID: LIB3067-007-H4-R4C
ggctgcggcttctcatcaccggaggcgagcaccgccttcggaactaccgctccgtcaccaccgtctccgagctcgaagaccccgcgatctgcaccgtcgtgctcgagtcctacgtcgttgacgtccccgacggcaacaccgaggacgacacccgcctcttcgccgacaccgtcatcaggctcaacctccagaagctcaagtccgtcgccgaggccaacgccgccgaggccgccgcaaccaccaattccgtccttctgccgcggccggcggagtagcggcggctgccatcggcaagggaagaaagcaacagcaagttttgtgcgtttctgttatttcaattctctgggaaagggtttctctgaattaaatctgatcatggatggatttggactggacaaggaggggccgggtcagcctaaattaggtgtgattgcaagggcgcgacctgtaataatctctctttcatctcctagattccttcttttcatctttacttcttccagaatttggttaattcctgctttatgtgattggaatcattccttaggaattgctgcttctcatatgtctttgcattgcatgtttgatgtggctatcttgaggcatgtgatccatgcctaattcgatcctcttagattgctagc

SEQ ID NO: 53077 - DNA, 475 bp, Zea mays
  Clone ID: LIB3067-007-Q1-K1-D4-F2A
caaataattcacttctcttaactctgattttagccgactgttcctctgcctcaacatcattaactactccacggcatttggggaatccacaaaaacatggaagtcgttgatcacttgaaaaaaacctataatcatatgtcagctcttcccatggatctatgtcccgtttcgcaaaaatgatgatgtgttcatctccaagaatagttatggcacgtgaatagcaattaggctcgcatgagtgattgatcagacgggctatacttccaacccgagtggcatctataacacgttcatcatctatcctgaacatatatgtcccagcacccactagtgagttgtaaattcgccgctctctagtgtctgatatcggtggtctaacaatctcccctatgtattcaaccatcatatctccggccttgtgtgcaaccttggcaaagacaccatatccatgaatttttgattttccaaaagttag

SEQ ID NO: 53078 - DNA, 477 bp, Zea mays
  unsure at all n locations
  Clone ID: LIB3067-007-Q1-K1-D4-R2A
ctaacttttggaaaatcaaaaattcatggatatggtgtctttgccaaggttgcacacaaggccggagatatgatggttgaatacataggggagattgttagaccaccgatatcagacactagagagcggcgaatttacaactcactagtgggtgctgggacatatatgttcaggatagatgatgaacgtgttatagatgccactcgggttggaagtatagcccgtctgatcaatcactcatgcgagcctaattgctattcacgtgccataactattcttggagatgaacacatcatcatttttgcgaaacgggacatagatccatgggaagagctgacatatgattataggtttttttcaagtgatcaacgacttccatgtttttgtggattccccaaatgccgtggagtagttaatgatgttgaggcagaggaacagtncgctaaaatcagagttaagagaagtgatatatttgaa

SEQ ID NO: 53079 - DNA, 679 bp, Zea mays
  Clone ID: LIB3067-023-Q1-K1-F10-R4A
ctctcatactgttccgagagacatctaattcatcaccattagaaccttcaccaaaccttgaagtactatgagcattcacaccactgtcctctcttccaaccacatgctgttcaccctgcacatatttcatgtcaacatctttctcgtatattcgttccttctcagcctcttccaagttaagcagcctggcgaccatcatttctttaccaccacacagagagaggccattatgtctacagcggcgttcaagttcagctagtgggagccctaatagctcctttgtcgctgctgcctttccagtagccaaggcaccgtcttcattaagcttaaatccatcatttccatcctcagagctacctttcttttcaatttcgggtgcatcaccgcataacgagtgaaacggaacaacaccagagttgcctgatctaagaaaagtagccctcagcccattaagaaatgcatcagaaaacaggaaccagtctgcccaaacttgtagaactttcataaccctctccttcagagcttcagcagtaatccttccagtgatactgcgatacaagtcattaaagctctccataacatctggcaaagaagcttcaaacttcgttcggaatgcagatgcgttcttcacaggagcgctactgttatgaaggatgtcagacactaacataagccgagc

SEQ ID NO: 53080 - DNA, 498 bp, Zea mays
  Clone ID: LIB3067-039-G9-F4B
tgcgaatgcaacggcttgccctaagcaactaacgaactggagctcggtgcaaggatcctctcgatccgaaaatacggtttgcgaaccgtgttgttttttcaatgtttaacacagtcttgggcatgaaaatcgtcatccttggtttttgcttcaagaaggacacaggtgacacgagagagacttcagcgattgatgtttgtaacaaattagttgcagacaagggcaagcttgacatatacgacccacaagttcttgaagaacagatcagaacagatctttccatggctaggtttgactgggaccaccctgttcctcttcagcagattaaagctgaaggtattttatagcaagtgaatgtcgtcttaaatgcttaccaggcaactaaagattcccacggcctatttgtcttaacctgatgggatgagtttaaatcctttgaccttcaagaaaattttttggcattttcagaaaccaagcttttttgtttcgatggttgga

SEQ ID NO: 53081 - DNA, 581 bp, Zea mays
  unsure at all n locations
  Clone ID: LIB3067-002-D4-F3A
gctgcgccaagtgtaccagcagcagcaggtcaaggtggccaccaccggcggcgccgacatcgccaccgccgcctcgccgtcgatgcaggccaggcaagagctgctcgcgtgcgagggcgctgctattcgatagcggaggcggcggcggcggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaatgcatcgatgccaagttgtgaatgaattgtactattcagttatttggaccggcttagtcggaatatagtgagacggagtttgttggtgtgagttatccgttcttaatttattgttgtttagattgattttatttaaaaaaaaaaaaaaaaaaaaaccaagaaaaaaaaaaaaaagaaaaaaaaaaaaaaaaaaaaaaaaaaaaaaaaaananntnnnnaaaaaaaaaaaaataaaaaaaaaaaaaaaaaaaaaaaaaaaataatgggggggggcctttttagg

SEQ ID NO: 53082 - DNA, 358 bp, Zea mays
  Clone ID: LIB3067-001-Q1-K1-E3.F2
gggggggggggggggggtttttggggggggtgggtggttttttgggggggtttggttggggtttttggggttgttgggggggggggggggggggtttttggggggttttgggggggccttgggtgggttgtgttttttgggggggggtttttgggggttgttgtttttttttttttgggggggggtttttgggggggggggtttgggtggttgggggttttgggggggtgtttttgtggggttgggggggggggggttttggggtggtgttgttttttgtttgtgtggggtgtgctgttgtgggggggggtgggggcgtttgtgtgtggggggtttttttggtggggggggggggggg

SEQ ID NO: 53083 - DNA, 392 bp, Zea mays
  unsure at all n locations
  Clone ID: LIB3067-001-Q1-K1-E3.R2
gntgtagnatgattggagtacatcacttcacttaatcatgaaatctgtagaaggcgaaactactagccatatatgatatgcataatccgtgtggtaaacattatcaatatcacacaaattatttctaaaaaaaaaaaaaaaaaaaaaaaaaaaaaaaaaaaaaaaaaaaaaaaaaaaaaaaaagggaaaaaaaaaaaaaaaaaaaaaaaaaaaaataaaaaagaaaaaaggttaaaaaaaaaaaaaaaaaaaaaaaagggggggcgctttttgggggatcaaagttttataaggggaggcgcgggggtaaactttttttattggggaacccgtaatataacttatgggcggggtttttaaaggcgtgggcgtggaaaaacttgttttttccc

SEQ ID NO: 53084 - DNA, 603 bp, Zea mays
  Clone ID: LIB3067-002-Q1-K1-F10-R2A
acgcgctgttcctttgcagcgacgccgccggcgaccagcagcgggacagcagctactacgagcgcgagaacgcgctcacggtcatcgggagcaacccgctgcggcgccacctggccctgggctacgacgactcccactcccacgacgacggcgcgtcgtcagctggctctgaccgcgtggacggcatagagctcgccgcggcggcgccggcgccggcggtcgttaagaagcaggtgaggttcgcggtggctccgcccaggagccccggtgtggacgagaccgtgttggaggagctgcacgagctgtgcgaggcgcgcgaggccggcacggcgttcatcctgggccactcgcacgtgaagaccaagcccgggtcgtcgatactcaagaggctggccgtcggcgtcggctacaacttcttgcgacggaactgccgcggcccggacgtggtgctgcgcgtgccgccggcgtcgctgctcgaggtgggaatggtgtacgtgctgtgaccagaacgtggcggtgatgggtgactgcgatctctgcgtccggttttcgctgcgtgaactacggatctctctgctctgtgatgtgctattcctattatgc

SEQ ID NO: 53085 - DNA, 549 bp, Zea mays
  unsure at all n locations
  Clone ID: LIB3067-005-Q1-K1-G10.F2
cnncgtgntctggggcagtgtcgctcnnncccancgtggcgtgggccantgttcttctgtctttaccgctcnnnttggcgccggtcttttcntccctcncttccttttctctttttnnttgggccccgttttccggcggcgcgcggccttgttctttgnncctttnngaggggtggncttggtggcgggcttggtgccctcggggacggcgtgcttggcnngctcgccggggggggcgnggcgccccgcggtctggttctcgcggggggtggcggtgggcttcttgtttttgcgcgcccgcttggcgggctcggccgcgngcttctcgnngntgtcgttggtggnggggttcttgttgggcctggccttgggcgggntgccgntgtcggggtgcgcctgcttctgcnccttggnggtgttggtcttgttggtcttcccgggcttcttcgctttctttttcccctttttgccctcgccggcctcctttccggcgggcttgcccgccggggggggctttttgggcttgggcttttttcccgtcggggcctt

SEQ ID NO: 53086 - DNA, 372 bp, Zea mays
  Clone ID: LIB3067-008-Q1-K1-H9.F2
aattgtggcgccttggcgtgaacagatccacacctcggccgctaaatcaaactgcgcgcgctccatgataagcggagagcccccgtcagatcaccaccatcttattcctatccaaaggaacggacccatgctttagttgacaatcacggaggggggggggccgaacctaccagatcagagagatctaggagagctgttctgacccagggaccttgaccaccttggaagttcccccggtggggaagcccaccttttggatggccttgaccacgtgcatgccgtggactacttgttcgaagacgaagtttttgccgtctagccaaggggtttctacagtgcattattaataaatggaatcctttggggttgggc

SEQ ID NO: 53087 - DNA, 459 bp, Zea mays
  unsure at all n locations
  Clone ID: LIB3067-008-Q1-K1-H9.R2
tcctgcccgccaaggcatggcgcgcgaggggaaagaggggcccgcaagaagggcaagaagagcgtggagtacctactagatctacatcttcaacgtgctgaagcaggtgcacccggacatcggcatctgctttaaggccatgtccatcatgaactccttcatcaacgacatcttcgagaagctcggcgccgaggccgccaagctcgtgcggtacaacaagaagcccaccatcacctgccgtgagatccatacctccgtgcgcctcgttctccaaggtgagctcgccaagcacgccctcttccagggcaccaagggccgcaccaagttcacctcgttctaagctgcgtgtgctccgcttggaggcttccctcgtatgntcgcgtgtcttgctgcacttaggtgctgctgtgtgtggtctcctccggtagcgactgttatctgatgggacagtgacaatgc

SEQ ID NO: 53088 - DNA, 560 bp, Zea mays
  Clone ID: LIB3067-010-Q1-K1-C10.F2
aatcccctaataaatcttatctccatcaaactatccatctcactaaccatatttaaactctactctgtccagatggacgttatgttgggaacagtgttttacagtgctcaaacatggacgaaaatctttcgcattgcacagactgagttaacaccgtgtttcacggtggcctatttttgtcgagcgtcctgtagtgtgtttcgtttcacaaacagtgagaagatgacagctcaggagtcgagacacaggtgctgagatgcctgctggggttcctccgcggtgattttagacagagcaagatgttttgatttcgcactgtaatgtttacctaaacgagtatctggaggcaagcctacaagcttcggtagtccatgacggtcacttcgtcctcgggagcatccaggtcttggtagcttcgtattcgacgagggtcatgcatatgatgaggcggaggagcactgaagactggggacggaccacgcattggaggaccgccgctgcccgtccctgctttcctaggatgtggacctccactgggctcaaaagaggtggcgcaccct

SEQ ID NO: 53089 - DNA, 614 bp, Zea mays
  unsure at all n locations
  Clone ID: LIB3067-010-Q1-K1-C10.R2
tcgcccacgcgtccggggatcagggtgcgccacctccttttgagcccagtggaggtccacatcctaggaaagcagggacgggcagcggcggtcctccaatgcgtggtccgtccccagtcttcagtgctcctccgcctcatcatatgcatgaccctcgtcgaatacgaagctaccaagacctggatgctcccgaggacgaagtgaccgtcatggactaccgaagcttgtaggcttgcctccagatactcgtttaggtaaacattacagtgcgaaatcaaaacatcttgctctgtctaaaatcaccgcggaggaaccccagcaggcatctcagcacctgtgtctcgactcctgagctgtcatcttctcactgtttgtgaaacgaaacacactacaggacgctcgacaaaaataggccaccgtgaaacacggtgttaactcagtctgtgcaatgcgaaagattttcgtccatgtttgagcactgtaaaacactgttcccaacataacgtccatctggacagagtagagtttaaatatggttagtgagatggatagtttgatggagataagatttattaggggaattaaaaaaaaaaaaaaaanaaaaaggcggccgc

SEQ ID NO: 53090 - DNA, 520 bp, Zea mays
  Clone ID: LIB3067-019-Q1-K1-C12.F2
gcagccttagccgaggtgaacttggtgacggccttggtgccctcggagacggcgtgcttggcgagctccccgggaaggacgaggcgcacggtggtctggatctcacgggaggtgatggtaggctttttgttatagcgcgcgagcttggcggcctcagcagggagcttctcgaagatatcgttaatgaaggagttcatgatcgacatggccttggaggagatgccaatgtccgggtgcacctgcttcagcaccttgaagatgtagatcttgtaggtctccacgctcttcttgcccttcttcttgcccctcttgccctcgccgccctccttggcagcggacttgccagcggggacccgcttctccgccttcggcttcttcccggcgggcgccttctcggccgcgggctcctcctccgccggcttcttcgccgcgggcttcttctcggccttgggcgccatcgatgcggggcgagttggggtttgggttgcgaagggggatgggaagaaatgcgaggagatct

SEQ ID NO: 53091 - DNA, 522 bp, Zea mays
  unsure at all n locations
  Clone ID: LIB3067-019-Q1-K1-C12.R2
tccnatctcctcgcatttcttcccatcccccttcgcaacccaaaccccaactcgccccgcatcgatggcgcccaaggccgagaagaagcccgcggcgaagaagccggcggaggaggagcccgcggccgagaaggcgcccgccgggaagaagccgaaggcggagaagcgggtccccgctggcaagtccgctgccaaggagggcggcgagggcaagaggggcaagaagaagggcaagaagagcgtggagacctacaagatctacatcttcaaggtgctgaagcaggtgcacccggacattggcatctcctccaaggccatgtcgatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 53092 - DNA, 624 bp, Zea mays
  Clone ID: LIB3067-028-Q1-K1-H6.F2
gaagataaagacagcagcaacctatataggaccatgtggttatttcttatttgaacagttcggtaagcatggcaggcagcaaagtgggcaggcaacagcactcgtagcgatctctgaaggacacggcacttctcaaggcaggggaaccaaagcgctggctaagccatccacgcaggagggtagcagccgcccggcgctggctctggctgctggttcatgtccatagtatggtatgtaggttgcagaggcgcgttgctctccagagccacgaagaagtgttctggctgtggagggtcatgggacaacatgccgcctccgccttgccacgccaattgcgggggagaagcagcctctgcctcaaactcgtgcagcttccttttcagaaccctgttagcgtcttgcagcatttgttcctttctctttaagtcgcaaagttcatcaagtaacacctgagtctttcttgatcttatttgcttcaaggtcttgtctacttgactctcaagctggtcaagttcacttgggctaagtggagccagttcttcaccaagaagatcctttgtgagtgttgtaaaacctcaactcgtgctttcagctccacatattctttgatagttattctgcatc

SEQ ID NO: 53093 - DNA, 673 bp, Zea mays
  unsure at all n locations
  Clone ID: LIB3067-028-Q1-K1-H6.R2
tccgccccacgcgtccgcccacgccgtccgcccacgtctgtccgcccacgcgtccgcgtcgntcggggcccaattgagnntgtgagagctcgaaaaaacccaggggnatnncggccggnaccagcagcgagcgagcgncgnagctctgcgtgncgtgtgtnngtgtctggctctagnnattagatcacctccattcgtcaataatgtgcaggcgagatccattagtctgctggtggncgagacaaagcaacggatcgtcgtcgatccggagagcggaaagcgcgcagatcgcgacggccatggggcgcggcaaggtggtgctgcagcggatcgagaacaagatcagccgccaggtcaccttcgccaagcgccggaacggcctgctcaagaaggcgtacgagctctccatcctctgcgacgccgaggtcgcgctcgtcctcttctcccacgccggccgcctctaccagttctcatcctcctccgatctgcttaagactctagagcggtaccagaggcacatctatgcttcagctgatgctgcagttccatcttgcgatgagatgcagaataactatcaagaatatgtgaagctgaaagcacgagttgaggttttacaacactcacaaaggaatcttcttggtgaagaactggctccacttagcccaagtgaact

SEQ ID NO: 53094 - DNA, 252 bp, Zea mays
  Clone ID: LIB3067-032-B1-F3A
actgccagtgaattaccatcatcaagcctacatggatcagctgaacaacgaggacctggtggacccgaatgagcatggtcgatctggatggatatgaaatgctctgatgaccccaaataaaggtgatgcacagcagggattcaccctgcaggacgcgagactatgtattgaggctaagacctcgtgtgtgttgtgttgtgtgcgaagcttggaactttataaatcgttgtcatgcccatggctttctatttc

SEQ ID NO: 53095 - DNA, 66 bp, Zea mays
  Clone ID: LIB3067-032-F8-F3A
aaactttacatgtcatgaacagcaaagactgtgcctccttaatgctacaggtttgcggcattttgc

SEQ ID NO: 53096 - DNA, 551 bp, Zea mays
  Clone ID: LIB3067-042-Q1-K1-B11.F2
attaaaacatattccttatagattatgggatgctacttaaaacatgcatggtaagatactgcagacacaatacagttactttcttacataaaagacatcaaccgagcccagaaagcaaacgcagcggcaactaccaccgggggaacacacctaaccgtactactatggtactactgcaagaagaggagacgagtgcacgtcgcatcgctcgcctaggagctagtgaacttggtgacggctttggtgccctcggagacggcgtgcttggcgagctcgccggggaggacgaggcggacggaggtctggatctcgcgggacgtaatggtaggcttgttgttgtaccgcgccagcttggccgcctccgccgccagcttctcgaagatgtcgttgatgaaggagttcatgatggacatggccttggacgagatgccaatatccgggtgcacctgcttcagcaccttgaagatgtagatcttgtacgtctccaccgacttcttcgccttcttcttccccttcttctcgccaccctcctttgccggggacttgcccgc

SEQ ID NO: 53097 - DNA, 632 bp, Zea mays
  unsure at all n locations
  Clone ID: LIB3067-042-Q1-K1-B11.R2
ccgcctccccgnatcttcgtcgaggagggaagccccatcccgaaacccgccgccgtattccaatggggcgcccaaggccgagaagaagcccgccgccaagaagcctgcggaggaggagccggcggcggagaaggccccggcggggaagaagcccaaggccgagaagcggctccctgcgggcaagtccgcgggcaaggagggtggcgagaagaaggggaagaagaaggcgaagaagtcggtggagacgtacaagatctacatcttcaaggtgctgaagcaggtgcacccggatattggcatctcgtccaaggccatgtccatcatgaactccttcatcaacgacatcttcgagaagctggcggcggaggcggccaagctggcgcggtacaacaagaagcctaccattacgtcccgcgagatccagacctccgtccgcctcgtcctccccggcgagctcgccaagcacgccgtctccgagggcaccaaagccgtcaccaagttcactagctcctaggcgagcgatgcgacgtgcactcgtctcctcttcttgcagtagtaccatagtagtacggttagggtgtgttgccgcggtgggtagttgccgctgcgtttgctttctgggctcggttgat

SEQ ID NO: 53098 - DNA, 238 bp, Zea mays
  Clone ID: LIB3067-045-B5-F3A
gagcttccttcgccggagccgacgaggtttggcttcgccaccgcggtcaaggcagcagttgatggcgtgatgaccaccactccaaaggatgtgcaaggagatagagcagtaaaaaagcgcggtcggaagaaccagtacaggggaattaggcagcgccctttgggcaaatgggcagctgagatcaaggaccccaacaagggcgttcgcgtctgggtcggaacctacaacaccggcgagg

SEQ ID NO: 53099 - DNA, 626 bp, Zea mays
  unsure at all n locations
  Clone ID: LIB3067-045-B5-R3A
ccggcggcctgttcctattctcttcggcgctccgccttgcatgtaagagtaagacgccggagcgaagaccgaggaggtgtagtccgaggtcatggcggcggcggcggcggcgtcgtcccacgaccacgaccccaccaagtcggaggagccggagccgtaggagttgctgctctggtcgtcggagacggagaccataatgttggtcgcggacgacctcctcttattaccgggcaccgccgccgccatcgcaggcgcagggactaggaagctgtcactgccactgccactgccaccctcggcggcggctggcttcgctgcaggaacggcctccttcttattgtcaccgaacgcaaacatcgcaaacagatcatcgttgttgttgttgtcgccgtcgtcgttcttcaggttgttaaacatctcatcggcgcaggccttcgggggtgggggtggagctactagcctcgctgcgttcgcggcgttcgttggcctgtgacgagtgcctgtcgcgtcnncatcggagaaactcacctcagctatattactgcggatcttgagagctccggccacttgtgctctagatgccttcttggcagagacggaggttcagagccagacgcggacgccct

SEQ ID NO: 53100 - DNA, 494 bp, Zea mays
  Clone ID: LIB3067-045-Q1-K1-C4.F2
ggtcttaaattctagagcttgcgctggcataacaaaagcgttcttcattactactcatcaactcaaatgctgctgcggggctttattagcaccagggggggcaggtctcccgacacactctttggtgcacatgcaagccccgtgcttgcaaaacccgccgggattgccctcgctcttgcccacggtgacccagttctcgctctgggggcaccaccctttgaaggtcctgcctcttctgcccagcttgccccacataggggcgcttctcttgctctgacgtagagcgccactttccccctgatggcttgctcacggccgcaacgcttttgtcactagggtgctgctcctggtactcctgcctgaattcagacttgaccaccaataaagccgaaggagggcgcttggacttgccgctcgcggcggcctttttgcgcttttcggggcctccttcggcggcccggagcctgccctcatccttcttggaggcgttgccc

SEQ ID NO: 53101 - DNA, 558 bp, Zea mays
  unsure at all n locations
  Clone ID: LIB3067-045-Q1-K1-C4.R2
cccacgcgtccgcccacgcgtccgcccacgcgtccgggccaacgcctccaanaaggatgagggcaggctccgggccggcggcggcggcgccggaaagcgcaagaaggccgccgcgagcggcaagcccaagcgccctccctccgctttcttcgtcttcatgtctgaattcaggcaggagtaccaggcgcagcaccctagcaacaagagcgttgcggccgtgagcaaggcagcaggggaaaagtggcgctctatgtcagagcaagagaagcaaccctatgtggaccaagctgggcagaagaggcaggaccttcaaagggtggtgccaccagagcgagaactgcatcaccgtctgcaagagcgagggcaataccggcgggttctgcaagctcggggcttgcatgtgcaccaaagagtgtgtcgggagtactggcgctgctggtgctaataaagccccacagcagcatttgagttgatgagtagtaatgaagaacgcttttgttatgccagcgcaagctctagaatttgaggccgagatgaccaaaaataaatgattttgtt

SEQ ID NO: 53102 - DNA, 380 bp, Zea mays
  Clone ID: LIB3067-047-C2-R3A
cgtgaaggcatacttcttgtatagtgtaacctacatgcaattgactgcgcgcaggcttacaaacatcgggactgcgaaaaccctggagttaccgaacataaccggcgcggaaacatgccactcttgacctatggcgtgtctctgagaggcccctaccgatcgggcttgccaacacattgccatcctgaaaggcgaataggactcgccctggagcggctcattaatgcgctgcagaagtggtggttactcgcagcgacacctgttcacttgtcacctgcctaacgtccgctagtttcgctttaatacccttatttgttgtcacgatcaccggcttttcccgtcgaacttttaatcgggggctacccatagggttccgactc

SEQ ID NO: 53103 - DNA, 563 bp, Zea mays
  Clone ID: LIB3067-056-Q1-K1-F12.F2
gataaccgagaacttcattgccattgcatagtcatagttaaattacagcagggtagacccaactacatcatgatttgaccgataacccaaactacagaacccggcacatttttacaccttctagccagacagtgatgacggaaacggccactactacttccacctccaccgggacgacgcctaggccctctccccacggatacggcgggcgagctggatgtccttgggcatgatggtgacgcgcttggcgtgaatggcgcagaggttggtgtcctcgaagagcccgacgaggtaggcctcggacgcctcctgcagcgcggcgacggcggagctctggaagcggaggtcggtcttgaagtcctgggcgatctcacgcaccaggcgctggaacggcagcttgcggatcagcagctccgtgctcttctggtacttgcggatctcccggagcgcgacggtgccggggcggaaacggtggggcttcttcactccgccggtcgccggggcagacttgcgcgccgccttggtggccagctgcttccttggcgccttgccgccagtggact

SEQ ID NO: 53104 - DNA, 674 bp, Zea mays
  Clone ID: LIB3067-056-Q1-K1-F12.R2
tcccgtttcgacccagcgttcggcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctaggcgtcgtcccggtggaggtggaagtagtagtggccgtttctgtcatcactgtctggctagaaggtgtagagatgtgccgggttctgtagtttgggttatcggtcaaatcatgatgtagttgggtctaccctgctgtaatttaactatgactatgcaatggcaatgaagttctcggttatc

SEQ ID NO: 53105 - DNA, 575 bp, Zea mays
  unsure at all n locations
  Clone ID: LIB3067-059-Q1-K1-C6.R2
cctgccgccgggcgccgcgcctggtgcagnnatcgtgccgtggnggcgggcttgcagtgggatggggcgcgggccgactaccggcgaccccgcggnaggccatggngcctcaagtacatccagtacgagatcggtgtcgccgagagcacgctcaaggacaagttccccagcgggcacaagatcttcaccaacccgacggcgctacacaagaaggggttcatgttcatcaggcagacgctcatggacggccaggacatcaccgttgacgtcggccgcttcagggaggtgctgctccaggtgctcaacagcctcgcacagtagccgtctgcgtgctcactgctcagcacggtgctacccccaccttagtagtactcctgaagtatatacacacagctacgcactacacagccatgtatacgtacaatactttagttgcaactttgtactggagtatcattgttacggatgtacactctacagagagacctttgcgtggtcaccggtccatgggggcataatactgtactacaatgagagagggaaatcttangggtgtgttttgggtttgcccctgc

SEQ ID NO: 53106 - DNA, 344 bp, Zea mays
  unsure at all n locations
  Clone ID: LIB3067-060-Q1-K1-C4-F128A
caccntgtcatgagcggcgctgagttctcaggccggatttgctgcatggcatgcccgagtatcaccgaagcgcgtgttcttgtgtcgtgtgtccgtgtctgtcagtcagtctctatgtgttgcccataataaacaaagacatgcgagtaccagacatgtgcaactctagtagtatggtgcgtgttatcactaggcacgcgtactcgtatagttgtgttcagttctgggtctatagagatatgtagccctgcattgtcgaaataaatactgtgtccactcgttcgtgaaatgaaaaaaaaaaaaaaaaaaaaaaaaaaaatgatgaggtataaagttccaaaaag

SEQ ID NO: 53107 - DNA, 416 bp, Zea mays
  Clone ID: LIB3067-060-Q1-K1-C4-F2A
atctttttttttttttttttgttttttttttttttttttttttttatataattaatttgaaggcatgtgaatgttttagaaaatttatgattaaaactttaaaggcgtgtagattatgatgtatgaaaaaaaaaaaccatgtaaaaaaaaatattataaaaacgagggggataaaatatttgattaacccaaaaacaaaaaaaatataagaaggcccagggtaattgtagaaacacacccaaacccaaaaaaggggaccgggttggcgccaacctgggatgtgttaaagaggaaaaacaaaagaggaaattaagaaaccatagggaaaagaaaaaaaagtccaccatttaggaaaattaggacaagccaaagaaaaaaatacgggcgagaaaaaccaaacctctcaaggggggggg

SEQ ID NO: 53108 - DNA, 571 bp, Zea mays
  Clone ID: LIB3067-060-Q1-K1-C4-R1A
gtagaatgacgatgaggggtctctctgttgcggtcgctctggtcgtggtggtggccgcggcctgccttgccgcgccgcggggcacttacggcgcgggcgagtgcggtgcgacgccgccggacacggtggcgctgaggctggcgccgtgcgcgtcggcggcggaggaccccggctccgcgccgtccggctcctgctgcagcgcggtgcacgccatcgggaagcagagccccaagagcctctgcgccgtcatgctgtccaacaccgccaggagcgccgggatcaaggccgagggcgacatcaccatccccaaacgctgcaacctcgccgaccgccccgttggctacaagtgcggagattacaccctgccatgagcggcggtgagttctccaggccggatttgctgcatggcatgcccgagtatcaccgaagcgcgagctcttgtgtcgtgtgtccgtgtctgtcagtcagtctctatgtgttgcccataataaacaaagacatgcgagtaccagacatgtgcaactctagtagtatggtgcgtgttatcactaggcacgcgtactcgtatagt

SEQ ID NO: 53109 - DNA, 156 bp, Zea mays
  Clone ID: LIB3067-045-C12-A7P1-A
ccgcgggaacagttcggccaagccatcaagaccattgttggattcctgttaacaaagggcggcccgcattttcgcggcgtgccccccacgggggcagttttattttcttccatgaggactccacccgccttgaagtggtcatttttaacatagggc

SEQ ID NO: 53110 - DNA, 335 bp, Zea mays
  unsure at all n locations
  Clone ID: LIB3067-045-C12-A8P1-A
ctagagcgcgccgccaccgcgcggagacacatatccacgtccattgcatcaccatcagccttggttttggtcttctttttcttgcttttcttgggagatgcatcggtcttctcgatatcatcatcatccattgaggtgccattgaccatgctgtcaatagcggctttcatcacatcaaggtttttacgagcgcaacancccttgtcatagaattccagtctctcctcgacttgctcacgcaacttttgcccaaagacagaggtgctagcctccgagtagcagtcaatcggacgcgtgggcggacgcgtgggcggacgcgtgggcggacgcgtggg

SEQ ID NO: 53111 - DNA, 194 bp, Zea mays
  Clone ID: LIB3067-045-C12-B7P1-A
accgccaccgatggtaagaagaataagaaaaagaaggctaaggccgaggatgatgagtagccaagttatttgttgtatggcgtatgaatccgagagtatttgttgaaaaacagagatgaacgcctgcctagctcaactagcttgtagttcatgagcgtttgatgcaaacccaactcaaagtacgaagttttcct

SEQ ID NO: 53112 - DNA, 85 bp, Zea mays
  Clone ID: LIB3067-045-C12-B8P1-A
tcacgctagtcaagtgcgaaccgcagacttagatcagcgttcctgagtctcgccttcttcactcgtacgtctgcgcttctcgagg

SEQ ID NO: 53113 - DNA, 322 bp, Zea mays
  Clone ID: LIB3067-045-C12-D10P1-A
aaggaaaacttcgtactttggttgggtttgcatcaaacgcctcatgaactacaagctagttgagctaggcaggcgttcatttttgtttttaaacaaatactttgggattcatacgccatacaacaaataacttggctactcataatcctcggccttagccttctttttcttcttcttcttaccatcggggggggtcttaggttcagctttttcggaagcttcacgggtcttttttttctttttcttagggggagtatatgctgcaccgttctcctcctgggcctcctcctccagattaagcttctttttcttcttcttcttc

SEQ ID NO: 53114 - DNA, 468 bp, Zea mays
  Clone ID: LIB3067-045-C12-D7P1-A
aggaaaacttcgtactttgagttgggtttgcataacgcctaatgaactacaagctatgttgagctaggcaggcgttcatttttgtttttcaacaaatacttttggattcatacgccatacaacaaataacttggttactcatcatcctcggccttagccttctttttcttcttgttctaaccatcggtggcggacttaggttcagcttcttcggaagcttcacggctcttctttttctttttcttaggggtagtatttgctgcaccggtctcctcctgtgcctcctcctccagcttaggcttctttttcttcttcttcttgtcagttccaggctcaactttttcaccagcaacgttggagggtttatccacgttcattgcattaccatcagccttgggtttggccttctttttcttgctttttttgggagatgcataggtcttttcgatatcatcatcatccattggg

SEQ ID NO: 53115 - DNA, 322 bp, Zea mays
  Clone ID: LIB3067-045-C12-D8P1-A
aggaaaacttcgtactttgagttgggtttgcataaaacgcctcatgaactacaagctagttgagctaggcaggcgttcatttttgtttttcaacaaatactttcggattcataccccatacaacaaataacttggttactaataatcctcggccttagccttctttttcttcttcttctaaccatcggggggggtcttaggttcagcttttttggaagcttcacgggttctttttttttttttcttaggggtagtatttgctgcaccgttctcctcctgggccttctcctacagcttaggcttctttttctttttcttcttc

SEQ ID NO: 53116 - DNA, 316 bp, Zea mays
  Clone ID: LIB3067-045-C12-E10P1-A
cccacgcgtccgcccacgcgtacgaggacgcgtgggcagcagagagattactacgatccaacagttctagagcaagagagaggaagacacaccgcagagttagcaggctaataacttgcaagagcagcaggaatggcggctgacgcgtcgactctcttgctttatcctagccgtgcttctggcatgagtggacgctgccaccgacttcaacgaagcggctgctgtcggcttcagacttggacacagagcacgtttcgcgcgcaagcatggacgtgctgtcgatgagatgccccagtcggagccacaacctaaaact

SEQ ID NO: 53117 - DNA, 493 bp, Zea mays
  Clone ID: LIB3067-045-C12-E7P1-A
cgccaccgcggtgaacacagtcttaggttcagcttcttcggaagcttcacggctcttctttttctttttcttaggggtagtatctgtttgtccgttctcctcctgtgcctcctccggcagcttatgcttctttttcttcttcttcttctcagttccaggctcagcttctccaccacacgttggagggtttatccacgtccattgcatcaccatcagccttggttttggtcttctttttcttgcttttcttgggagatgcatcggtcttctcgatatcatcatcatccattgaggtgccattgaccatgctgtcaatagcggctttcatcacatcaaggtttttacgaggcgcaacacccttgtcatagaattccagtctctcctcgacttgctcacgcaacttttgcccaaagacagaggtgctagcctccgagtagcagtcaatcggacgcgtgggcggacgcgtgggcggacgcgtgggcggacgcgtggg

SEQ ID NO: 53118 - DNA, 392 bp, Zea mays
  unsure at all n locations
  Clone ID: LIB3067-045-C12-F10P1-A
accgnggtgaacacacnacagtccggggggctggaaagcacaacgtgagcacagcgaaaacaatgtcagtacccaaactaattttttaccccaacatgcacactttatcagcgggggtcgtatgtaatgggccattgcgagccgccaacaccatcagacaggcaacaggtatgaccatgggtacgccccgtgctactgcgacttactctcgggaaaggtggtgctcacgcacataccgacccgtaaactcggcatcgacctacgcgcccgtccacgcgttcgcccacgcgtctcggtacccatggtcgccagatataccactacagatcaaacaggctagatccctagagaggaccacacaacggctagacagcacgctaaccactagaaac

SEQ ID NO: 53119 - DNA, 182 bp, Zea mays
  Clone ID: LIB3067-045-C12-F8P1-A
acgggggtcttttttttttaaatgtgcctggtatccttttttttaggaaaacttcgaactttgagttgggtttgcatcaaacgccttatgaactacaagctagttgagctaggcaggcgttcatctttgtttttcaacaaatactttcgggttcatacgccatacaacaaataacttgggta

SEQ ID NO: 53120 - DNA, 498 bp, Zea mays
  Clone ID: LIB3067-045-C12-F9P1-A
ggccgcacaccgcgatgaacacaatggcacctcaatggatgatgatgatatcgagaagaccgatgcatctcccaagaaaagcaggataaagattaccaaaaccaaggctgatggtgatgcaatggacgtggataaaccctccaacgttgctggtggagaagctgagcctggaactgagagaagaagaagaaaaagaagcatacgctggaggaggaggcacaggaggagaacggtgcagcagatactacccctaagaaaaagaaaaagaagagccgtgaagcttccgaagaagctgaacctaagaccgccaccgatggtaagaagaagaagaaaaagaaggctaaggccgaggatgatgagtagccaagttatttgttgtatggcgtatgaatccgagagtatttgttgaaaaacagagatgaacgcctgcctagctcaactagcttgtagttcatgaggcgtttgatgcaaacccaactcaaagtacgaagttttcct

SEQ ID NO: 53121 - DNA, 250 bp, Zea mays
  Clone ID: LIB3067-045-C12-G7P1-A
aggaaaacttcgtactttgagttgggtttgcattaaacgccttatgaactacaagctagttgagctaggcaggcgttcatttttgtttttcaacaaatacttttgggttcatacgccatacaacaaaaaacttgggtactaatcatcctgggccttagccttttttttcttcttcttcttaccattgggggcggtcttaggttcagcttttttggaaggttcacggctttttttttttttttttttaggg

SEQ ID NO: 53122 - DNA, 530 bp, Zea mays
  Clone ID: LIB3067-045-C12-G8P1-A
ctagaccggccgccaccgcggtgaacaacaacaaataacttggctactcatcatcctcggccttagccttctttttcttcttcttcttaccatcggtggtggtcttaggttcagcttcttcggaagcttcacggctcttctttttctttttcttaggggtagtatctgctgcaccgttctcctcctggcctcctcctccagcttatgcttctttttcttcttcttcttctcagttccaggctcagcttctccaccagcaacgttggagggtttatccacgtccattgcatcaccatcagccttggttttggtcttctttttcttgcttttcttgggagatgcatcggtcttctcgatatcatcatcatccattgaggtgccattgaccatgctgtcaatagcggctttcatcacatcaaggtttttacgaggcgcaacacccttgtcatagaattccagtctctcctcgacttgctcacgcaacttttgcccaaagacagaggtgctagcctccgagtagcagtcaatcg

SEQ ID NO: 53123 - DNA, 300 bp, Zea mays
  unsure at all n locations
  Clone ID: LIB3067-045-C12-H9P1-A
nncgccacgcgtnncgccacgcgtnncgccacgcgtnncgccacgcgtncgattgactgctactcggaggctagcacctctgtctttgggcaaaagttgcgtgagcaagtcgaggagagactggaattctatgacaagggtgttgcgcctcgaaaaaccttgatgtgatgaaagccgctattgacagcatggtcaatggcacctcaatggatgatgatgatatcgagaagaccgatgcatctcccaagaaaaagcagaaaaagaagaccaaaacccaggctgatggtgatgcaatggacg

SEQ ID NO: 53124 - DNA, 476 bp, Zea mays
  Clone ID: LIB3067-007-Q1-K1-D4-F2B
caaataattcactttttttaactctgattttagccgactgggcctctgcctcaacatcattaactactccacggcatttggggaatccacaaaaacatggaagtcgttgatcacttgaaaaaaacctataatcatatgtcagctcttcccatggatctatgtcccgtttcgcaaaaatgatgatgtgttcatctccaagaatagttatggcacgtgaatagcaattaggctcgcatgagtgattgatcagacgggctatacttccaacccgagtggcatctataacacgttcatcatctatcctgaacatatatgtcccagcacccactagtgagttgtaaattcgccgctctctagtgtctgatatcgggtggtctaaccatctcccctatgtattcaaccatcatatctccggccttgtgtgcaaccttggcaaagacaccatatccatgaatttttgattttccaaaagttag

SEQ ID NO: 53125 - DNA, 475 bp, Zea mays
  Clone ID: LIB3067-007-Q1-K1-D4-R2B
ctaacttttggaaaatcaatttttcatggatatggtgtctttgccaaggttgcacacaaggccggagatatgatggttgaatacataggggagattgttagaccaccgatatcagacactagagagcggcgaatttacaactcactagtgggtgctgggacatatatgttcaggatagatgatgaacgtgttatagatgccactcgggttggaagtatagcccgtctgatcaatcactcatgcgagcctaattgctattcacgtgccataactattcttggagatgaacacatcatcatttttgcgaaacgggacatagatccatgggaagagctgacatatgattataggtttttttcaagtgatcaacgacttccatgtttttgtggattccccaaatgccgtggagtagttaatgatgttgaggcagaggaacagtcggctaaaatcagagttaagagaagtgaattatttg

SEQ ID NO: 53126 - DNA, 256 bp, Zea mays
  Clone ID: LIB3067-022-Q1-K1-B12-R4B
ccgcggtacaggccgcggacgccgtccgcgaggaggatcttccggaaggcgtccgcgccgccgcggtagcggcaggcgtccggggtctggtccatgagccgctggctgatgacgtctacgggggtccacaccacctgcgccgcgacggccgcggacacgcccgccgggcggacgcggcggccgacgccgcgggctccgagacgcccagccggacggcggccgacccgacggagctcttggtggccggacgcgtggg

SEQ ID NO: 53127 - DNA, 258 bp, Zea mays
  Clone ID: LIB3067-022-Q1-K1-B12-R4C
ccccgcggtacaggccgcggacgccgtccgcgaggaggatcttccggaaggcgtccgcgccgccgcggtagcggcaggcgtccggggtctggtccatgagccgctggctgatgacgtctacgggggtccacaccacctgcgccgcgacggccgcggacacgcccgccgggcggacgcggcggccgacgccgcgggctccgagacgcccagccggacggcggccgacccgacggagctcttggtggccggacgcgtggg

SEQ ID NO: 53128 - DNA, 692 bp, Zea mays
  unsure at all n locations
  Clone ID: LIB3067-023-Q1-K1-F10-R3B
ggcttgcacttttcccgcgtaccctatccctccccacgtcgttgccatgagaccggtccctaccgcgatagtgctctcgatccctcncttgtgacttccttggagggctcaagcttctactctggctccggcgccgtttcctaggatgatcatgtgcatcgccatgcctctctttccgctccgacgacgatgatgttctttcagaagatcgcctgctgttagcaccatcagctggagtggataaaccatattctgactggagacgtcttcgatggctggcaaccttcctctcaatctcatccaagtcacgcagaccctgctcctcaagagattcacggtactgcatgacagaaatttcaatctgcctcaacttctgcctgtgctcttcatcaacaatcgtatcatgatgatgacttgtgtggtcagtactagcttctgttgtatcgacctttccgagaccatcagcaatatcgcttccggatgaatagcttaatcccaagcctcggccacctttcctatcttcatcgtcactgatgtcatcctctcgactccatttagaagctggcaaaacaggatcgtatttcggcttcttgcttggaaatgattcaagttcggcagaagcagatccaccagaacgtcctttaccagctctcatactgttccgagagacatctaaatcatcaccattagaa

SEQ ID NO: 53129 - DNA, 430 bp, Zea mays
  Clone ID: LIB3067-023-Q1-K1-F10-R5B
gcagtaatccttccagcgatactgcgatacaagtcattaaagctctccataacatctggcaaagaagcttcaaactccatacggaatgcagatgcgttcttcacaggagcgctactgttatgaaggatgtcagacactagcataagccgagcaacctttgttggaatagacgtctccttgagtgtcaaggattctgtaagaacctcaacaatctcgccagctgcatcagcattatccaaggcaaatcccatggcgtcttttatttggctcctctctaatgtcaaagctcgcagcatgtcctcaaattcatcacgctgtgagtcagtcaatgtacgctccacttcaacacgcctgcttctaccagcagcaaatgtagattccttttcacgttcagggcttctgttggacgacaagggaggtgggacccatc

SEQ ID NO: 53130 - DNA, 410 bp, Zea mays
  unsure at all n locations
  Clone ID: LIB3067-023-Q1-K1-F10-R5C
ctgcgatacaagtcattaaagctctccataacatctggcaaagaagcttcaaactnccttttggaatgcagatgcgttcttcacaggagcgcttttgttatgaaggatgtcagacactaccataagccgagcaacctttgttggaatagacgtctccttgagtgtcaaggattctgtaagaacctcaacaatctcgccagctgcatcagcattatccaaggcaaatcccatggcgtcttttatttggctcctctctaatgtcaaagctcgcagcatgtcctcaaattcatcacgctgtgagtcagtcaatgtacgctccacttcaacacgcctgcttctaccagcagcaaatgtagattccttttcacgttcagggcttctgttggacgacaagggaggtgggacccatc

SEQ ID NO: 53131 - DNA, 727 bp, Zea mays
  unsure at all n locations
  Clone ID: LIB3067-034-Q1-K1-H1-R4A
cggatataacaacaaaaacatccttgggtgaccaccttcgccttgaaactttgtctattggattgattatggtttgctcagctgcctcaagacggtacccaatgacaatctctttcctctgcctagctcgcagaatgacctcaaagaaatttaattcctctcttctctaaggtaaagatcagaaggtcgtatttgcatttcatttccttgttcagcgaagagctcctccaagacattatttatctgccgatcttctgcgaccattgccaatgccatgctcactaattcatttgaaagaacgtagtcactaatttttgacactgacaacaaattttttgtcctggggtccaaaatttcactgattatgacagatttatcagatgcttgttgcatctcccctatccaagaaccttcagaaaaggtccctcgggaacatgtgaaataatgattcctgcatggaagacgttttgcctgaatatctcttatcagcagcaaagttgcaagtgacctcgagtcagcttggattgctgaatcttctacagattcatctgccaaaatcaggaatagaatcgaatgattctaaaggaagggctctccaagtgacggcgaataacagcatttccctcacgatgcaccaaagtaatattatcgaggcgactgaagtccaaacctccatcaattagctntctttctctgcaacctcaggacatattaacaccacaacttg

SEQ ID NO: 53132 - DNA, 729 bp, Zea mays
  unsure at all n locations
  Clone ID: LIB3067-049-Q1-K1-D8-R3E
ggagcaggtgaaggtgctggtggcgtcgtcgtaggcgtagctgtaggccgacgggcatgcgctcttgaacacctgcgagtagttggtctgtccgcacatcgccggcgtgccgtactgcccggtgcagcagtagcgcgcgctgccgtaggcgatgcacgcgctcttgcacgctacgacgccgccgccggacgatgcgacgacgcggaggtccccggggcacacggcgtttacgtcgcccgcgcaagccgcggggcggcagtcgccgccgccgcccgagggcgccacgcgcaccggcacgttgaagccgtcgacgaggctgacgtcgtagaagtccggcctgccgctgcccggcgcggcgagcgtgacctcgacgagcgagaccggaggcgccggcccgcggccctggcacgcgacgtcgcccgtgccgcagtcggccgtggcgcangagaagcgcccggtggcggggtcggccacgcagcccgtgcgcgcccacaacgtgccggaccatgtccccgacgacggcgcgtccatgctggacgtggcggacggcgccaggtagaagcccgaccgcgcgagcggcggcgagctggcgccgtggagcgcgcccacccacaccgngtgcttgcaggcgttggtgaagatgaacgacgccgctccatccacgcctagcgccgtcaagagaaaaagctgaagaatcaagagaatgggccatctgttcctgctagctcc

SEQ ID NO: 53133 - DNA, 547 bp, Zea mays
  unsure at all n locations
  Clone ID: LIB3067-049-Q1-K1-D8-R3F
ctggtggccccgacgtaggcgtagctgtaggccgacgggcatgcgctcttgaacacctgcgagtagttgngttggccgcacatcgccggcgtgccgtactgcccggtgcagcagtagcgcgcgctgccgtaggcgatgcacgcgctctgcacgctacgacgccgccgccggacgatgcgacgacgcggaggtccccggggcacacggcgtttacgtcgcccgcgcaagccgcggggcggcagtcgccgccgccgcccgagggcgccacgcgcaccggcacgttgaagccgtcgacgaggctgacgtcgtagaagtccggcctgccgctgcccggcgcggcgagcgtgacctcgacgagcgagaccggaggcgccggcccgcggccctggcacgcgacgtcgcccgtgccgcagtcggccgtggcgcaggagaagcgcccggtggcggggtcggccacgcagcccgtgcgcgcccacaacgtgccggaccatgtccccgacgacggcgcgtccatgctggacgtggcggacggcgccaggtagaagcc

SEQ ID NO: 53134 - DNA, 327 bp, Zea mays
  unsure at all n locations
  Clone ID: LIB3068-010-Q1-K1-H4.F3
ccgcggnacgcgacgacccgggggggcaccgagagcgcgtaggtcttggtcttccacttctgcagcgcagcctcccactcctggtcctcctcctcctcctgcgtcgcctcaaccaccgcagcggtccccggagggggcggaagcgcgagggctcgggcacggttgcggaagaaaaaaantaatattcaaaaaatcaaaaaaacacaaaaactaaaanattaattnacaacaacaaaacaataaaaaaaaaatataaaaaaaaaaaataaaaaaataaaaaaaaaatataaaaaaaaaaaaaaaaaaaataaacataataaantaaat

SEQ ID NO: 53135 - DNA, 508 bp, Zea mays
  Clone ID: LIB3068-010-Q1-K1-H4.F4
gggtcaagttcagccgagtctgcatggcagctgagttgttcccttggggactcttggctcggctatgccatccgtagggattgctagagcctatcaagaatgctgaagaacaggattggtttcatagcctgagtgacagatggaaggtccatttgtgcaggaaccagaacggagaagcagatcctaatggtacaatatggggagttccatacagatggggcaccatggtcattgcttacaagaaagacaagttcaaaagacataatttgaagccaatacaggattgggaggatctgtggaggcccgagcttgccgggaggatttcaatggtcgattctcctagagaggtgattggtgctgttctgaagcatctggggtcatcatataacacagctgatatggaaatggacgtcaatggtggtagagcggcagtcctaaacagttttacgcaactacagaagcagggccaactattcgacagcatgaactatctgaagtcgtttagtga

SEQ ID NO: 53136 - DNA, 203 bp, Zea mays
  unsure at all n locations
  Clone ID: LIB3068-010-Q1-K1-H4.R3
cgagctggncacgaaccttgtcagcggagttcctccgcccgagatcctggagaggtgcgagtttctggaacccctgtcaggtaaggcgctggaggactaccagtggctgatgtctcgggtgcagagacctcgtcttggtttgtttgggaacatgttgcagaagatgtcagctgtacttgacttcaaaagaagatcttagagcc

SEQ ID NO: 53137 - DNA, 682 bp, Zea mays
  unsure at all n locations
  Clone ID: LIB3068-010-Q1-K1-H4.R4
tccggggntagagtcttggcggnagggtaggctccttgcgctctgcggcagagtcgaaccactggtgaaccagtggagacgggcctctggctcggctcccgatttggtcagtctgaaatctcgtcgcgcatggtattgcccatagatcagcccataggctgctgcctgacttgggaacaaccaccgcgacattagacattcgctttgcagcagggatcacgtcgctgctccaacccactgcgacccatacgtctccaacactaaacgacttcagatagttcatgctgtcgaatagttggacctgcttctgtagttgcgtaaaactgtttaggactgccgctctaccaccattgacgtccatttccatatcaactgtgttatatgatgaccccagatgcttcagaacagcaccaatcacctctctaggagaatcgaccattgaaatcctcccggcaagctcgggcctccacagatcctcccaatcctgtattggcttcaaattatgtcttttgaacttgtctttcttgtaagcaatgaccatggtgccccatctgtatggaactccccatattgtaccattaaggatctgcttctccggntctggttcctgcacaaatggaccttccatctgtcactcaggctatgaaaccaatccttgtcttcagcattcttgataggctct

SEQ ID NO: 53138 - DNA, 350 bp, Zea mays
  unsure at all n locations
  Clone ID: LIB3068-011-Q1-K1-G12.F3
gcgcctgctggttcccctggtgtctgtcatgtcatccacacagggtgccagttgttctcttctctttcttttcttttctcttctcttggcttgtatatcggatccatatatgctggtggtgcttgaacgaactgttgttgtttgcttaaccgtgcaaacatatacagtggtctatacactacattcagaacccaaaaaaaaaaaaaaaaaaagggcgggccggtcttaaagagatccaagacttaccgtaccccgtgccatgcgcacgncatagatttcttctatagtggtcaccctaaatttaattnacctggcgcgccgcgtttacaacgtccgcgactggggaaaac

SEQ ID NO: 53139 - DNA, 438 bp, Zea mays
  unsure at all n locations
  Clone ID: LIB3068-012-Q1-K1-C5.F3
gcttatctctccacgaataaatagccaaggtgtccgttcatgnancccatgctaaagtctcaattaattcctgccaatatccacgccagggaaattaagaacataaatcctgtagcccaaacaagatgtccaaataagaacatccaagcccatactgataaactattcatcccaaaaggattatatccattaataagttgtgaagagtttaaccataggtaatctcttaaccatcccatcaaataagtgggaggattcattaaattgtgaaacgttgccctgccataatgtaatgggttttcaatgccaataaaaaggaacccatccaatgggatttaacatccaaaaaactgccaaataaaaagcggcccaaggagaaaatcacaagtaccgccgggccctgggccgggggaaggaaaactattacccgaagtcctt

SEQ ID NO: 53140 - DNA, 373 bp, Zea mays
  Clone ID: LIB3068-012-Q1-K1-C5.F4
ccccctgttccgggatacacatgactaaagtcctgtccaagccaaagaacttactccgaaagtcctgacaaatgatgattcagacgagaattcggcgtttttgaaaacaaaagcttggcttccatttgggttgtagatgtaaccaaccccctattaatgatagcgtagaaagaaataagtagaaaaagagctccagtataaagatattcattggtgcgcaatccaattgtataccaccactgataaaccccagaataagcgatattcactggaccggcagtacctcctagagtaaaggcttccacagtggattgcccaaaatgaggatcccaactggcatgagcaataggtcttacgtgtaaacacacgcgtg

SEQ ID NO: 53141 - DNA, 306 bp, Zea mays
  unsure at all n locations
  Clone ID: LIB3068-012-Q1-K1-C5.R3
aaaaaaaaaaaaaaacattttccggggttnatnttnccttntagcgctttcttgnatgcctcacatcagcagtttggttaatttagttatttttttttgtactgtnatcagnnaacccagttcattactcttgaggagagggaggatccgcctttttagatttttgctatttatttttctatctaggattagaaccatatacttggtaataataggaacggcacattatggcaaaaaaagtttgattcagagggagaagaagcggcagaaattagaacaaaaatatcatttgattcgtcgatcctt

SEQ ID NO: 53142 - DNA, 162 bp, Zea mays
  unsure at all n locations
  Clone ID: LIB3068-038-Q1-K1-F1.F3
ccccatattgcgactacatagnattgtttgtaaaaggtattgttcttttccttatgatcgcgatgttggccaaccattgcgggtagaatgctagagcccgggaccacgttctattatttttttcttctccttatattgatctttttgatttttnccgattaa

SEQ ID NO: 53143 - DNA, 423 bp, Zea mays
  unsure at all n locations
  Clone ID: LIB3068-038-Q1-K1-F1.R3
ggctganaaactcgcaggaaagttccaccgacgtctattaaatcgacgggttttcaaagcacaaaaacgcatacatatgtctgttttcaaagcacaaagagttctagatgagattcgctggcgttactacngaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatngaaaaaattcagacctcgagctcgaggacgtagttattctataaaaaaaacgatgtgtaatataacaattgtactaaatatagtaaagaaatcaaaataatctttagatcaatctaagatttcgattcccagt

SEQ ID NO: 53144 - DNA, 253 bp, Zea mays
  Clone ID: LIB3068-038-Q1-K1-G2.F3
cgcctccgcgcactccgcacgtcgagcacgagccgaagcgaagagttgccgtagtagccgtccttggccttggccggcttccttcacgttcaccgtgaggcgagcgccgtgggggcgtccgggctggcggcgctgccgatcgtcgcgcgggcacggcacttccatatggcggcggagaacacgtcgaacgcagagcacgtagacacctggccgatgccgatgccgaagctgcaaagacagaactcgcccttga

SEQ ID NO: 53145 - DNA, 245 bp, Zea mays
  unsure at all n locations
  Clone ID: LIB3068-038-Q1-K1-G2.F4
cctggcgtcctgcagggtgcagctcgccgncgcaccgacgaacgctacgccctcgccggtgcacgcgagcttcagctggtccccagtgacggcgaggcggccggccattgggtagtagggaacaagcgcacgggacagagctcttctaatggtctcggccggacgatcgatggggttctcgtagacgaacatcgctgacacgggcagggaaaccagagctctgtccatggaggagagctggaggg

SEQ ID NO: 53146 - DNA, 495 bp, Zea mays
  unsure at all n locations
  Clone ID: LIB3068-038-Q1-K1-G2.R4
cctcccttctgctggtgcaggtgaccgagttttcctgtggcggcttcgttgtcggggtgacgtgngaccacgtcctcacggacggcgccggcatggcgcagttcttgaaggccgtcggcgagtttgcccgaggttccccttccccttccgtcttgccgatgagggtggacgacaccctctctgaactccccccgccaataaccaccatgactaaggcactcgtcagcagcaagcccagagacatgccgtcctcctacatcacagttcccctgagcttcgtcgaccgcatcaagggcgagttccgtcgtcgcagctacggcagcggcagcggccaggtgacgacgtgcactgcgttcgacgtgttcaccgacgacataaggaagtgccgaacccgcgcgacgatacgnagccccgccagcccggacgcccccacggcgctcgccttcaccgtgaacgtgaggaaccccgccaaggccaagaacagctactacggca

SEQ ID NO: 53147 - DNA, 663 bp, Zea mays
  unsure at all n locations
  Clone ID: LIB3068-043-Q1-K1-C2.F3
tcttgctgggnaattctccatcatgtgattgcaagttgatcaaaacctttgctgctcggtgtagaggcgttggatctctctcggcctggcctgcatcaatcagcgccagcatggcccaactagtgttcactgcatgaggccggttgcctttgagattggtgtaaacctggtcttgagatgacaaatagctttctccccaaccaccggaaggaagttcttttgacaacagaaagtcgcatgcctttctaattgcaggactgttctcaaatgttctaccagcagcaattagtcccttcacaccaaaccaagtgccgtatgtgaaacaaacggcccaagagccataccatgaaccatcgcttttctgaatactctcgatgaaattggaagctttgctgatacagttatccacctctttcctgcggtgcccagggtatagnttttttgaatgatgtcagggcctgaattgctgctgatgtacattcaacatacgggtaatcaatcacaatatccccaaaggtctcagcaggattgatcagctccaaccagggataagatcttgtgagttcatatgtcgcgaagccgccattatcattcatataagacatcagacaactgacagcatcataaaatctattagcttccatcgggtcaccaacaattttg

SEQ ID NO: 53148 - DNA, 420 bp, Zea mays
  unsure at all n locations
  Clone ID: LIB3068-043-Q1-K1-C2.F4
tttgggggggataccttgntaacaataatgggaggcctttagtccttcagcagtgcaatcagatataggccaaccatgatcagcagttgagaatggccatgcacctttagatgtgtggcggtaccagtcattcagatcaccagggcagtcatcaagaacctgtgaattcttgatatagttgtgtgctagtttaagggtaggaccaaactcttcaataaggttggtagccacaatggcttgaactgtgaaagctgtatcccaaagttggctgccattataaccctgcatcttcatgccatcttcagcaagccacaagtaatcatagactcgtgggatatgaagtttgaaggcctccgagtttggatcttcaatccagcaagcaagcatattcaataccggacgcgtgggcggacgcgtggg

SEQ ID NO: 53149 - DNA, 235 bp, Zea mays
  unsure at all n locations
  Clone ID: LIB3068-043-Q1-K1-C2.R3
tttgggctctgggtgagtaccggtngccggtcttgggggctggcaagtcttggcggtgaacgggaggtgtgcgtgtgtgtgtgtcatggatcggcttttgtgagtagccatgtggaagttggaataatatagctacgttacgttcagggggttgcgctactagtggtcctagtaataatagtgatggtgatagcaatgtactcctcattattacaatctcaaagtggttcatgcc

SEQ ID NO: 53150 - DNA, 686 bp, Zea mays
  unsure at all n locations
  Clone ID: LIB3068-043-Q1-K1-C2.R4
tgtctggtagtcttatatgatgataatggcggcttcgcgncatatgnaactcacagnatcttatccctggttggagctgatcaatcctgctgagacctttggggatattgtgattgattacccgtatgttgaatgtacatcagcagcaattcaggccctgacatcattcaaaaaactataccctgggcaccgcaggaaagaggtggataactgtatcagcaaagcttccaatttcatcgagagtattcagaaaagcgatggttcatggtatggctcttgggccgtttgtttcacatacggcacttggtttggtgtgaagggactaattgctgctggtagaacatttgagaacagtcctgcaattagaaaggcatgcgactttctgttgtcaaaagaacttccttccggtggttggggagaaagctatttgtcatctcaagaccaggtttacaccaatctcaaaggcaaccggcctcatgcagtgaacactagttgggccatgctggcgctgattgatgcaggccaggccgagagagatccaacgcctctacaccgagcagcaaaggttttgatcaacttgcaatcacatgatggagaatttcctcagcaagagatcataggagtgttcaacaagaactgcatgataagctactcccagtacaggaacatcttcccgatttgggctc

SEQ ID NO: 53151 - DNA, 671 bp, Zea mays
  unsure at all n locations
  Clone ID: LIB3068-043-Q1-K1-E3.F3
ttgcgtgtaccaggcttgggttggngcctataccaattgtagcatggcatcttgaatcaacagccttctcagcacctgagggaaggcgcaggacacacttggcgcctggctcctggactaccttagcatatgtaccagctgctcgaaccatcttcccaccctgaccaggacgacattcaatattatgcacccaggttccaattcgtgcattggctaatggtatacaatttccaacctttgagttgagatcaattatatcgaactgattttccaaggaatatggtgaagaggctgaactcttagaaggcttcgaggaattatagttcatcactgtactacctggcatgcactggtgactggccaatatataagacactggtatgcaatcagcctttccctttggccctttactcgtaccactagtctttgctgccaagctactggaagctgttagcttgtgtcttaagcaaatgtttcttcttcagttcattctgccaggagagtgcagcttgacgcttcattctctgtgcccaaagcacatcatctgttgcccatttctgaatctcagtaaaggaaaatgtatgttttccttcttcatccgctttggcttgagcaaagaatgtgggcttggcaccagctacagctatcctcggtaagctcgatgacgcacc

SEQ ID NO: 53152 - DNA, 398 bp, Zea mays
  Clone ID: LIB3068-043-Q1-K1-E3.F4
ttggcccctccaccacggtggaaaaagtgatgcgcccagtagagttcctcccagccgtcttcgatgaactcagagtcagacgcttcagcgctcccgtctttgctcgatccctcacaagcgagagagcagactgacgtgccatctcgttgaaagggatggagactgtacaatagctccgagtggagactctccaaaatgcaaagatgttctaggctcagaaagcggcagggacaagacctagacgggttggccggcggtcgcatcatctctgaggtgagatggtccgaggagacgatggctctcggcagcaggaaagaggtcagtcgccttgccggcggctacgagtggtgtgctgcggagcgagggagatcgaggacggctacgatgggcccccgggg

SEQ ID NO: 53153 - DNA, 349 bp, Zea mays
  unsure at all n locations
  Clone ID: LIB3068-043-Q1-K1-E3.R3
tgtggntcatccccaggtggnggcgaggggcgtacctaaggaggcaggccttcagtttctccctgggaagcccacaaagcagggtaccgatcaccaagtgtggccagtcggaaagcgtttgctggaacaaagctcatacagttcagaaataaagaatatgtgtttgtggcagagggaactgtgataatcgacttgattctggtgcagcagaagaaatggttgttatcactccaatcgacaacacagaataaatgttttcactccaatggttgttatcgctacttttccccttttgtcattctgcagaaactagctcttcatgaaacctgattagtgaatttcttcctgt

SEQ ID NO: 53154 - DNA, 690 bp, Zea mays
  unsure at all n locations
  Clone ID: LIB3068-043-Q1-K1-E3.R4
tcctcggaccttgctcttgtgcgagggtgcaggggtgcatttccgccgccccagnatccacagnaactcagtgccatgtctcaaatccaacaatctgctacagctgatgtctccggccggttttcccttgctgcattatctagtagagtgcataaagataaggaagcttctgcactgtactctgctctgggaaatggagatatttctgcatctcttaaatctggtgcgtcatcgagcttaccgaggatagctgtagctggtgccaagcccacattctttgctcaagccaaagcggatgaagaaggaaaacatacattttcctttactgagattcagaaatgggcaacagatgatgtgctttgggcacagagaatgaagcgtcaagctgcactctcctggcagaatgaactgaagaagaaacatttgcttaagacacaagctaacagcttcagtagcttggcagcaaagactagtggtacgagtaaagggccaaagggaaaggctgattgcataccagtgtcttatatattggccagtcaccagtgcatgccaggtagtacagtgatgaactataattcctcgaagccttctaagagttcagcctcttcaccatattccttggaaaatcagttcgatataattgatctcaactcaaaggttgngaaattgtataccattagccaatgcacg

SEQ ID NO: 53155 - DNA, 449 bp, Zea mays
  Clone ID: LIB3068-049-Q1-K1-D6
cggacgcgtgggattgttttgtcacaccgagaacccatacttacctaaactgtgtgtgtgtgtgcaggtgccaatggcttggcttcgccgagggatttcctttccccgacagcatggtttgagcaggagcaccaccctggatacacaatagtgcacaagtatggtggcgagctgttcagcgccacgcaggatttctctccattcaacgtggtcgcgtggcatgggaattatgtcccttacaaggtgtgttgtatgccattgtacacctgtctgccattgagatgtgtgtcgctgttcactccacccccttctctttcagtatgatctgagtaagttctgtccattcaacaccgtcctcttggatcatggcgacccgtcagtgaacacagttctaactgcgccaactgataagcctggcgtcgcgttgcttgattttgtaatattcccac

SEQ ID NO: 53156 - DNA, 293 bp, Zea mays
  Clone ID: LIB3068-051-Q1-K1-C5
cggacgcgtgggcgagcatcttcgacgccaaggccgggattgccctgaacgacgacttcgtcaagctcgtgtcgtggtacgacaacgagtggggctacagcaaccgcgtcgtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgctggttttggacaaatt

SEQ ID NO: 53157 - DNA, 298 bp, Zea mays
  unsure at all n locations
  Clone ID: LIB3068-021-Q1-K1-C5
cccacgcgtccgtcgagtctcgtccacccgtcgtcctcctagctactgtactcgccagtcgccatgggcaagattaagatcggaatcaacggcttcggaaggatcggcaggctcgtggccagggtcgccctccagagcgaggatgtcgagctcgtggccgtcaacgaccccttcatcaccacggactacatgacctacatgttcaagtacgacaccgtccacggncactggaagcacagcgacatcacactcaaggactccaagacccttcttttcggtgacaagccggtcaccgtct

SEQ ID NO: 53158 - DNA, 308 bp, Zea mays
  Clone ID: LIB3068-041-Q1-K1-B11
cccacgcgtccgcccacgcgtccggtcgacctgatccgccacatgttcaagacccagtaggcgtagtagagagatagatttctgcctccctatcgtgggtcgtccccaatggcctttggtcgcagaccatctttgctgcttgtctatgctgagaataaatgtgaacggtgcccctggacgctggatccatgctggttttggacacgctgtctttttgtgtttaacttatctgctgccgtcctgtaacgaattcgcaagttttagttcttttgtgctttgttaaagaataaacaatgaggtttcagttt

SEQ ID NO: 53159 - DNA, 412 bp, Zea mays
  Clone ID: LIB3068-026-Q1-K1-D5
cccacgcgtccgcccacgcgtccggtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgctggttttggacacgctgcctttttgtgtttaacttatctgctgccgtactgttacgaattcgcaagttttagttcttttgggctttgctaaagaataaacaatgaggtttcagtttacacacaagttttgggatggattacaagctcagagactatgacctcaatgacaatgctttttcacctaaacttggacatgcaaaaaaaaaaaggggcgccctttt

SEQ ID NO: 53160 - DNA, 378 bp, Zea mays
  Clone ID: LIB3068-055-Q1-K1-G2
tcgcgcagggctgccagctttaacatcattcccagcagcaccggtgctgccaaggctgtcgggaaggttgttcctgaattgaatggcaagctcactggcatgtccttccgggttcccaccgtggatgtgtcagctgtagacctcactgtcagaatcgagaagggggcctcctacgaggaaatcaagaaagctattaaggccgcttctgagggcccactcaagggtatcattggctacgtggaggaggatctgagttccaccgactttcaccggtgacagcaggtcgagctttttcgacgccaaggccggtattgccctgaacgaccacttcatcaagctcgtctcgtggtacgacaacgagtggtgctacagcaaccg

SEQ ID NO: 53161 - DNA, 415 bp, Zea mays
  unsure at all n locations
  Clone ID: LIB3068-002-Q1-K1-D3
cccacgcgtccgcccctacctctccagcatctcccgtctccgtcgtctcgtctccgctcctgacctcgcgagccatgggcaagatcaagatcggaatcaacggtttcggaaggatcggcaggctcgtggccagtgtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctntggcatcaggaaccccgaggagatcccgtggggtgaggctggtgctgagtatgtcgtggagtccaccggtgtcttcactgacaaggacaaggctgctgcacatct

SEQ ID NO: 53162 - DNA, 389 bp, Zea mays
  Clone ID: LIB3068-008-Q1-K1-H2
ctttcccctacctctccagcatctcccgtctccgtcgtctcgtctccgctcctcacctgggcagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaagga

SEQ ID NO: 53163 - DNA, 414 bp, Zea mays
  Clone ID: LIB3068-026-Q1-K1-E3
cggacgcgtgggcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtg

SEQ ID NO: 53164 - DNA, 430 bp, Zea mays
  Clone ID: LIB3068-001-Q1-K1-F4
cgacagatagccgtaacttctgtgctgtgccagccgcatccctgagacaagatggtggaaggtcggagtgaacggattcggccgcatcgggcgcctggtcaccagggctgcttttaattctggcaaagtggacatcgtcgccatcaatgaccccttcattgaccttcactacatggtctacatgttccagtatgattccacccacggcaagttcaacggcacagtcaaggcatagaacgggaagctcgtcatcaatggaaaggccatcaccatcttccaggagcgagatcctgccaacattaagtggggtgatgctggtgctgagtatgtggtggagtccactgggggcttcactaccatggagaaaggctgggctcacttgaagggtggcgccaagagggtcatcatctctgcaccttctgccgatgcc

SEQ ID NO: 53165 - DNA, 230 bp, Zea mays
  Clone ID: LIB3068-029-Q1-K1-F6
gcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacct

SEQ ID NO: 53166 - DNA, 333 bp, Zea mays
  unsure at all n locations
  Clone ID: LIB3068-046-Q1-K1-B2
cagggccgggctggtcggcgcggacgggccgacccactgcggggcgttcgacgtcgcgtgcatggcctgcctgcccaacatggtcgtcatggccccgtccgacgaggccgagctctgccacatggtcgccaccgccgcggcaatcgacgaccgcccgtcctgcttccgctacccgagaggcaacggcgttggcgtcccgttgccgcccaactacaaaggcactcccctcgaggtcggcaaaggcaggatcctgctggagggcgacaccggggngctgctggngtacgggtcgggagtgcagnactggctgaccgtcgcgtacctggtgcagcg

SEQ ID NO: 53167 - DNA, 382 bp, Zea mays
  unsure at all n locations
  Clone ID: LIB3068-056-Q1-K1-C6
cccacgcgtccgcaagcaagctttcagctagtacatacatactanncanccaggcagcgatggctcccaccgtgatgatngcctcntcngccaccgccgtcgctccgttccaggggctcaagtccaccgccagcctccccgtcgcccgccgctcctccagaagcctcggcaacgtcagcaacggcggaaggatccggtgcatgcaagtgtggccggcctacggcaacaagaagttcgagacgctgtcgtacctgccgccgctgtcgacggacgacctgcttaagcaggtggactacctgctgcgcaacggctggataccctgcctcgagttcagcaaggtcggcttcgtgtaccgcgagaactccaccttcccgtgctacta

SEQ ID NO: 53168 - DNA, 360 bp, Zea mays
  Clone ID: LIB3068-016-Q1-K1-D2
ttatgtcaccacaaacagaaactaaagcaagtgttggatttaaagctggtgttaaggattagaaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatggttacttcca

SEQ ID NO: 53169 - DNA, 367 bp, Zea mays
  Clone ID: LIB3068-036-Q1-K1-A10
cggactcgtgggcggactcgtgggtttgattattggttttgtcacagaatactacaggagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgtacggcattgcagttgccgctcttgctattgatgcttatggtgccatcagtgacgatgctgatgctattgctgagatggctgacatgagccacagaatcgctgagagaactgatgctatcgacgctactggcaacagaactgctgctatt

SEQ ID NO: 53170 - DNA, 448 bp, Zea mays
  Clone ID: LIB3068-037-Q1-K1-C1
catctcctgagtcctgcctgcgctcgcctcagctcctttcttccccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaactgtgctg

SEQ ID NO: 53171 - DNA, 427 bp, Zea mays
  Clone ID: LIB3068-057-Q1-K1-F6
cccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaaccaggagaacgagttagtccagagcagtcgtaatgagta

SEQ ID NO: 53172 - DNA, 352 bp, Zea mays
  Clone ID: LIB3068-025-Q1-K1-C7
cccacgcgtccgcccacgcgtccgagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagccagcgccgggcggctgctacccttctgcgtggatggcttagccagcgctttg

SEQ ID NO: 53173 - DNA, 452 bp, Zea mays
  unsure at all n locations
  Clone ID: LIB3068-044-Q1-K1-F11
cccacgcgtccggcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcctcaccacctcctcctacgccgcgctcaacggcgttctgtactgcaagatccacttcgcgcagctgttcatggagaaggggagctacagccacatgatgaagaagagcccgtcccaggatacgctgccggacatggccgncgacgagcaaccgncggaaccggcgccaccgcaagacggggaaggagaagacaac

SEQ ID NO: 53174 - DNA, 454 bp, Zea mays
  unsure at all n locations
  Clone ID: LIB3068-022-Q1-K1-G12
cccacgcgtccgtccacgcgtccgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacggnggctgcatcctcaccaccttctnctacgccgcgctcaacggcgttctgtactgcaagatccacttcgcgcagctggtcatgga

SEQ ID NO: 53175 - DNA, 428 bp, Zea mays
  Clone ID: LIB3068-006-Q1-K1-C8
cccacgcgtccggaagatggctggcgctgtacgcaccggagggaagggcagcatgcgcaggaagaagaaggcagttgacaagaccacgaccacagatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggccctgataacctggacaaccttaagaagctggctgagattttccagaggcaggtacctggtgctgaagcagctgcacaggatgatgacgacgtccctgagcttgtccaaagagagacatttg

SEQ ID NO: 53176 - DNA, 441 bp, Zea mays
  unsure at all n locations
  Clone ID: LIB3068-043-Q1-K1-A2
gggacaacgccaagaagtacattgaggctggagtttcagagcatgccaagacccttggcccaaaagggtctgaccctcacaaggcggctgtcattggtgacaccattggagatccctctaaggacacgtctggccctttcctcaacatcctcatcaagcttatggcggttgaatcccttgtcttcgcccncttcttcngccgccatggtggcattctcttcaaatggctctaagccagcgagagacgcangataaaagccgtagttttgcaaggcgagtagagcagtatgtcagtaatacagcatctatggcatgtgcttttgctcgtccagttcatgagccccgttgtgtatttggtttccgttttcttggttggagtttttagttccaaagtccgatcatgttttgatcccataaattctcttccagccttcgagcaac

SEQ ID NO: 53177 - DNA, 400 bp, Zea mays
  unsure at all n locations
  Clone ID: LIB3068-013-Q1-K1-H2
cccacgcgtccgtggattcattcctcgcactctttgtgaagacagtgatcctttggatgtactggttataatgcaggagcctgttatcccaggctgtttcctacgtgcgaaggctatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaacgactntctaccagcgagcgccgcttatgaagccatacagcactctatggatctgtatgctacatacatcngtgagggcctgangaggtaagattctgatggc

SEQ ID NO: 53178 - DNA, 445 bp, Zea mays
  Clone ID: LIB3068-007-Q1-K1-F9
gaagtattccaactccaacatcgaaattcatactttcaatcagagccagtagcctctcggtgttaccgaggacttcttgccacttcccagcaaagggaaatctgggaaggatggctggtatcctcctggtcatggtgatgtgtttccctctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtatccgatgagcatgtgaatgaatttaaatcaatcgagaagtttaagatattcaacactaacaac

SEQ ID NO: 53179 - DNA, 444 bp, Zea mays
  Clone ID: LIB3068-006-Q1-K1-F10
gtgccggacccgcagaggatgatccgcgcctacgcacagtcggtggcgacactcaacctggtccgggcgttcgccaccggagggtacgctgccatgcagcgcgtcactcagtggaacctcgatttcatggatcacaacgagcaaggtgataggtaccgtgaattggcccatagggtggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgagcgcactcgacaactcgatggagctcatgttgaattcctccgtggtgttgccaaccctctgggcataaaggtgagcgacaaaatg

SEQ ID NO: 53180 - DNA, 423 bp, Zea mays
  Clone ID: LIB3068-034-Q1-K1-E6
gaagactcgtccatttgactccattctggctgaagtgcgtgccttcttcgatgtgcatgaccaagaaggaagccaccctgggggcgtccaccttgaaatgactgggcagaacgtgaccgagtgcatcggtggatcacggaccgtgaccttcgacgatctgagcgaccgctaccacacccactgcgacccaaggctgaatgcctcccagtccctggagctcgcctttatcatcgcagagaggctgaggaagaggaggatgcgatcggggctcaacagcagcctgccactgccgccactggctttctgagtagccggagccaaacacaaaggagggtaggaatagctgtggtgactcggaagagaaagagacagtcgacgccttggtttgttgatgcttagtgtggtgacctggtggtggtggtg

SEQ ID NO: 53181 - DNA, 205 bp, Zea mays
  Clone ID: LIB3068-032-Q1-K1-D10
gaagttgcctcatcttatccgtgctgttcgcaatgctggattaattgtcacatggatggctgatcctatgcatggaaacaccatcaaggccccttgtggcctgaagactcgtccatttgactcaattctggctgaagtgcgcgcattcttcgatgtgcatgatcaagaatgaagtcacccaggaggcatccaccttgaaatgact

SEQ ID NO: 53182 - DNA, 347 bp, Zea mays
  Clone ID: LIB3068-008-Q1-K1-A11
ggcacgcctacgcttccgcctacgcgttgtctgactcgtgggctttcgcgtggtcggacgcgtgggccgacgctggtgccgtagaagaagccggtagcgcacgggaagtgtgcggtctacagctggaggtccaagaaggctttgcagctccccgagtacccgaacgcggatgagctggacgctgtgctgaagaccatcgagacgttcccgccggtggtgttcgtcggagaggctcgccgtctcgaggagcgcatggccgaggccggcatgggccgcgccttcgtcctccaaggtggcgactgctccgagagtttcaaggagttccacgccaacaacatgcgtgacac

SEQ ID NO: 53183 - DNA, 396 bp, Zea mays
  Clone ID: LIB3068-035-Q1-K1-A4
cccacgcgtccgcccacgcgtccggcgtgttggcgcttcgagcattgtatgtaaaagtggcgatgtagctgggagggttgaaagtcaactcaaacttgtcatcaggcctatgtattcaaaccctcctatacatggtgcctctatcggtgctaccatactcagggacagccagatgttcaacgaatggactctggaactgaaagccattgctgataagatcattcacatgaggcatcaactatttaatgcccctaaatccaaatgaacccctggagattggagccatatcattgagcacattcggatgtacactgtgactgagctgaataacgaacaagtcgcattcatgaggcaggaatacctcatttacatgacatctgatgatatgaacatcat

SEQ ID NO: 53184 - DNA, 444 bp, Zea mays
  Clone ID: LIB3068-012-Q1-K1-C6
cggacgcgtgggcgaacaaaagcgcatcgatctcgctgtcgtcactcctcgtcacccaggcacgaacagaggcaccacccagcatggccctgcaggcggcgctcctctcatccaccctctcatccgtccccaagaagtgcagcctcgccgtcgcggcgaaggacacggcattccttagcgtatcccagaaggtcagtgatcagctgcatctgcatgctgcactcgcagtcacaatgcgcttgaattgaacgtgtcactcactctgtcgtgagcatgccatgcgtgcagaaggtgcaggcggcgtcgctgtcggtgagagtcacttcgccatctaccggcccacggcaaggacgccgacgttcacggcggacggatacgagatgagcgtcggcgtcaaccacctgggccacttcctcctggcgcgcctgctcctggacgacatgc

SEQ ID NO: 53185 - DNA, 317 bp, Zea mays
  Clone ID: LIB3068-021-Q1-K1-A7
gtcacttctccacgaacaaaagcgcatcgatctcgctgtcgtcactcctcgtcacccagccacgaacagaggcaccacccagcatggccctgcaggcggcgctactcccatacaccctctcatccgtccccaagaagtgcagcctcgccgtcgcggcgaatgacacggcattccttagcgtatcctacaagaaggtgcacgcggcgtcactgtccgtgaaaacgcggtggcgactaccgcgcctgtggccacgccggggtccagcacggcggtcaacgatgggaagaagaccgtgcggcatgccgtggtggtgatca

SEQ ID NO: 53186 - DNA, 371 bp, Zea mays
  Clone ID: LIB3068-003-Q1-K1-H6
tcatcagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacatagacagctacttgatactagataca

SEQ ID NO: 53187 - DNA, 531 bp, Zea mays
  unsure at all n locations
  Clone ID: LIB3068-033-Q1-K1-H5
gcgactcatacacggtcctacccagtctccatcgacaatcgaggatctcgacgtctcacaaggactgatgctgcagtcggtctgaacactggggagctggtagtcttatgcaaggcagaatgaccacaggtagaacacatgagaagtattaatgctcaacaagcatgctgtccgtacactatgtcggctacatctgtcgagatttatggaaantgaacgcctgatggattgaggcttgacagaatgatggtagctaaccatctgatcgtgagactcacagaaggaataggataaatgtgtatggtctagaagaccatccactcagacaagaccatanttccgttcctgtaatatgggttagattgatccccgataagactagaagccatggcgaatttagtatggagttaacataagaacagctacgttgatacttagataccattgcgcttcaggagtattgactcacagggttaagtgcaatggtaagtagcatgagaaaacctaactgagggattacaaaatgacatt

SEQ ID NO: 53188 - DNA, 468 bp, Zea mays
  Clone ID: LIB3068-033-Q1-K1-H9
tcatcagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacaaagacagctacttgatactagatacattgccttcagagtatgactcacgggttaaggcaatggaagtagatgagaaacctactgaagattacaatgacattggcggacttgagaaacagattc

SEQ ID NO: 53189 - DNA, 444 bp, Zea mays
  Clone ID: LIB3068-005-Q1-K1-D12
cccacgcgtccggcgccgtctggcccagaaccgtttagctgctaggaaaagccgtctaagagggaaggcatacgttgagcaacttgagaatagcaggctgaaacttagccagttggagcaggagctccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcaacgcacacgccggtgacgacgagctccggcgcatcgtggacggcgtcatggcgcatcaccacgaagcgttcaggctcaagtgcgtggcagccagtgcggacgccttccacgtgctgtcggggatgttgaagacccccgtggagaggtgctttatgtggct

SEQ ID NO: 53190 - DNA, 415 bp, Zea mays
  Clone ID: LIB3068-044-Q1-K1-G10
ctaggtcaaaaggcactgcgccgtctggcccagaaccgtgaagctgctaggaaaagccgtggaagaaagaaggcatacgttgagcaacttgagaatagcaggctgaaacttagccagttggagcaggagctccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcaacgcacacgccggtgacgacgagctccggcgcatcgtggacggcgtcatggcgcatcaccacgaagcgttcaggctcaagtgcgtggcagccagggcggacgccttccacgtgctgtcggggatgt

SEQ ID NO: 53191 - DNA, 373 bp, Zea mays
  Clone ID: LIB3068-041-Q1-K1-B6
ctcctcctttttctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagtta

SEQ ID NO: 53192 - DNA, 433 bp, Zea mays
  Clone ID: LIB3068-043-Q1-K1-C7
cccacgcgtccggctctcctcctttttctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgaaaggtacgaaaaaaacagttatgcaagcccagatactgctgtacagaacatagagaacgagttagt

SEQ ID NO: 53193 - DNA, 362 bp, Zea mays
  Clone ID: LIB3068-025-Q1-K1-E5
gggaagcaaagttaaatatgagcttgacaagaaaactggactgattaaggttgatcgagtcctatactcatcagttgtataccctcacaattatggtttcgttccaaggactctttgtgaagacaatgacccattggatgtgttggtcctgatgcaggagcctgttattcctggttcgttcctgcgagcaagagcaatcggccttatgcccatgattgaccagggtgaaaaggatgacaagataatagcagtctgtgctgatgatcctgaatatcgtcactacaacgacatcagtgagctgtcttctcatcgcctgcaagagatcaagcggttctttgaagattattagaagaatgaagatt

SEQ ID NO: 53194 - DNA, 387 bp, Zea mays
  Clone ID: LIB3068-054-Q1-K1-C11
cccacgcgtccgcgcccctcctcctctccttcatccgtacccaatctaatctacacccgggcgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgtgtcattcttggacactctgaaaggagagctctgctgggagaatcaaatg

SEQ ID NO: 53195 - DNA, 65 bp, Zea mays
  Clone ID: LIB3068-024-Q1-K1-G5
cccacgcgtccgcccttttcgagtctgtactgaaactgctgagagatttgcagttgtgatctatg

SEQ ID NO: 53196 - DNA, 65 bp, Zea mays
  Clone ID: LIB3068-024-Q1-K1-G6
cccacgcgtccgcccttttcgagtctgtactgaaactgctgagagatttgcaggtgggatctatg

SEQ ID NO: 53197 - DNA, 470 bp, Zea mays
  Clone ID: LIB3068-024-Q1-K1-G8
gcaagcttcgcgccaaatcggacaacaagatgtgcttcgattgcaacgccaagaacccgacgtgggcgtccgtcacctacggcgtcttcctctgcatcgactgctcggcggcgcaccgcagcctcggcgtccacgtctccttcgtcaggtcaacaaatttggattcatggactccagaacaactgaaaatgatggtctatggcggaaataaccgtgcgcaagctttctttaagcagcatggttggacagatggtggaaaaattgaagcaaagtatacttcaagagctgctgacttgtaccgacagttgcttgctaaagacgttgctaaaagctctacagaagatggaaacaatagttggccatcttccccagttgcagcatcccaggctccaaatcaagctgctgcatttccagatctcaagctgacagaggtgtcaaaagaaaatgtaagtgaaaagaaagattctgag

SEQ ID NO: 53198 - DNA, 431 bp, Zea mays
  Clone ID: LIB3068-024-Q1-K1-G9
cccacgcgtccggttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagc

SEQ ID NO: 53199 - DNA, 265 bp, Zea mays
  Clone ID: LIB3068-024-Q1-K1-H1
ttgctattccctcatcttctcatctccctttatatgatctttccacactaatctcaaatagggccttttggtcctatttaatgaacccatctatcacaatgactctgttttccattccccctatatacccatcctctacatcaataactgtatcttcttcttcatctctattaccatcaacatgtactctaatcaccacaattatattataactaatcatgatcattccaatctcactgcctactctatctacatcatctttaac

SEQ ID NO: 53200 - DNA, 430 bp, Zea mays
  Clone ID: LIB3068-024-Q1-K1-H11
caagaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaaca

SEQ ID NO: 53201 - DNA, 77 bp, Zea mays
  Clone ID: LIB3068-024-Q1-K1-H12
cccacgcgtccgcccacgcgtccgaaaaaaaaaaaaaaaaaaaaaaaaaaaaaaaaaaggggagttctagatcgcga

SEQ ID NO: 53202 - DNA, 434 bp, Zea mays
  unsure at all n locations
  Clone ID: LIB3068-024-Q1-K1-H6
gagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggatgaagagacgccaaaggaggaagagacggcaaaggaggcggagccggagccggagcccgcngccgctgaagaggtgaaggaggaagcggcagcgccc

SEQ ID NO: 53203 - DNA, 293 bp, Zea mays
  Clone ID: LIB3068-024-Q1-K1-H7
cccacgcgtccggtatatactctctttgtcctaaaaaaaaaaaaaaaaaaaaaaaaaaaaaaaaagaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaccaaaacacaaataaacaaccaaaaaaatcacaaaaacagaaaaaccaaaactactaaagaaatcaaaacccaaaaaagcatgttcccgaattcgaaaacaaggtagaagacccagatgcacaggc

SEQ ID NO: 53204 - DNA, 389 bp, Zea mays
  Clone ID: LIB3068-025-Q1-K1-A1
cccacgcgtccgtgcttaagtggcatttatttagtatttttattatacgatacacaaagcaactactggtcctggaatttgttattggaatttccgataggttatcgttgtcgggtgactaagggcacatagaaccgggatcttttgctggccatggatgttctgaatgcacttgtaacggccctggtatctgacactctcctagaatacaattcaatacaagggctgcagctctagcttgaagaaaaaaaaaaaaaaaacagaaaaaaataaaaaacaagataataaaaaaaaaaaaagaccaggaccaatcaaaaattcacaatgaccatcaaatttcatgatgaagctttagatcaccctatttggaaaaaaaaagggggggcctt

SEQ ID NO: 53205 - DNA, 445 bp, Zea mays
  Clone ID: LIB3068-025-Q1-K1-A10
cccacgcgtccgcccacgcgtccgctccagcgacggcagcgggcgagggttacgcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcacggtcttgaactctagatggtatccgcggaataatcattgtacctgaatcatatactgcaat

SEQ ID NO: 53206 - DNA, 332 bp, Zea mays
  Clone ID: LIB3068-025-Q1-K1-A11
accaacgtacgaccacgcgtacgctcctcgacagcagcagacgaaggttacacgggcgggaggcctagtagatccagcctaacctgcacccatgtgcgacatggacaatctcatgatctgtgtccttaatgaacccgactggccgtccttctgcactcatcgctacaggcaaaaccttgctttcaccaaacttactggccttgctggatatatggcttaccccagatcacgttactccaactatgctcgatcctatcgccgttcgtatcacctgcgcaacctagttgtgaactgggactggccttttatgccaacgttaacccacattgtct

SEQ ID NO: 53207 - DNA, 391 bp, Zea mays
  unsure at all n locations
  Clone ID: LIB3068-025-Q1-K1-A12
cccacgcgtccgcaagaagtcagtcacatctcacagctcagtgagatccagagccaaagggcggggcgtctccgactcccaatcccaagtccagccgccgccgccgtctcttgctcgctccaaaagccgttttccagagatctttttcagcgccagacgccagccgccgtctctcgcttgcctgcatttccgatcctgaggcagtcctcatctcattctcatgatctcatccaaccgggaggctgggaacgagatcacagctacagctacagctacctgagcaggatcctcctcagatcggcttcaaaaatcaaaaggggcgggggacaacaaggcangggatgagtgcaactgcaaccaaggtgaagagacgtgtgggcaagtacgagct

SEQ ID NO: 53208 - DNA, 351 bp, Zea mays
  Clone ID: LIB3068-025-Q1-K1-A5
gggaacatcaccgtgtagtgtacgtacatatctacgctagctactactactactgagtgtggaaaccttgtggttcacatgaaacgaaagaatacgctgcaaaaatgtactagcgaaaagaaagaggaaaggggacaagtacatgtacaatacgacgctgcttccctccctccggcggccatttctgcatcatcgtcgtcgagattcctggtgcggtgcggtgcggtgcggtgctgtgcgtcgtggcgtgcgtgcgtacggatcgtcatgtcggcctgctgcttccgcggctggaggacgaggacgagccggagtggccgctgccccccagcttcctgctgatgctgtgga

SEQ ID NO: 53209 - DNA, 346 bp, Zea mays
  Clone ID: LIB3068-025-Q1-K1-A6
tcgcccacgcgttcgcccacgcgtccggaaaaaaaaaaaaaaaaaaaaaaaaaaaaaaagaaggaaaaaaaaaaaaaaaaaaaaaaaaaaaaaaaaaaaaattaaaaaaaaaaaaaaaaaaaaaaaaaaaaaaaaaaaaaaaataaaaaaaaaaaaaaaaaaaaaaaaaaaaaataaaaaagggggccatttttaaaatttcaaatttttaaaacccttgaaattaacttatttaatttttttttgggaaattaaaatttaatcaatttgcctattttttaaaaagttatgatttgaaaaaccttggatttacccaattaatttgattggaaaaaaataccttttt

SEQ ID NO: 53210 - DNA, 141 bp, Zea mays
  Clone ID: LIB3068-025-Q1-K1-A8
cccacgcgtccgcggacgcgtgggccgtcgtctctgtttgcgtttctgtcaagtgtgcatggaataatactgtaactgtgtttcctgccgggcaatgcactgtgatatgatgcccaacgaataaatgtcgcttttattttt

SEQ ID NO: 53211 - DNA, 408 bp, Zea mays
  unsure at all n locations
  Clone ID: LIB3068-025-Q1-K1-B1
caactgtaatacgactgtactgaaatttctctctcctatgaatttgagatgctcgcctgccttctgattcaaatacttattacactaatggcacctcgcaatcatgttcctttgatcattttatgatatgatttatgatctgaaccacattaaacacctttctatttaacgcagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctcttccaccctgagcagctcatcagtggcaaggaggatgccgctaacaatttcgcccgtggccactacaca

SEQ ID NO: 53212 - DNA, 375 bp, Zea mays
  Clone ID: LIB3068-025-Q1-K1-B3
cggacgcgtgggcggacgcgtgggctcccgatcagcagctgatcgctcactcttgcagggggatcattctttagctgcgctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccggccgtcgtcgtgcccgaggaggctgcccccgccgccgaggccaaggtggaggagccagctgccccggcggagaccgagccagctgccgccgctgagcccgaggcggcccccgtggcggctgacgaagagacgccaaaggaggaagag

SEQ ID NO: 53213 - DNA, 354 bp, Zea mays
  Clone ID: LIB3068-025-Q1-K1-B5
acgtccactcgtacgcggacgcgtggtaaatataatatgaaataagaaaagctaaccgggggtggtgattcagatacttagttcactaaatggctcctgccaatcatgttcctttgatcattgtatgatatgatttatgatctgaaccacattaaacacctttctatctaacgcaacctgatggccaagtgcctggagatatgaccgcgggtcatcacgatgatgccttcagcaccttcttcagccagactggtgctgggaagcacgttccccgtgcaatcttcgatgatctataacccactgtgatcgatgaggtgctcactggcacgtaccggcagctcttgcaccctgagc

SEQ ID NO: 53214 - DNA, 432 bp, Zea mays
  Clone ID: LIB3068-024-Q1-K1-E10
ggcggcggcgtacgaggtgctcgtagcaggcggggaggggctgttcctcaagaccaagcccccggccgccagatccgccgtcgaggcgctcccgtccgccgtcgtcgcggccggccaggaagtccagggggatgagtgcgctgtgtgcaaggacggggtcgcggtcggccagcgcgtcaagcggctgccgtgctcgcaccgctaccacgacggctgcatcgtgccctggctccaggtgcgcaactcgtgcccgctctgccgcttcgagctgcccaccgacgacccggagtacgagtcctggaaagccggccggaccgacgccgcgtgaaccggccaaccaggcagtggccgcatgctcttatggtatggttttattgatagtgttgtatgtatgggttgggtttgaatcgggtgctttggttataaggttgc

SEQ ID NO: 53215 - DNA, 158 bp, Zea mays
  Clone ID: LIB3068-024-Q1-K1-E2
tacccttttcactctttcacactctccatatctacagcgtcagcattcgcaacctttctcaacccttccctactccaaatccaccttatctcccacactccctactaacccttcattaccctccaactcctaactaccaaacaatttatcctttaaat

SEQ ID NO: 53216 - DNA, 465 bp, Zea mays
  Clone ID: LIB3068-024-Q1-K1-E5
cccacgcgtccgagagtgtgtgtgagagagaggatgggtggcagcggcagggctgctctgctgcgggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacaagccgcccaaggagcacgggcccaagccggagaagccgcccaaggagcacaagccgacgccgtccacgtacaccccgagccccaaacccacgccgtcgacgtacactgacaccccgacgccctccaagccgacgccacccacatacactaccgcccctacgccccacaaacccacaccaaaacccactatcactactacgacgtacaccccgacccccaagcctacgacacct

SEQ ID NO: 53217 - DNA, 328 bp, Zea mays
  Clone ID: LIB3068-024-Q1-K1-E6
cttaaccctcgttcctctagccgtctcgcgcagacacagcctacatttctccttcgactgctgtgcggctagctcaaccatggcggactccaaggccacctcagcggtcaccctccgcactcgcaagttcatgaccaaccgactgctggcccgcaaacaatttgtgcttgaggttatccaccccggccgcgccaacgtctccaaggcggagttgaaggagaggcttgccaagatgtacgacgtgaaggaccccaacaccatcttcgtcttcaagttccgcacccacttcggtggaagcaagtccactggcttcggcctcatctacgat

SEQ ID NO: 53218 - DNA, 480 bp, Zea mays
  Clone ID: LIB3068-024-Q1-K1-E8
cccacgcgtccgcccacgcgtccgcccacgcgtccgcccacgcgtccgcccacgcgtccgacccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctgttcatagtcggggactggttaggggacatgtc

SEQ ID NO: 53219 - DNA, 331 bp, Zea mays
  Clone ID: LIB3068-024-Q1-K1-E9
cccacgcgtccgcccacgcgtccgggtttctctgctctgctctccctcgccggcgtgcttcacgatcgtggtgtgtgtaaggaactaaggacgacggtgcctggtttaggagtttagctatagacgaaagcacgtacggccgcgtgcctggtctagctacgcggcctggttgatcttgagcagttaagcgtgtacgaaacgacagctgtgtacgtgtgtactgtctgatggagtgtgagaagtactgtgtgtatttggtatggatccgatcggcctgatgtatgaaaaggatgtttacgtactatatatagatggaaaatcgtatttgcct

SEQ ID NO: 53220 - DNA, 212 bp, Zea mays
  Clone ID: LIB3068-024-Q1-K1-F1
cccacgcgtccgcccacgcgtccggccagtgcttattctagggcatttgaggttatggttcctaggttttttttgtggaacctgatttatcgttgtatgatcatgacaaacaattggtagtaaggaaatcaaaaaggggaaatccgtacatgtttgctctgtttcatctgtatcttgcatgttaaatatttaaatataaaaagcattgagtc

SEQ ID NO: 53221 - DNA, 396 bp, Zea mays
  Clone ID: LIB3068-024-Q1-K1-F10
cggacgcgtgggcggacacgtgggcggacgcgtgggcggactcttggtcgacatgtggacttacagtgtttgtataacggtattgagactgaatggagtgtactttgaggtagtttctgaaaaacaaagaaatgaatgcaataagagaaaagacagagtaaaaaaacggacaacgagtaaagcggatgacgagacttgacatgataacacaaccgttggattactgcactggctacagttgcgcaattagtggccgatgtggcggttctagctcgccaccgacgacgcgcagtactaatgctggatagccgggacgactgactgtgcgtgaaccggtgaaacaggcagtgactgcatgctctcatggtatggcactatcgatagtgtagtatgtat

SEQ ID NO: 53222 - DNA, 433 bp, Zea mays
  Clone ID: LIB3068-024-Q1-K1-F11
cggacgcgtgggcggacgcgtgggcggacgcgtgggggcagacatcgtctctactgatggacatatatgatttagcttgtggcgatacatgttatgtccactagagaaacgatattctgagacactcgccttcgcccaagactgccttatgattatcgctgatatggacatgtggtacatgcttctctacccttagaagtctttcactccgaatctcgggacgagattcttttaaggggggagggctgtaacaccccaggtgtttaccgtatgctcgacaacgagtatgaacttaagcacgaaatatcagtggataacacggattttaaattttaatcatcctcacttattgcgattttaatatcgcatctgttccgtttatcgcgagtgtgacatcatttttacttctatttattcgggctcttcccaaatt

SEQ ID NO: 53223 - DNA, 319 bp, Zea mays
  Clone ID: LIB3068-024-Q1-K1-F3
cggacgcgtgggcggacgcgtggggtcaaactttgctggcagtttttaaaacagttttttaagggaaatcagggtatatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaataaaataaaaaattaatttaaaaaaaaaataaaaaaaggaaatcgatctagattatacaaaaacatgactgggaaaaaactactgttacgaaatataatagtgttgccaaaaatcaaa

SEQ ID NO: 53224 - DNA, 252 bp, Zea mays
  unsure at all n locations
  Clone ID: LIB3068-024-Q1-K1-F5
cccacacgtncgcggacacttgttttcctacgctttttcagactcttgttcctatgccctttcgtgagaactagatttatcgctcggtgatcattatgacacattggttggtacagcaatcaaacatgtgatattcctacatgcttgctttgcataatgcgtatatctactgttaaatatttatatataaccagtattacgtcaaactatacaactacacgagcagtccttctagaatatccaagctttaca

SEQ ID NO: 53225 - DNA, 441 bp, Zea mays
  Clone ID: LIB3068-024-Q1-K1-F9
gctgcgcagcgcgagcgcggaaggcgcgatgcggcgcgcggtggaggccgcgcgcgcggccgaggcagacgggatgctcgcggtatcggtgctgccgggcttttcgctcgcggacattcccgcaccctgcatcagcgtggtcgtggtggccgatggcgatcgggccgcggccgatgcggtggccgagcgcatcgcgcggcagatctgggatgagcgcgacgcgttcgtctaccgcagcgcaccgctggcggaatcggttgcgcaggccgcggcgctcgcgcgcggcgcggaccgcccggtgctgatgctcgatcacggcgacaactgcatgtcgggcggcccgtgcgacacgatggacctgctcgaagccgcgctcgcgcacgggctcgacggcatcgtcagcgggccgctgtgcgacccgcaagccgtcgcggcgctgat

SEQ ID NO: 53226 - DNA, 336 bp, Zea mays
  Clone ID: LIB3068-024-Q1-K1-G12
acgcaacctgaggaacgaggatggacgatgactcgcttctgacgaagacgatgaacggtgcggagagtggactcgccgcggggaccatctggtgcaccgtcgtcgccacctggtacgacgtgccccgtgtggagcgccacgtggcgctccctggccttatccggacgctcaagatgtgcagcacctactgggccaccttcgtcaccatccatggcctatacatcatcgtcgaacatctcgtgcagagccagcgcaagaagcgcgactttgtcaacggggccgtcagcgcgttcaatgccggagcctctgtctgcggctacagacgaaagagttttc

SEQ ID NO: 53227 - DNA, 463 bp, Zea mays
  Clone ID: LIB3068-024-Q1-K1-G2
cccacgcgtccgcggacgcgtgggttctctggctggggagcaagcggctgcagggaactttgacacagcaatgaggttgcttagccgccagttgggtatcaagaactttgttccactaatgcccttgtttcttgatctgcacatgggcagtcatacatatttgcgtgggcttgctgccgctcctgttatatcagttgcagtagagaaaggttggaatgagtccgcaagtcctaatgtgaggggccctcctgcgcttgttttcagcttctcacggatggaagacagactcaaggctgcctacaaagccacaactgagggcaagttcccagaagcactgaggcagttccttagcatcttacataccattccagttatcgtggtggactcacggagagaagttgatgaggtgaaggagttaatcgagatagtgagggagtatgtccttggtctgaggatggaactc

SEQ ID NO: 53228 - DNA, 419 bp, Zea mays
  unsure at all n locations
  Clone ID: LIB3068-024-Q1-K1-G3
cccacgcgtccgcccacgcgtccggagaaaccaaggccaaggagcacagcaccccgtccgtcccgagcaggagagcgagagacagaaggctgtgcgaagggaaagaagagacggtgggagaggagggcgacatggagaggccggcaccggtgaggaagtctcacacgtcgacggcggacctgctgatctggccggagggggcgccgcaggagtcgcccgccggggccacgccgccatccaaccgccggccgcatcagccgtcggaggcgctcaggaaggtggtgttcggcgggcaggtgacggaggaagaaggccgaaaagcttaaccaggaggaaccatgctctggttccaagtggaaaggagatgacagggaagcggcatatntgctgctgggggcgaggctgaagaagatgaatct

SEQ ID NO: 53229 - DNA, 477 bp, Zea mays
  Clone ID: LIB3068-024-Q1-K1-D8
cttccatttaacccaactgataaaagaactgctttaatctaccttgatggagaggggaaaatgcatcgtgttagcaagggagcaccagagcagatccttcatcttgcccacaacaagtcggatattgaaagaagggtcagagctgtgatcgacaaatttgctgagcgtggtctgcgagcacttggtgtggcttaccaggaagtgccagaatggtaggaaagagagtcctggaggaccatggcagttcattgggctcttgcctctttttgaccccccgcgccatgatagtgcagaaactatcagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattga

SEQ ID NO: 53230 - DNA, 409 bp, Zea mays
  unsure at all n locations
  Clone ID: LIB3068-026-Q1-K1-H11
cgggattggaaacgtgtaaccacctccagcctaaacacagtcaccaccacctacacccccggtgtctcctctccttccattgccacagtcggccttctccgtggaagccggcgggccgccgcctcctttgtccctgtcgtcgtgctcttccgtaccgccattccctagcactgtccacgggcgagatctcgcgtgtacggtgtacctcgtttccctcggcgggtggatcagtgacggcttggtcgagatggacgatgtggttgatgacatcatctgtggaacggatgcggcggttgccgtcgaggatggggccagtgggacgcccgcaatgcctagcttatggtgccagggtgaggaagagcataggaagggcaatgaggacaactcangtgagagcgaggtgattaac

SEQ ID NO: 53231 - DNA, 232 bp, Zea mays
  Clone ID: LIB3068-026-Q1-K1-H12
acccttcttccgcgaccccagcatcccgctcacttactacaacatgctgtactcctatatcgacccgccattcgctatcactatcgacatgcgacacacggactttaccgtgcacgatctcttacaccggatggccgatcagtgactactaggacgagaccgacgacacggttcataacatcatctgttacaacgataacctcattcacagggtcgacatgagccagtggga

SEQ ID NO: 53232 - DNA, 400 bp, Zea mays
  Clone ID: LIB3068-026-Q1-K1-H2
tcgcaccggcaccgagtacgggccctacctccagaacgaaccttcacccttgcacacaacgagaattgtggagaagtgcactcttaaactagtcgatgagtacaagcacatgctgtgccaggccactgaaccactatctacgtttttgcagtatataacttatggccacatgattgacaatgttgtccttattgtaactgggacactgcatgagagagatgttaacgaacttttggagaaatgccacccattgggcatgtttgacagcattgcatcacttgctgttgctcaaaacatgcgtgagctttatagattggttctagtcgatacaccactggccccttacttctcagagtgcattacatctgaagatctggatgacatgaatattgagattatg

SEQ ID NO: 53233 - DNA, 223 bp, Zea mays
  Clone ID: LIB3068-026-Q1-K1-H3
ggctggagaagtggccatctatgtatcctgtagagcaatgcacaacctatacaatacggcgacgacattcatatgctcatgcagtactgatattataatataaccatatacatatccaaaagtcataccatcaagctacatgaacggcgaataatataacaaaacacttgggaataaggtaattgagctatatcatatgtagagctatagctggcttgatgaa

SEQ ID NO: 53234 - DNA, 390 bp, Zea mays
  Clone ID: LIB3068-026-Q1-K1-H4
cccacgcgtccggcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgccttctactcgggcaacaacaagttcaggtgcaccgacatcttcctcggcatgtgcggccccaagtgctagatcagagagggagaacgcgcgct

SEQ ID NO: 53235 - DNA, 395 bp, Zea mays
  Clone ID: LIB3068-026-Q1-K1-H6
cggacgcgtggggagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggatgaagagacgccaaaggaggaagagacggcaaaagatgcggagccg

SEQ ID NO: 53236 - DNA, 383 bp, Zea mays
  unsure at all n locations
  Clone ID: LIB3068-026-Q1-K1-H8
gcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacaccctcgaccgccgcaccatctgcggctgcctcaagaacgtcgncaacggcgccaacgggagcggcacctaca

SEQ ID NO: 53237 - DNA, 409 bp, Zea mays
  Clone ID: LIB3068-026-Q1-K1-H9
cacacgcgtacgggttctacgagaggatatttagaggaagaacagctcgaacgagaccatgaagagcatgcccacacctggtgctgatcctgtgcctccaggccgatctggtcatgggcgtcttcgccgctttggctaaagaaaatgccctgattgagagcaaggccatcgacatcaacccggggcagctcaagtgctgcaccaactgcaacttctgcttctcagggctctacacctgcgacgacgtcaaataggactgcgaccccgtctgcaagaagtgcgtcgtcgccgtgcacgcctcctactcgggcaacaacaagttcaggtgcaccgacatcttgctcggcatgtgcggacccaagtgctagatcagagaagaagaacgcgcgctgctgctagctgctatagc

SEQ ID NO: 53238 - DNA, 447 bp, Zea mays
  Clone ID: LIB3068-027-Q1-K1-A10
ctcgcctctcgcgcatcctaccaggagggtgggagacccaggcagcggaggtgtgcgagggtcgcttcgcaccacgcgctgcggcctgcggtgcgagagatcgaggcctgagctagggtctggtggcggagatgtcgacgccggcgaggaagcgcctgatgcgggacttcaagcgccttcagcaggacccgcccgccggcatcagcggcgcgccgtacgacaacaatatcatgctctggaacgccgtcatattcgggccggatgacacgccgtgggatggaggcacgttcaagctgactctgcaatttatagaagattaccccaacaaacctccaactgttcggtttggttcgaggatgtttcatccaaacatctatgcggatggaagcatctgtttggacatcctacaaaaccagtggagccctatatatgatgttgcggcaatat

SEQ ID NO: 53239 - DNA, 85 bp, Zea mays
  Clone ID: LIB3068-027-Q1-K1-A11
tcttcctaaaaaaaataaaaaataaaacaaattttataaaaaaaaaaaaacaacaaaaaaaaaaaaaagaaatatataaacaacc

SEQ ID NO: 53240 - DNA, 329 bp, Zea mays
  Clone ID: LIB3068-027-Q1-K1-A12
taaaaaaaaaaaaaaaaaaaaaaaaattttaaaaaaaaaaaaaaaaaaaaaaaaacaagcagtgattaataaaaaaggccggagtgctctttcattccactctttcgtactcttacattcaaccttatatttatttcatagcccaacctaattcaaattcactacccgtataaaccacaacttttcaacacttaaaacccttactttacataacttattcaccttgtaacacattcccctttcgcccttttacttattaccttccaggcccttacccatcgccatttccaacattatctcaccctttattgtcaacattaacccccctt

SEQ ID NO: 53241 - DNA, 429 bp, Zea mays
  Clone ID: LIB3068-027-Q1-K1-A2
cagacattgcaattgtatttgcacagcagcgagatctcgctcagaagagactctgaagagggaacgagctgcgcttcttcgtcctcgatcaactagcttctctgatcgcttccatatggagagagctgcgtcaagctgcgctagcctcctagcacaaaggaggtgctactccgtggccgcggtcgtggtgaagggatgcgggcggaaggccgtggagaaagtggccaagcgcatcatgggcaaggaggtgaacaccgcggctgcctccggggagaagacgccgtgggtgccggaccctgtcaccggctactaccgtccggcgggtggcgccaaggaagtggacgcggcggagcttcgcgccaggctgctcaccaagaggatcgccaactaaatcaatctagcagcagagcagtgcggctgagattattt

SEQ ID NO: 53242 - DNA, 422 bp, Zea mays
  Clone ID: LIB3068-027-Q1-K1-A3
gtatctccaaggatggccagacccgtgaacatgctctccttgcgttcacccttggagtggagcagatgatttgctgctgcaacaagatggatgcaaccactccgaaatactccaaggcacgttatgatgagattgtgaaggaagtctcatcctacctcaagaaagttgggtacaaccctgataagattgccttcgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaaacctggtatggtagtc

SEQ ID NO: 53243 - DNA, 424 bp, Zea mays
  Clone ID: LIB3068-027-Q1-K1-A8
cgcgtcggcacacgttgggactttcggatgcgcaaatttgtttctgagaagcgaaaattatggcgggtgaagctcctgtgttgtgacgtactaatgtatcgatactacttacaccttcatctaaaggcactcgccgtttctgggacgctaagaaattcagtttttatggagtcattgacaattctgctggaggagatgtgctgggtatcgcttgtttgatggggtctaaaacaaggtttgagattggacaatattatgcattaacaatattgcatcttgataatgcattatattaaaaggacccaaggcaatctattgagccacaattatgtgctcatacaaagcaaggagacacaagttctgaggagaaatatggggaggagatggtttggcatcatggaccaaacttcgattggcagcatga

SEQ ID NO: 53244 - DNA, 280 bp, Zea mays
  Clone ID: LIB3068-027-Q1-K1-A9
cccactcgtccgattacccttcacctgactcttctctaaataaaaacacactcaaagtgggtcaatataaatatgctaatgcaacaaaaaaaaaatcaaacactccaaaatatttcaatattcctgatcttcatattgttaatctagtctcatactacactcttaaatttacttacaatccttataagattaacttctctacaatttcttgctttgaaaaccacatcattattcaaaattacaccaatctttactcattcaaatttccaaccctgcttta

SEQ ID NO: 53245 - DNA, 384 bp, Zea mays
  Clone ID: LIB3068-027-Q1-K1-B1
cttgaacagatcgagcttcttttgcaccacaaggtcgaggatgtcttgcaactgcggatgaagctgcggctgcggctcaagctgcaagtgcggcaagaagtaccctgacctggaggagacgagcaccggcgcgcaggccaccgtcgtactcggcgtggccccggagaacaaggccgcgcacgagttcgttgaggccgcagcggagtccggcgaggacggccacggctgcagctgctgtggcaactgcaagtgcgacccctgcaactgctgatcacatcgatcgacgaccatggatatgattattatctatctagcttcgggtggtggttgaacaataataagcgaggccgaactggctgacatacataggtattgtgtggtgtg

SEQ ID NO: 53246 - DNA, 430 bp, Zea mays
  Clone ID: LIB3068-027-Q1-K1-B10
ccacttcaaaggaaagccatattatgttgatatcattgacttgttcaacgaggttgagtggaagacagcttcagggcaaatgttggatcttatcactacccacgagggtgaaaaggatctaactaaatataacttgacagttcaccgccgcatcgttcagtacaagacagcttattattcattctaccttcctgttgcatgtgcattgctgctggctggtgagaacttggaaaactttgttgatgtaaagaacattctcgttgaaatgggaacatactttcaagttcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaat

SEQ ID NO: 53247 - DNA, 384 bp, Zea mays
  unsure at all n locations
  Clone ID: LIB3068-026-Q1-K1-H1
cggacgcgtgggcggacgcgtgggctgatggagagcttgccacggcaagagctgcagctggcgcaggaacaataatgacattgtcctcatggtctacttccagcgttgaagaggtcaactcagttgggccgggcatacgtttcttccagctctatgtctacaaggacaggaatatcgtacggcaactcgtgaaaagggctgagatggctggcttcaaggccattgcactcacggtagacactccaatacttggccgcagggaagctgacattaagaacaggttcgccttaccttcacatctggtgttgaaaaacttccaagcgctggatcttggcacgatggacaagacaaatgattccggccttgcttnctacgttgctggtc

SEQ ID NO: 53248 - DNA, 442 bp, Zea mays
  Clone ID: LIB3068-026-Q1-K1-E10
ctacccccagtctcggaagagaactatccagaagcgcaagactccaaagccgtcgccttggtatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagccagatcccactgactgggccaaactcaatca

SEQ ID NO: 53249 - DNA, 72 bp, Zea mays
  Clone ID: LIB3068-026-Q1-K1-E12
aaaaaaaaaaaaaaaaaaaaaaaaaaaaaaataaaaaaaaaaaaaaaaaaaaaaaaaggcgggcgatataaa

SEQ ID NO: 53250 - DNA, 441 bp, Zea mays
  Clone ID: LIB3068-026-Q1-K1-E5
cccacgcgtccgcggacgcgtgggttgcaaacaagtatatgaagagggttgcctcagaacttgatgcattagaaggcactgagaaagagcccaatagagagtttttgcttctccagggtgtgaggttcgctttccgggttcatcagtttgctgggggttttgatgcagaaagcatgaaagcttttgaagagctaagaagcaagatgaccacacaggcatctgctccaccaatatctcaaggctgaagcataaattgagcacaggattcagcacacatctggtcttacttgctggagagtgatttttagttgtgtatattaagtgtacagactacagaagagagattcaaattccggtgttgtgtcaagcaagttgtatatgccaagataatacaagtcaggtttgttcatttgtataacagttttagctcaagcataacac

SEQ ID NO: 53251 - DNA, 228 bp, Zea mays
  Clone ID: LIB3068-026-Q1-K1-E7
gaagacgaagatgaagacgaggcctctctccgggtatattgaaggaaggagaaggcttttgcgcgcgctatgctgaggctgctaatctagcacccgcctagacgtttcccttttctctggtggattacggactggatcggaccaaagatcgatccagctcctagtactaataatatagttgtacttgagaaaatgaataattgtaatttattgtttttttgggacctt

SEQ ID NO: 53252 - DNA, 418 bp, Zea mays
  Clone ID: LIB3068-026-Q1-K1-E8
cccacgcgtccgcccacgcgtccgcccactcgtccgcccacgcgtccggtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttccgtgatctagaacccacttggatcgatg

SEQ ID NO: 53253 - DNA, 56 bp, Zea mays
  Clone ID: LIB3068-026-Q1-K1-F10
ctgagctccaaagaatctagcagctaggagcaggccgtgtatacgccatccaccac

SEQ ID NO: 53254 - DNA, 55 bp, Zea mays
  Clone ID: LIB3068-026-Q1-K1-F11
gaaaccaagagaaaggagaccggtctatcttaaaagtgagcttcggcttacaagg

SEQ ID NO: 53255 - DNA, 418 bp, Zea mays
  Clone ID: LIB3068-026-Q1-K1-F12
cttccaaagtgttttgtttgttgtccgcctggcgcctgcccccataactactctgccacgaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatc

SEQ ID NO: 53256 - DNA, 386 bp, Zea mays
  unsure at all n locations
  Clone ID: LIB3068-026-Q1-K1-F6
cccacgcgtccgcccacgcgtccgcaaggtgctgaagcaggtgcacccggacatcggcagctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaaaagtgatctgagcagntgcatatataantcttgcatactattct

SEQ ID NO: 53257 - DNA, 391 bp, Zea mays
  Clone ID: LIB3068-026-Q1-K1-F7
cgcgtccgccacgcgtacgcccacgcgtccgcaaggttctgaagcaggtgcacccggacatcggcatgttctccaaggccatgtccatgatgaactccttcatcaacgacatcttcaagaagctcgccggcgaggcggtcaagctcgcccgctacaacaagaagcccaccatcaccttccgggagatccagacctccgtccgcctcgttctacccggcgagctcgccaagcacgccgtctcggaaggcaccaaagccgtcaccaagttcacctcgtcctaagctcctttcgagtatgtccttaagcgccgtggcgccttttgactgtatggaatggttggcatctgaaagttgatctgaacagtgcaatctataattctggcatactattc

SEQ ID NO: 53258 - DNA, 239 bp, Zea mays
  Clone ID: LIB3068-026-Q1-K1-F8
acccactcgtccgcccgcgcgtccgcccacgcgtcctctaggttctgaagcaggtgcaccccaacatgggcagctccttcaaggccatgtccatcatgaactccttcatcaacgacatcttctagaagctcgccggctaggcggccaaactcgcccgctacaacaagaatcccaccatcaccttcctgcagatccagacctccgttcacctcgttctaccctgctagctctccaagcac

SEQ ID NO: 53259 - DNA, 349 bp, Zea mays
  Clone ID: LIB3068-026-Q1-K1-G1
gagttttcttgaaaaatcaatggatgtttatctaggtcgcggcgcgagaagagagcaaggggaagatgattgtcaccgtgtttccgagcgggggcgagaggtacatgacctccgacctgttcgccgccgccagagaggagtgtattgccatgacgttttgatctttttttaccccctccccccagaaaaaaggggaaaacaaatacgcgtgtatctttatcttcacatggtattggtttaccatgcatgtacatttaaaaatatttttccccgaaacggaatagaacagctgcgtgcttgtttacacatcaaaaaaaaaaattacttgattattttattaataaaattt

SEQ ID NO: 53260 - DNA, 339 bp, Zea mays
  Clone ID: LIB3068-026-Q1-K1-G12
cgcacgcctctccgccccgctccgctccagattgcgcgcacccacccatggcgctcgccgcgtcccaccacggcttcctgcccttcgcccccgctgccacgcctaccccgtcacgggggcacctgcgcttccgcgccgcgcgccctctgccccgccccgcccggagaatttgttgccaatctatcaactcagctaatgtgttgggagcttcttcaacgacatctgatgaagcagtcccagtcccagttgtccagatagatcaagactcagaccgcgatgcgaccattgtgcagctaagttttggagatcgcttgggggcgctacttgacacgatgaaag

SEQ ID NO: 53261 - DNA, 341 bp, Zea mays
  Clone ID: LIB3068-026-Q1-K1-G2
gagttttcttgaaaaatcaatggatgtttatctatgtcgcggcgcgagaagagagcaaggggaggatgattgtcaccgtgtttccgagcgggggcgagaggtacatgacctccgacctgttcgccgccgccagagaggagtgtattgccatgacgttttgatctttttttaccccctccccccagaaaaaaggggaaaacaaatacgcgtgtatctttatcttcacatggtattggtttaccatgcatgtacatttaaaaatatttttccccgaaacggaatataacagctgcgtgcttgtttacacatcatataataattgtttgttttcatatttttta

SEQ ID NO: 53262 - DNA, 446 bp, Zea mays
  unsure at all n locations
  Clone ID: LIB3068-026-Q1-K1-G3
cccacgcgtccgctcgactctgccccagcttctgggggcgggggccccgtgccgtcctccaccgaccccggcgcgggtgtcgggggaggcggcgacgggctgggtatgcacgggcgcggccgaggtcgcgggagctaccgccaaacggtgtgccggcactggcttcgcggcctctgcatgaagggcgaggcctgcggattcctgcaccagttcgacaaggcccgcatgcccgtctgccgcttcttccgcgacttcggcgagtgccgcgagcccgactgcgcgtacaagcactcgtacgacgacgtcaaggagtgcaacatgtacaagatgggtttttggcccaatggtcctaattggcggtataagcatatcaaagctcctggngccaccgcttctggtgaggaagttcttcaaaagattttgcagatgcgctcttttaacagata

SEQ ID NO: 53263 - DNA, 449 bp, Zea mays
  Clone ID: LIB3068-026-Q1-K1-G7
caagatcaagcgcctcccgcctccagcactcttaactcaggggacacgatcgccatggccggcacatcgaccgccgccgccgtgctgtgcccgccgtccgtggccgggctccgcctggcgccgtctcccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacat

SEQ ID NO: 53264 - DNA, 332 bp, Zea mays
  Clone ID: LIB3068-026-Q1-K1-G9
gaattgcctgagcacgcaggtggacgcaagtgaagctcgccgttggcggccaccgggaagagaagttcgatacctcaccagcctgcgcgcacggaacaatggcgcacgcgaaggccgtcgccgtcctcggcgccgtggtgatcgcgtcgctcctcctcgcggctgagagccgccacattgcccgaaaagacctgggcgtcggccttggtgggggcggcagcggcggcggtggcggcagcctcggtgtcggcacgggtggtggcgtcggggttggtacaggcggcggacttggggttggcacgggtggcgggctgggtgtcggctcagggatc

SEQ ID NO: 53265 - DNA, 439 bp, Zea mays
  Clone ID: LIB3068-026-Q1-K1-D9
cccacgcgtccggtcacttgctctccctccaacaagctaattaaggccggtccatccctcgtctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgtcacaagatcgaggaggaagtcgcggcggcggcggccgtcggctccggcggcttcgccttccacgagcaccacgagaagaaga

SEQ ID NO: 53266 - DNA, 307 bp, Zea mays
  Clone ID: LIB3068-026-Q1-K1-B5
agagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgagggggagccatgccgcaaagctcccaacaacttt

SEQ ID NO: 53267 - DNA, 331 bp, Zea mays
  Clone ID: LIB3068-026-Q1-K1-B6
agagtagtagtgatccgcaatgtctacggatgaggctgttgtggctgatgtcccggggggctatgttccagcggaggtcccggcggcccatgtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaatgagaggtaggggtcgagctcggtggccatcatcaagtacgtcgatgggaagcatggctgctagctccccaccaacttccgcaagcagctcactgtgcatctg

SEQ ID NO: 53268 - DNA, 298 bp, Zea mays
  Clone ID: LIB3068-026-Q1-K1-B8
cccacgcgtccgcccacgcgttcgtacgcttgtgcttccctactacgtcccctgggctaggtgtgctgccatccggctccgggagacgaacgtggacagaataacgcagacctctatggtaccggactgtattatgccgtcccaggcgattaatttactagtgtgttcgaatctatatgttataacagcacctacgtgtattaagacggtatgtaaagctgttgcatctatattaggtgtgaaaccatcattaacgtcatcaactatgccatatataaaaagcatggcggccggttta

SEQ ID NO: 53269 - DNA, 330 bp, Zea mays
  Clone ID: LIB3068-026-Q1-K1-B9
gcgaacgcgagagccgaccgtctcagtgtgcgcgcgaagaagagaaggaggaggaagaagaagaaaaatgtatccggccaagcccaccgtcgccaccgtcagcgagccggtcaccgggatggcggcgccgccggtgaccggcatccccatcagcagccccggccccgccgtcgcggccagccagtggtcctcgggcctctgcgcctgcttcgacgactgcggcctctgctgcatgacgtgctggtgcccgtgcgtgacgttcgggcggatcgcggaggtcgtggaccgcggcgcgacgtcgtgcgcggcggcgggggccatctacacgct

SEQ ID NO: 53270 - DNA, 143 bp, Zea mays
  Clone ID: LIB3068-026-Q1-K1-C1
cccacgcgtccgaaaaaaaaaaaaaaaaaataaaaaacaaacaaactaaaaaataacaaacgggagtacacaatcatacggatacaaaaactaaaaaataatgaaacctaaacggccatcctctttactgcgtcccacttttc

SEQ ID NO: 53271 - DNA, 348 bp, Zea mays
  Clone ID: LIB3068-026-Q1-K1-C10
ggtgggttggcttctcctcccccttcggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttcttcacggaggaggcgatgcggaacgccatcgagggcatgaacggcaaggagctggacggccgcaacatcaccgtcaacgaggcccagtcccgcg

SEQ ID NO: 53272 - DNA, 115 bp, Zea mays
  Clone ID: LIB3068-026-Q1-K1-C11
ccgggcatgatctgatctgatctgagctcgtctttggatatggattactaggacactgacgtggagtgcttctagatgcccgggtagaaagcgaagaatcccttcaccattacca

SEQ ID NO: 53273 - DNA, 399 bp, Zea mays
  Clone ID: LIB3068-026-Q1-K1-C12
aaaaaaaaaaaaaaaaaaaaaaaaaaaaaaattaaaataaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaaggtccaaattttacttccccttccttgcaaattcttatttttttttttgggcccccaaatttaattcacttggccgttttttaaaaacaccgaacttggaaaaaccctggttttcccaattttattccctttgaaaaaaatcccctttttcccatttggcttattaccaaaaaggcccaccccaatcgcctttccaaaaatttgcaaccccttattggcaattggtacccccct

SEQ ID NO: 53274 - DNA, 211 bp, Zea mays
  Clone ID: LIB3068-026-Q1-K1-C2
aaaaaaaaaaaaaaaaaaaaaaataaaaaattaaatataaataaaaaaaaaaaaaaaaaaaggaaagactaaaataataaaaattaaaaatcaataatataaataaatatataaattaatttaaaaattaaaaaaatttaaaaatattcttattaaacaattaaaaaaaactttatcttttttaaattatccaatttttttttctttttat

SEQ ID NO: 53275 - DNA, 238 bp, Zea mays
  Clone ID: LIB3068-026-Q1-K1-C8
aacacacttggcatgacaccctgttcttaattattgccagcacaggagaaacaaggagggggcctcatctgatactcgtccgcactatggctgctctcgacatcctcgcatctctcggcgaaagctcgtcgtcctggccctgctgcaacaactgctgtgcttgcaacacgaagcatccgccggagtgccagtgcaatgacatgtccgtcaacgggtgccatcccgagtgcatgaactg

SEQ ID NO: 53276 - DNA, 360 bp, Zea mays
  Clone ID: LIB3068-026-Q1-K1-C9
ggcatcagctgagctgagctgagctggtccatggagagggattactcgtccacggacggcgggggcagcgagatgcccgggaagaaggcgaggaagccctacaccatcaccaagccccgcgagcggtggagcaccgaggagcacgcccgcttcgtcgacgcgctgctcatgttcggacgcgactggaagaagatcgaggagcatgtcggcaccaagacgacggtccagatacggagccacgcccagaaatacttcctcaaggtccagaagcttgggctggccgcaaggctgccgccgatgtacccgaggcgccacttcgccatgcagcagcagcagagctcggtggccgatggtagcagc

SEQ ID NO: 53277 - DNA, 410 bp, Zea mays
  Clone ID: LIB3068-026-Q1-K1-D10
gaccgactcgtccgcccacgcgtcctatcacttgccctcccttctcacgctcagtaacgccagtccatacctagtctagctcgaatcattatccatggctgacgagaaccaccaccaccaccacctgttccaccacatcaagcacgaatagcacaccctgcactgcctttactgcaagtccagcaaatacacgcacgccactgtgaacccagtcacatcaccgtccagaaccagttcaacaagtacaagaacgaggacaagcaaccccagcacaagcatcacctctgcaaggccatctccatcgtcgacagcgccttcgcactctactagaatcacgaggcgaagaatgacacctatcacgcccaccgtcacaagatcaaggatgatcgtccctcatctgacatcctcat

SEQ ID NO: 53278 - DNA, 131 bp, Zea mays
  Clone ID: LIB3068-026-Q1-K1-D11
ccacgcgtccggtcacttgctctacctgctacacgctaattaacgccggtccatccctagtctaggtcgattcattatccatggctgaatagaatctccaccaccacctcttgttccaccacaacatggac

SEQ ID NO: 53279 - DNA, 428 bp, Zea mays
  Clone ID: LIB3068-026-Q1-K1-D2
cggacgcgtgggaagaactgaagcttgcgacgtccaactactcacctgatatgttaattgggaagggtggaaccagccaggttttcaaggcacagcttgatggcggaacatttgctgccataaagattcttaaaccctcggttgatgcaatacacgagtttgttacggaggttgagaccgtaaccagcttgcagcatgagaacattgtagcactaaggggattcagcttcgagaactacaaccttgtgttggcatatgattacatgccccgagggagcttggacaaagctcttcatgggaagaatgatggcacagagtttcttgtctgggagaggagaattaagatagcaattgacatcgcaagagcactcaaatttctccatctcggcggtgtgacccagtctgtgatccatggagatgttaagtct

SEQ ID NO: 53280 - DNA, 380 bp, Zea mays
  Clone ID: LIB3068-026-Q1-K1-D3
cggacgcgtgggccgacgcgtcggccgactcgtgctggcagttgccatgcacacaagtcatgcgaggtattttcgaagagctgcattggtcaagagcgctgtggggtaagcgcggttccagatgcattcggtggagatccatgtcctgggactatgaaaagagcccttgttgaggctatatgcggatgagtcatatgatccatataacgtactggtttctacaataatgttaccctatattaagcttgtaagaggtgaaagtggtggcatctgcgacacacggattgccagggtttacagggattaattgtatggtagatttaatcatcgtatgtgtaatgaacttagggtcacattagatttgcatggttgaaatggtt

SEQ ID NO: 53281 - DNA, 381 bp, Zea mays
  Clone ID: LIB3068-026-Q1-K1-D6
cccacgcgtccgcccacgcgtccgcggacgcgtgggaacgatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagccgcgacgcccttgcggttggaggaggcttagaagagcacggatcctcagcgatgaaccctgggcgctcaagctggggaagtgaagcaagtcgatg

SEQ ID NO: 53282 - DNA, 216 bp, Zea mays
  Clone ID: LIB3068-026-Q1-K1-D8
cccgcgcgtccgcccacgcgtccgctgactcttgggaacgatccctccttccaagaacaggttctgttttagggtcgaacaggatcatgttctgaggccccgtccaactaatggtttcatgagtccaatcatggttagagctgttggcgacattgatatgggtagaaaaccagtggcttgtgattagcctatgatggcggctgaaattggtgattt

SEQ ID NO: 53283 - DNA, 395 bp, Zea mays
  Clone ID: LIB3068-026-Q1-K1-B2
cccacgcgtccgcccacgcgtccgcccacgcgtccggagagaaccgaagggcctctgtcatctgggatcaagaggctggtcggtacgtgtcagttcctgcacagacaagaatgggaagtggagtcgatctgccagcaagaaacccacggttcttgacgaacccaagtggcgagccaagcagccatgtgaggagcgtggtgcctggcaatgcctcgtcctcagcaatgccatcagggcagccttcatagaggttgacatattctgggcagtcaatattcttcggtggccccatgctgagcacccctggcgtgggcgccaataggaatgaggcagactcaagagcacgctccgagggaagcagagatcctaatgccctgtgtgagaaaactaggact

SEQ ID NO: 53284 - DNA, 330 bp, Zea mays
  Clone ID: LIB3068-025-Q1-K1-G6
acgcatgcgtaaactcacacgccctggcgaggatcctgtttccaatcccctcattccaaattgaccacgaagacccttaattccggatccggggggaaaaccccggtttttttcccgaacttaacttcttcacatcccttgaatatgcttccgttcccgggccccaccgtctattcaaggcttcattccgtctcaacttggaaacaatgtgctcgctaagtctccttgccagtttccggccatacattgcccaaaaacaagcactggctcaatgctgtccattatgttggtcatgcagagcccaattgggaaagaacccaagataacatc

SEQ ID NO: 53285 - DNA, 371 bp, Zea mays
  Clone ID: LIB3068-025-Q1-K1-H1
cggacgcgtgggccggcatcgccgcgctcatgaccgtgctggtggtcaacaaccgcaaggaggtcgacaacatacccaggagccgtgtcaagtgctacgccctcgcgcccgccaggtgtatgtcgctcaacctcgccgtcaagtacgctgacgtcatcaactccgtcgtgctccaggacgactttttgccaagaacaccgactccgctagagtacatttttggttctatcttctgcttgccctgcatgctatttctcatctgcttgagagatacatttaaacaagacaagagaaaatttatagatccaagaagattgtatgcacctgggcgaatgtatcatatcgttgagaggaaattttgcagatgtgga

SEQ ID NO: 53286 - DNA, 163 bp, Zea mays
  Clone ID: LIB3068-025-Q1-K1-H3
acgcggacgcgtccgtccacgcgtccgcccacgcgtccgcccacgcgtccgctggccctaagattgtgtcttgaaacaagtttaaaattaagattactcgtggcaaaaaaaaaaaaaaaaaaaaaaaaaaacataaaaaaaaaaaaaaaaaacaataaacaaa

SEQ ID NO: 53287 - DNA, 432 bp, Zea mays
  Clone ID: LIB3068-025-Q1-K1-H4
ggccatgttgccacaattgcagagctcaagcctggtgttctctcagtacatgaaggaaacgatgtgagcaagtactttgtgagcagtgggtttgctttcgtccatgcaaactccattgctgatattgtggctgttgaggctatccctgtggatcagatcgacccagcattggttcagaagggtctcgctgaattcactgccaagcttggtgcggcctctactgacctggagaaggctgaggcccagatcggagtcgatgttcacagtgccctcaatgctgcattgaccggttaattggtggcattttaaattgtcttgtatttttcatctacagttttagagtgagtttaagtttgcaaactcatgggcatgggatggacggaatgatcctaaataaattatactccatctaaaacatggacatatgtttct

SEQ ID NO: 53288 - DNA, 455 bp, Zea mays
  Clone ID: LIB3068-025-Q1-K1-H6
cccacgcgtccgggcaagcgctgaacctgaacctggtgggcgacccggacctggtggcgagagaccccgtggtagccttcaagacggccatctggttctggatgacgccgcagtcgcccaagccctcgtgccacgccgtgatgaccggcgactggaggccctccgccaccgaccgcgccgcggggaggctccccggatacggcctgaccacgaacatcatcaacggtggtctagagtgcggcgaggaccgctccaccgacggcgccaaagccgccaaggaccgggtcggctactacaagaggtactgcggtatgctcggagtggggtacggggacaacatggcatgcgggagccagaagccttacggaggatgatgacactagtagctgatctatggttgctgcaatgcaagccttcacgttgtgttgcctctctacctaaagaataaatcaagc

SEQ ID NO: 53289 - DNA, 426 bp, Zea mays
  Clone ID: LIB3068-025-Q1-K1-H9
cggacgcgtgggcggacgcgtgggcggacgcgtgggcggacgcgtgggcgtggcaatcggggggatcttcgtcgccctcctcgccgtggccggcgaggcggctgtgttcacggtggtgaaccagtgcccgttcaccgtgtgggccgcgtccgtgccggtgggcggcgggcggcagctgaaccgcggcgagagctggcggatcacggcccccgcgggcacgacggccgcgcgcatctgggcgcgcacggggtgccagttcgacgcgagcgggcgcgggagctgccgcacgggggactgcggcggcgtgctgcagtgcactgggtacgggcgcgcgcccaacacgctggcggagtacgcgctgaagcagttcaacaacctcgacttcttcgacatctgcctcatcgactgctttaacgtgcccatgag

SEQ ID NO: 53290 - DNA, 447 bp, Zea mays
  unsure at all n locations
  Clone ID: LIB3068-026-Q1-K1-A1
ccatcttgaaaatggtatcaaacagtctatcgaaggtgccacgatgtatgactatgtggggactgcagatgatgttggtactcttcttgctgtagactgtacgcctatggatgacaatggccgccagggtgatttggtgacagaatttgctaataatgggaataagataacatgtgatccagagatgcagagtcatatcgatgcatgtatttctaaagggagagctgaatttgaagtttttgtcctgcaggcttattctcctgaggaatgggaactggctacattggtgctcacacgacctaattatcagattaagttcaaacagaccggtaatgttgtaattgacgagaagtactcacaaagtctacagacaaaaattcctaatgggcgcacaactcagtttgttttaataactgcgggtacaactcttncatttaacacacaggg

SEQ ID NO: 53291 - DNA, 402 bp, Zea mays
  unsure at all n locations
  Clone ID: LIB3068-026-Q1-K1-A10
tcgcccacgcgtgcggcacatgacagtgatcaggaggaagcagaactaggttcagacatcagagggatacaaaaaaatgcggtggatggttaaagtcatggagagagcacaacagaagacagctgccttctgaagcacaagatagatgaagaatccaagggtgatgaacaacaagaattaggtgttacagtggatgatgacttggtgcatgaagacacgcttgaaactgacaatgctatcgagcatacagatgatggtcaacacgaccaggatcaaagaaccctgaaaggcaaacgaggacacaaaacctgcaagcatcgcanacaatgacgatgttgagattgtaactgagacacctactggactccaagctcctgtggagtcacgtatgactgattctga

SEQ ID NO: 53292 - DNA, 190 bp, Zea mays
  Clone ID: LIB3068-026-Q1-K1-A11
caaggaccttcggcgcccgttcaggatccacatcttcccgagcgagttcttggttgaccggttcctcttcggaccacctccaaagctcttggtgtagcttggcactctcaccaatcaagttttcatgtctgatctcgacattcagatcccaactggcttcgatcccttcggttaaggccatgtctgggac

SEQ ID NO: 53293 - DNA, 333 bp, Zea mays
  Clone ID: LIB3068-026-Q1-K1-A12
cccacgcgtccgcccacgcgtccggttgttcacggcagcggagcggcggcgtggtgcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgggaggtgtactcgaagaagggcgtgatgcggcggctgatgcggtggagccggccgcggtgggccgcggcggagcatgcggagtgcg

SEQ ID NO: 53294 - DNA, 337 bp, Zea mays
  Clone ID: LIB3068-026-Q1-K1-A3
cccacgcgtccggatacactgagagatattttagccgtagcccgtagccgttcattgtaggactataggtggctggctgtctcgagtattggtaaagactgttcggagtgcgtcgttcgttctcgtccagaacagctgggttctgggcatccggggaagaaacggaggcgttgacgcgtgtgtgtaggttcagaagaaaccccaataagataattgcgttgttatatgatgccgctcgcattattaggacgaaaaaacaaaagaagaatgagaactcggatacataggtgcacacacgacctaattgctagaataaagctcccacagaccgcttatg

SEQ ID NO: 53295 - DNA, 304 bp, Zea mays
  Clone ID: LIB3068-026-Q1-K1-A4
acaacgcgtacggatacatctgagagaaaatataaacaaaaacaataaaacgaacataggggggctatatgtggctgacctcgactttagtatcgctaaagactgatccgattgctttgttctttctcgtccaaaacataatgtatttgcccattctttacagaaacggaactggaaacacccttgtgttgcctaacataataccctagtaagataattgcgttgctatatgatgcctattgcattattaggacgaaccgattggtctttctaacattttcgcagcctgaatggataaaggaac

SEQ ID NO: 53296 - DNA, 338 bp, Zea mays
  Clone ID: LIB3068-026-Q1-K1-A6
cctgcgcgtacgcacacgcttgcgtcaaagatactgccttgcttgagcaggtccgaactaaggctaacagcccaactgcgactggttgatgatggcacacgtagccaggtcgagggaccctgctactttgatacccggatctatggtaaggctaagccgaccactaaactaggactcccagaaggtgctcctgaatcagataacaggctggcgcctgctctgattgtcagatccggtgcataatgaccacttgacgaatggcactgccgatgaggcagcgacccagaatgctgctatcggtgatatcatctatctatggcaggatctgcatcttccac

SEQ ID NO: 53297 - DNA, 269 bp, Zea mays
  Clone ID: LIB3068-026-Q1-K1-A9
gtgacttaagccgtcgccgagtgctatatggtgctgctaaaaacactgcagccctttgggccacataataatcttccactgtgaagagcttgagcgtggccttgtatcatggcagcttttcgcctcgttgtacatagtctagtttctcatcactgttttagattcagcacagaaatgcagctgccgtctgcacgactgttgcagctatgaagctgtatgtaccttactgttggtgcactattttagttattgctaatcacaggggatac

SEQ ID NO: 53298 - DNA, 372 bp, Zea mays
  Clone ID: LIB3068-026-Q1-K1-B10
ctcctccccctacggttcgggttcgggttcgtgaggttctccggagttcggtttcgtgggtgagcggatcgagatggcggcgtcagatgttgagtaccgatgcttcgtcggcggcctctcctgggccacggacgaccactccctccacaacgccttcagcacctacggcgaggtcctcgagtccaagatcatcctcgatcgggagacgcagaggtcccgcggcttcggcttcgtcaccttctgcacggaggaggcgatgcggaacgccatcgagggcatgaacggcaaggagctggacggtcggaacatcaccggtaacgaagcccagtcccgcggctgccgtcgaggctgcagcggcagcgggtacagtgg

SEQ ID NO: 53299 - DNA, 357 bp, Zea mays
  Clone ID: LIB3068-026-Q1-K1-B11
tcgcccacgcgtccgattgaatggtacttatttaaaaaaaaataaaaaaaaaaaaaaaaaaaagaaaaaaaataaaaaaaaaaaaaaaaagataaaaaaataaaaataaaaaaaataaaaaaataaaaataaaaaaaaaaaaaggccgttcattcaaaaagagtggagctcctttaagataggttatcaatggcaaaaccatttcctatccgaagacaattaaattccatggctaaggtttttaaaccgcttgcatgttaaaaactatgccttacgcaatcgaattgatttacagaaattaaccctttatggcgaatgtgactttccacaaagcccagtattaatcacgtttcccaa

SEQ ID NO: 53300 - DNA, 415 bp, Zea mays
  Clone ID: LIB3068-026-Q1-K1-B12
ctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaagccatctgctgctgctgctagttctgcttggagggcatgggcgtccatcatcgtggagatgtggccatgcgggacacccaccgtcgaataaaatgctgtacttatatgcacgcacgttagaaatgcattagtgtctgtttgatgtgatcttgtgtgtgtgcgcgcgcatcttcatttgcac

SEQ ID NO: 53301 - DNA, 441 bp, Zea mays
  Clone ID: LIB3068-025-Q1-K1-E4
aacacgacctggggggttcagatcggatcggaagcttccataagtttccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagtcggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgcttgggtggtgatgt

SEQ ID NO: 53302 - DNA, 335 bp, Zea mays
  Clone ID: LIB3068-025-Q1-K1-E6
cggctggacggacgcatgcgtccacgcattcagaccctcactgaccttaccgctagcccagcctgatctaatgttaagggagcgtttttcagaacgcctgtcggcacccgcaagatggcgaactatgcctgctctctgcgaaaccacaggaaactattgtatatgctcgaaccgatactgacgtgcaaatcgatcgtctcacttatgtatacgggcgaaagactaattgtaccatctattagctcgttccctacgaatgttccctcactatagctgtatcccacacaagttctattgtctaaagccaacgattataggcatcttaggcgcaatat

SEQ ID NO: 53303 - DNA, 441 bp, Zea mays
  Clone ID: LIB3068-025-Q1-K1-E7
cccacgcgtccgcccacgcgtccgattcatgattccatccatattggatcaattctcgataccattttgcaatgaaattagaggaatgttatggtaaaacttcgtttaaaacgatgtggtagaaagcaacgtgcgacttgaaggacatgatcgattgtggatttgcctatccatcattttccatagtaatgaaaatgctcttggctcgacatagtctgttctattcgtcccgaaccgaattttcgctgggttgtttgtaagtaaagtaaatagtacacgatggagctcgagaggacagaatttctttttgatcaaaggaaagaatctagggttagtgaaaactaataaattaagccaactttgtcagtctatccttaatatagaaatcaaaagggtaaaattagaaaaaggctaattttggaaagatggaaaaactttttt

SEQ ID NO: 53304 - DNA, 251 bp, Zea mays
  Clone ID: LIB3068-025-Q1-K1-E8
gcacccgccgccgacagggaacatcgccggccgagatcggctgcacatctgtgctgctgcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctccc

SEQ ID NO: 53305 - DNA, 434 bp, Zea mays
  unsure at all n locations
  Clone ID: LIB3068-025-Q1-K1-E9
cagacaaatatgagttgccaaggctaagattgttgtgtgaatcttacttgtgcaagcatgtttctgtaaactccgtggcaactactctagcattggctgatcgataccatgctatcgagcttaaatctgtttgcctaaaatttgctgctgaaaacctttcggctgtgatccggaccgaggggttcgactatctcaaagacaactgcccatccctgcagtcagagatactgcggacagttgccgggtgtgaggaacaatgtagcagcggcgtgaaaagccagagcgtatgggcgcagctctctgacggcggcgacaccagcggtcgcagggtgaggccaagggtctgagacgcgatcctgcaagcactaacctttgtaatcaaactgtggtagtgtaaaatggatacagctatttgaattntaatctgggacgac

SEQ ID NO: 53306 - DNA, 359 bp, Zea mays
  Clone ID: LIB3068-025-Q1-K1-F1
ccaagctttccattccgtcgtatcgtgtgatcccgcctccggtatgaatgattcgcgtgttttgatttcgatctgatccgtcgcactgtttgactcggccccggccgggtactgagggatccaaatccaagggaatggatcaggcggcagccatgagccccagcccacgcgccgccgccggcatccactgggaggcacacgggcggcttctcacggcgtgcctcgtcgtgctcaacgtcctcctcgtcctcctcgtctacgcctacttctggcgcttcttctcgcgctcgcgcacgcgcggcggcggcggcggcggcggcggcgaggacgacgactcggccgatggggcgtcggcgtct

SEQ ID NO: 53307 - DNA, 417 bp, Zea mays
  Clone ID: LIB3068-025-Q1-K1-F12
cggacgcgtgggcggacgcgtggggcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactatggtggagggagctctacaacactgtgaagctcccgtacgctcgggaccgtatggtggagatctacttttggacctgtggtatgcttcatgaggaggagtactccctggcacggatgttcttcgccaagacgttcgggatggtgtcactgatggacgacactttcgatgtccatgctactc

SEQ ID NO: 53308 - DNA, 363 bp, Zea mays
  Clone ID: LIB3068-025-Q1-K1-F5
cccacgcgtccggggggacaaagggtaagagcctgcagtaacagatattggctctgtctggtacttgcaatttctatcccttcaactctttcttccgcccccgtgtttcaggaataatgttctggagatgaagaaacgcttgcgtgggcgtgcctgcaggcacgcgtgtagtagctgcggtattagtatatatgcttagatgttcagtcactttctttaagtacaatttggcgctggacgtgtaccttattttactatgtatccgtgacaacagctatgtgtctgctccctttattttcttggctttgcttcaaaaaaatggctacgaacattgcgaggttggacctttgagaccatatatat

SEQ ID NO: 53309 - DNA, 386 bp, Zea mays
  Clone ID: LIB3068-025-Q1-K1-F6
tgttccccaacctccgcagccgcttcaccgtcctccactccggctgccgaatcgggccggctcgatccagatcaggagctgagggatggacgcgaacaggcgccagagtgggatccagcagttgctggctgcggagcacgaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagccgcgactccggtgcaaacgtcaagcgtctcgaggaagaaacggcggcgaagatcgagcaactcacccagcatgccgcaagcatctccccggatgtcattcagatgc

SEQ ID NO: 53310 - DNA, 272 bp, Zea mays
  Clone ID: LIB3068-025-Q1-K1-F7
ggggacttgggggttgccgagctgtccgtctttcccctcctctctacccaccagctaccgcgggagggcaaggcaaacatctgcggcctcctttcccgaacccgggttggatggagcgggacttcctggccgcgatcggcaaggagcagcagcacccgcgcaaggagaaggcaggcggaggcgccgaggaatcagcttacttcggggcagcagccgtcccggcgatggactggtccttcgcgagcaagccctgcgccggcccggcgcttatg

SEQ ID NO: 53311 - DNA, 383 bp, Zea mays
  Clone ID: LIB3068-025-Q1-K1-F8
acgcgcgaacaaccgaggcgaggatccggataaaaagccacgagatacagagatggacacgggggacactgcactccggatccgcgggggacacgccggtgttcttgccggacttgagctgctccagtgcgctggagtaggctgcggtgccggggccgcaccgactatgcacggcttcatgccgtcgcaacttggagacatggtgctcgctaggtcgactgcccccattccggctatacatggtccaaagacaggcgctagctcaatgctgaccattaagtgggtcatgcggagcccaattgggaaagaccgtacgataacatctgcttcatgggtacgccagtagcacatccacgtttgggactgttggctctgtaccgatc

SEQ ID NO: 53312 - DNA, 82 bp, Zea mays
  Clone ID: LIB3068-025-Q1-K1-F9
aagaggacgcaaactacaaaaataaaaaaaacaaaaaaaaacaaatataaaaaaaaaaaaaaaaaaaaagcggggggtgtaa

SEQ ID NO: 53313 - DNA, 84 bp, Zea mays
  Clone ID: LIB3068-025-Q1-K1-G1
gacccacgcgcgcccacgcgtccgcccacgcgtccgcccacgcgtccgtccacgcgtccgccgacgcgtccgcccacgcgtccg

SEQ ID NO: 53314 - DNA, 430 bp, Zea mays
  Clone ID: LIB3068-025-Q1-K1-G10
cccacgcgtccggagatctcttgcctcacgacacgagcagcagaatttgtcgagggccggtggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgttgtcatccccatcctagtagcgtagaaaccacctgcattttcattttgatctccctaatccctccggctagctgctttccaatgaccaaaagatatcaaagaccactttccgtctttcttccgtggcctgtctgtcatctggctctgaaac

SEQ ID NO: 53315 - DNA, 420 bp, Zea mays
  Clone ID: LIB3068-025-Q1-K1-G11
ctcactctccgctggtcgctcactcttgcagctccacccttcactcagtcttagtctctgatgggctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaagagcccgtcgcggccgaaccggccgccgaggcggaggctgctgctcctgctggtcccgaggagactcctgcggtcga

SEQ ID NO: 53316 - DNA, 230 bp, Zea mays
  Clone ID: LIB3068-025-Q1-K1-G12
cggactcgtgggcggacgcgtgggtttttttttttattttttttttattcttatttttggatgtgttttattttttatttattttttttttttcttatttttttcatcattctttttacttttcttatccccactgtccaagtccccttgtccacacctttttgagtcaggtagcccacgtaccggaaaaacctccgacggccgcctttcccgatcattctgctttcttt

SEQ ID NO: 53317 - DNA, 455 bp, Zea mays
  Clone ID: LIB3068-025-Q1-K1-G2
gaaacgcggacgccgcggcgaggatccggttcccaagcccgcgatacgagatggacaccaggtacctgcactccggatccgcgggggacacgccggtgttcttgccggacttgagctgctccagtgcgctggagtaggctgcggtgccggggccgcaccgcctctgcagggcttcatgccgtcgcagcttggagacaaggtgctcgctaggtcgcctgcccgggttccggcgatacatggcccaaagacaggcgctggctcaatgctgcccattaggtgggtcatgcggagcccaattgggaaagaccgcaagataacatctgcttcatgggtcgtcgagtagcaaatccacgtttgggactgttggctttgttccgatcggatctagagatggcaatggcaatgacaaatcatattcgcactaggttattcgttccagtactttcacggacact

SEQ ID NO: 53318 - DNA, 318 bp, Zea mays
  Clone ID: LIB3068-025-Q1-K1-G3
gcggcggctatggtggcgggcgccgtgacggcggttatggcggcggtggcggctacggggggcggcgcgagggtggtggcggcggctacggaggcagtggccgctaccgcggtcggcgcaagggttgtggcggcggctggagggactgatgtgtgggcccatcctggcttctggcgagttatcttatatatctatagtattgtgttaccgatcgcttctgtcaccgcgttagtgttcgatctacctttggattacgtgttggtacccctgttgttccctttggctgctcccgctatgaaacgagacgagagaataatg

SEQ ID NO: 53319 - DNA, 380 bp, Zea mays
  Clone ID: LIB3068-025-Q1-K1-E3
gggacgcatgcgtccgcctaagcatacacacataagagctggtcatgaaagacctcattgattgacgaccaggcgaggtctattctcataagtggcgtaccctcacaactatggacctgacacagggactctttctgaacacaatgacccattcgatgcgttggtcctgatgcaggagcctgttattcctggctcgttactgcgagcatgaacaatcggtcttatgcccatgattgaccagggtgaaaaggattacaagatattctcaacctgtgctgatgatcctgaatatcgtctctactacgacatcagtgagctgtcttctcatcgtcagcacgagatcaagcggctctttgaagattattagaaggatgataatt

SEQ ID NO: 53320 - DNA, 363 bp, Zea mays
  Clone ID: LIB3068-025-Q1-K1-B8
cccatgcgttatcacagtaggaagctatgaggaaatcaaagcaacaaagttgccggcggagagaagcaaccatgagacctcaggcgtcgttactcgtcacactggctgttatcgtcgtcgtccctgcagctctgccactcagcaaagggacggaggaggaaggaggaggggaggcagtcgccgccgtggacgccgccggaacgagctcgtggccgtgctgcaacaagtgcggtttctgctacctgtctgacccgccgcagtgccaatgcctggacttctcgacggtcgggtgccacccagagtgcaagcggtgcatcaggtacaccgtcgacggtggcgtcgacatcccgcccgtgcacgcct

SEQ ID NO: 53321 - DNA, 354 bp, Zea mays
  Clone ID: LIB3068-025-Q1-K1-C1
agttgccaaagtttcagtctttggctgctgctataccggattatgctcgtccaatagatgatgggctttatcgtgctattgacatatatctcaaggcgcacccacatctgccagaatcggacaaggaagagctctgccgggtgatggactgccagaagctgtccctggaggcctgcacacacgcggcgcagaacgagcgcctcccgctccgcgtcatcctgcaggtcctcttcttcgagcagctccagctgcggagctccatcgcggaatgcctcatgatctcagagcccctagacggcggcggcggtggcttctcgcggcagctcggcggcctgcctgtctcgggcgagcacc

SEQ ID NO: 53322 - DNA, 394 bp, Zea mays
  Clone ID: LIB3068-025-Q1-K1-C11
cggacgcgtgggctatgaacttaccgtgaccgcttgttggtaaacctctttctgtgtgttttatccaagatggtgcatctgattctattggggtaagatcccgtatttgccgttcgttcaatagactcaaatagtgcagtgtcatcagaaaaagcaaactgcacacatgaaaccttatgggtttctttggcagacatcgcctttattaatggacatctttaaattagcttgtaccgatacatgctatgtccattagagaaacgacatcctgaggcactcgccttcgctccggactgtcttagggttatcgctgatatagatatggtttacatgcttctatacccttagaactctttcgctccgaatctcgggacgagattcttttaagggggga

SEQ ID NO: 53323 - DNA, 370 bp, Zea mays
  Clone ID: LIB3068-025-Q1-K1-C2
cccacgcgtccgctatcacagtaggaagctaggaggaaatcaaagcaacaaagttgccggccgagagaagcaaccatgagacctcaggcgtcgttactcgtcacactggctgttatcgtcgtcgtccctgcagctctgccactcagcaaagggacggaggaggaaggaggaggggaggcagtcgccgccgtggacgccgccggaacgagctcgtggccgtgctgcaacaagtgcggtttctgctacctgtctgacccgccgcagtgccaatgcctggacttctcgacggtcgggtgccacccagagtgcaagcggtgcatcaggtacaccgtcgacggtggcgtcgacatcccgcccgtgcacgcctacc

SEQ ID NO: 53324 - DNA, 393 bp, Zea mays
  Clone ID: LIB3068-025-Q1-K1-C4
gctttcgaatgtgttcatgatggctggggtgttgctgtgctggtgggtgtgccacatagggaggctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaatggggagggcatccgctgcatcatccgcatggagaactagatttcgctgtctagtttgtgatctggcctgggcttggggttaataaaagaggcaatgctagcctgccctttcgatgaggaggtacatacacgc

SEQ ID NO: 53325 - DNA, 362 bp, Zea mays
  Clone ID: LIB3068-025-Q1-K1-C6
cccacgcgttcgggaatttggagctcgtgttgccttcgaagtctatccgtgagatgtagatatatatttacatacatatatgtatgtgtgtgggtgccttgcgtggcttggcgtgatgatgtcataaataaagagggtgggtgtgcttgcggtattcatggatggccatggatctgagcacatgacgttggatgctttcttaaggctctcgtggatcttctatatttggaagaagctgtaaaataatatatcgccatctagtgttggcgttggcttgtatgtactttgtacctgctttattattttgtgcaatatcgagtaacctaatgtataaaaaaaaaaaatacacgacgtgatcgcat

SEQ ID NO: 53326 - DNA, 340 bp, Zea mays
  Clone ID: LIB3068-025-Q1-K1-D1
tcgcccacgcgttcgtccacgcctaattttctttaagaccacgaacgactctagtgtcgcgggattaaccgagcggcttgaagagccacgaacaaaagctgcaaaacgctttcaaaatactgaaaaggaatcttcacaagtttcaggcagaaactgcttctcccctacaatcggcctctcaacgcatacgctacatgttgtcccatgaccctccacagccagaacacttcttcgtggctctcgagagcaacgcgcctatgcaacctacataccatactatggacatgaaccagtatccagagccagcgcctggcggctgttaccctcctcctttgattgc

SEQ ID NO: 53327 - DNA, 303 bp, Zea mays
  Clone ID: LIB3068-025-Q1-K1-D11
gatttgtctaacaatgatctctgtggaactattcctgttgatgggcctttctcaaccttgcctctccgaagcttcgagaacaacagcaggctcaacggtccagagctacaaggattggttccttatgattttggatgttagatgccgatcaacaatgtaccaccttccccagttgaaagggggaaagccaagatagtattatcaatagaaacctagcttcaagaatgtcgtgactatatatatgtatgatattaagacgagatttgataagggtggcaaaaaaaaataagacacgccctgtaa

SEQ ID NO: 53328 - DNA, 101 bp, Zea mays
  Clone ID: LIB3068-025-Q1-K1-D12
aaaaaaacaaaaaaaaaaaaaaaaaaaatttaataaaaataaataaaaaaaaaaaaaaaaggagggaaaaacaaaaaaaaaaataaaaaaaaaaaaaaaaa

SEQ ID NO: 53329 - DNA, 118 bp, Zea mays
  Clone ID: LIB3068-025-Q1-K1-D3
tccacgcacgctctccttcacactacatactttttgacactccttcacttctaaatacggggcgttttccaatagggatgaaggtcccctaaagatagataactatgactttgaaaag

SEQ ID NO: 53330 - DNA, 96 bp, Zea mays
  Clone ID: LIB3068-025-Q1-K1-D4
atacgacccaatcttcttactcctacatgcctttttttagctctcttatattgacacctattgtaggtctattaccagagttggcaacctcccaac

SEQ ID NO: 53331 - DNA, 335 bp, Zea mays
  Clone ID: LIB3068-025-Q1-K1-D5
cggacgcgtgggtgcagcccaaatcgggcggtaaactccgtccaaggctaaatacaggcgagagaccgatagcgaacaagtaccgcgagggaaagatgaaaaggactttgaaaagagagtcaaagagtgcttgaaattgccgggagggaagcggatgggggctggcgacgcgcaccggccgtatgcggaacggctcctgctggtccgccgatcggctcggggcgtggaccgttgtcgcccgcgccggcggccaaagcccgggggccctaagcgcccccggcagccgtcgtcggcgcggacggtatccgcgcgcctcttgcgcgcccctcggggcg

SEQ ID NO: 53332 - DNA, 333 bp, Zea mays
  Clone ID: LIB3068-025-Q1-K1-D7
tacgatccacagatgcactcacatacattccttggttaagatctgggttcacttgatgacatggaggttgatcagcttgagaagccaaccgattcattcttaaatcacatacgatccacaaggtcacagcatatgcttgaacagctcactgatcttcagacgtggtagcaaatgatgtgtgaagcatataacttcctaacaagaaagctggatgagaccagcatccaacttcatgtccaagtgtgcgttcacggcgccaactgattactctactaccagcggtactccttgccacagccagccccataacatgttgtcctttgattattcttt

SEQ ID NO: 53333 - DNA, 377 bp, Zea mays
  Clone ID: LIB3068-025-Q1-K1-D8
cccacgcgtccgcccacgcgtccgcccacgcgtccggtcacgcgtcagttcgttcccggctctgtgtaccggccagtaaaatccgaacccacagcgagaaatggcggccgcagcgctccgtccggcgatcctgcgccgcattcgactatccccctgcccttcgctcgccctcggcgccgatgggacaggtgcatcccacccgcacgcgctggggcggtggctcgagcggcccatgtcctgccacgacgcgcacctcacccgcgacgaagtcatcgaccggatcctcgacgtcatcaagagccaccccaagatcgacccctgcaaggtgaccctggaggcgcacttcgagaaggatctcgggctcgacagcctggaca

SEQ ID NO: 53334 - DNA, 396 bp, Zea mays
  Clone ID: LIB3068-025-Q1-K1-E1
atttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataact

SEQ ID NO: 53335 - DNA, 335 bp, Zea mays
  Clone ID: LIB3068-025-Q1-K1-B6
tcccaatcgacgactcatacaaccactcattctcccactcatcctaaataaaataaaaaaaaaaaaaaaaaataaaaaaaaagcagaatattataaaaatttagaccactaataaataataaaaacaaaaaaaacaataaaaaaaattaaaaacataataaaatttaaatccccccttttacacaatccaacttttacttcatcattcattctaattctaacattttaaatatttctacctaattaaatatatttatccatccttttccattatcttaatttaaaaaaccttttcattccccatcctaaattctcttaataacaaacctttttat

SEQ ID NO: 53336 - DNA, 217 bp, Zea mays
  Clone ID: LIB3068-025-Q1-K1-E10
acaaatatcattttccaatgctaatttttttatcatgaatcttacttcttcaatcatggttgtgttatctccatggctactactctatcatttccttatcaataccattctatctatcttaaatctatttacctaaaattttcttcttaaaactcttttctttattatcctctcctaatatttcactatttcaaatacaactttacattctttctac

SEQ ID NO: 53337 - DNA, 441 bp, Zea mays
  Clone ID: LIB3068-025-Q1-K1-E11
cccacgcgtgcgcagacacatgagagcaaatgcgaggacaggtcaccggtgtaaagaacaggggagaagagccctcgacatacgactaccacgatttacgaggcggctggaaaccatgcactatattgccgagtatgagcatgaagaggcacacgacggcctgctgcttgagctcgctaggctcaactttgtccttgtgagagcgcttcacctcatggagctgaaggacctgtcactatggtggagggagctctacaacactgtgaagctcccgtacgctcgggaccgtatggtggagatctacttttggacctgtggtatgcttcatgaggaggagtactccctggcacggatgttcttcgccaagacgttcgagatggtgtcactgatggacgacactttcgatgtccatgctactctagacgagtgtcacaagctcaa

SEQ ID NO: 53338 - DNA, 206 bp, Zea mays
  Clone ID: LIB3068-029-Q1-K1-E11
cttctggctaaaggagcagccgtctcttgttggaaggtcacatcatgtgtctcttaagacgcggtacaaagatcagtaccacgagccgtctaccaaaaggaggaagctcccattcaaaaagtgcatctgcacaccaacaatgcttgatctatttacttcgcatcatgactccctgcattttagctaccgacaaccctattggccta

SEQ ID NO: 53339 - DNA, 358 bp, Zea mays
  Clone ID: LIB3068-029-Q1-K1-E3
tcggcgtctctgtgtcaagcctcatgctctcttccctcaatccgccgctctgcatcctcacgtcgctgattctcggcgacacccgctctgtgttagctcccggagcagggccgcgggcacctggaggtgtggagggcggtggcttggggtctagggggttggaggctctgcgctcgccttccttctgcgacgacgaagcaggctgcgcctcctcaacgccatccagcgagaaggatggtatatgaatgcatacaacctaagcgatgagattcggtgacctcccttcgtgggtagtcgaactttctgcacttattcgcgaagctatcttgcgtgtgcgacgccggtgtcggtcttggtg

SEQ ID NO: 53340 - DNA, 198 bp, Zea mays
  Clone ID: LIB3068-029-Q1-K1-E4
ctcgtattgaagtttgtcctgagcatgtcagctagtaaggacgtgcttgcccttgcgttactggaggtatacctatccagcattgatccagggaccacggtgactgtgaagtgacatggaaagccagtcttcatcagacgccggacggactacgacatctatctggccaacagtgtgtatgtggcatccttgcgccac

SEQ ID NO: 53341 - DNA, 204 bp, Zea mays
  Clone ID: LIB3068-029-Q1-K1-F10
tcgggagaaccgagagcagagagacatggctccctaccaccagcagcgggcgctgctcctggtccactcgtcttcctcctcctgcttcttgccccgtcccttgccggctcgtggggaaaggagggccacatcatggtctgcaagatcgcctagatagtcctgtcggataaggcagttgctgctgtgaaggcgtttctgccggag

SEQ ID NO: 53342 - DNA, 149 bp, Zea mays
  Clone ID: LIB3068-029-Q1-K1-F11
tcgagatattctgggccttgaggatcactttggtgacatggacttcaaaattgcagggacaagggaaggtattactgctattcagctggatataaaacctgctggaataccattggacataatatgtgaaagtttatagcctgcactta

SEQ ID NO: 53343 - DNA, 342 bp, Zea mays
  Clone ID: LIB3068-029-Q1-K1-F12
gtaaaaccatctccacaaccagtacagttggaagttagctgagatttttgcaactggagtggggcttggtggttatttggccatgatgactgtcattttcttctgggctgcatacaagactgacttcttcccgcggctgttccacgtcgaaagcctttagaagaccgtccaggatgactttcagaagctcgcatctgccgtgtaccttctagtcagcactatcatgcaggcccttatcttattgactcggtcgcgcatctggtcgtttgtggagcttactggggtcttgctggatttagctttcttggtggctcagctgatcgtcactctgatcgctgtata

SEQ ID NO: 53344 - DNA, 289 bp, Zea mays
  Clone ID: LIB3068-029-Q1-K1-F2
cccacgcgtccggtcaccactcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctgctacgcccgcggcacggggtccggcccctccgcgtcctgctgtagcggcgtcaggaacctcaagagcgccggca

SEQ ID NO: 53345 - DNA, 213 bp, Zea mays
  Clone ID: LIB3068-029-Q1-K1-F7
tgacccacgcgtccggccgccctagccgaacttcccacctgacaatgtcttccgcccggatcgggcctgcgaggccagtccttggagccaaaatgaggggcagtgccccgcttccgacccacggaataagtaaaataacgctcaaagtggtggtatttcacttgcgccacgaggctcccacttatactacacctctcaagtcatttcacaaag

SEQ ID NO: 53346 - DNA, 71 bp, Zea mays
  unsure at all n locations
  Clone ID: LIB3068-029-Q1-K1-F9
tcgaaaaaaaagaaaattaaaaaaaaaaatattaaanaaaaaaaaaaaaaaaaaaaaaaaaaagagggaat

SEQ ID NO: 53347 - DNA, 304 bp, Zea mays
  Clone ID: LIB3068-029-Q1-K1-G7
gcctgttgagctacttcgtgcaagccttcctcatacaaacgagcagcagcgccagcggcttcgggatttggctcagagatccatgccagtaacaggtttcaatccctcaggtgctagatgtgggcacatcacttcagaatctgttcctggatgatgtaactgaaggagacacacagtggcaaagagtcaatgcttttaaacattgatgagatggtcttcagcttataattgttgtatctgtagacatgcatgctccattataaggtgtgagcgagcttggagaatttccgattgctcatgaaag

SEQ ID NO: 53348 - DNA, 178 bp, Zea mays
  Clone ID: LIB3068-029-Q1-K1-G8
atggaggtgacaatgcatcagcctctccaaggccacaataccctatccagggcactgcacctacagtgcacatcctcaacacaagcaaccagcaaccatttgtcaatctatttgctccaggaaaccctggtctgacacaatccaagaattccatggtcgattcaaacgcattatccag

SEQ ID NO: 53349 - DNA, 143 bp, Zea mays
  Clone ID: LIB3068-029-Q1-K1-G9
cagctgtcgatccaattgtcacttgctctccctccaacaagctaattaaggccggtccgtgcttcttctagctcgtttcatgatccatgttctgtggagaagctccaccaccaccacctgttccaccacatgtaggactagga

SEQ ID NO: 53350 - DNA, 333 bp, Zea mays
  Clone ID: LIB3068-029-Q1-K1-H1
ctcgacccggagaagaggctgtaccccggcggctcctacttcgacccgctcggccgggcttccgaccctgagaagaaggagcggctgcagctggcggagatcaagcacgcgcggctcgccatggtcgccttcctcggcttcgccgtgcaggccgtcgccaccggcaaggggccgctcaacaactgggccacccacctgagcgacccgctccacaccaccatcttctacacgttcttgagggttctcttaagcccgccattgctccgtcccgttcattgaccggccggaacgtgttcttggattaatgtacttcgatctttatgagcctgggga

SEQ ID NO: 53351 - DNA, 319 bp, Zea mays
  Clone ID: LIB3068-029-Q1-K1-H10
cccacgcgtccggtggctctacatcgccccgacggggatgtacgggtgcgtgaactacctcaaggagaagtatgggaatccaacgatctacataacggagaacggaatggaccagcctggaaacttgacccgagaccagtacctgcgctacgccacgagggtgcggttctacaggagctacatcggccagctgaagaaggccatagaccatggagcgaaacgggctggctacttcgtctggtctcttctcgacaacttcgagtggctggcagggtacttgttcaagttcggcattgtatacgtggacttcaacacgctc

SEQ ID NO: 53352 - DNA, 77 bp, Zea mays
  Clone ID: LIB3068-029-Q1-K1-H11
gcgccacttgccagctagagccatccttaatatcttgcagttactgagagtgtgcgtgggagagaggatgggtggca

SEQ ID NO: 53353 - DNA, 317 bp, Zea mays
  Clone ID: LIB3068-029-Q1-K1-H12
cccacgcgtccgccttcgagaagctgtccaccatcagtactggaattaatatgttggaagaggatggagaagttgatgcatatgtatcccctcataaggagatagacccacacaatgcagcacccaagcgaaagaaagccaggttcatgataccaaagagtgctcaggtggacagtgaggtgcgccgcgagctgcaggagctcatggacgctagggaggcattcatgttctttatcctggggcactcgtacatgaatgcgaatagcgggtcgagttttattaaacgtattgtgataaaattcttgtacgagttcttg

SEQ ID NO: 53354 - DNA, 208 bp, Zea mays
  Clone ID: LIB3068-029-Q1-K1-H2
tcgcggacgcgttggcggacgcgtgggcggacgcgtggacttcggtccatgctgatcggccaagggtccgagatccgcctgcgtcaggtaacggtcctatcttgatctcgtagtggcacctgcgcctggatgtagggattcggtggaggatggcgtgaaggctgtggggctgatctacgcctttgtcgcgcgcggcatcgcggtgctg

SEQ ID NO: 53355 - DNA, 297 bp, Zea mays
  Clone ID: LIB3068-029-Q1-K1-E1
ctcggctctcgcatcgatgaagaacgtagcaaaatgcgatacctggtgtgaattgcggaatcgcgcgaaccatcgagtttttgaacgcaagttgcgcccgaagccttctggcggagggcacgtctgcctgggcgtcacgccaaaagacactcctaacaccttcccgcggggcgagggacgtggcgtctggccccccgcgccgcacggcgaggttgtccgaatcatgggcttactgcgaaccgcgccgggcgcagcacgtggtgggcgacatcaagttgttgttctcggtgcagcgtt

SEQ ID NO: 53356 - DNA, 296 bp, Zea mays
  Clone ID: LIB3068-029-Q1-K1-H3
cggacgcgtgtgatccgcacctctctccatcttcctgctcctccgcctccttcttgatccaggggagccagtgatcgccatgtcggactcggaggagcaccacttcgaatcgaatgccgacgccggagcgtccaagacctacccgtagcatgctggcaccgttctgaagaacggcttcatcgtcattaagaaccgtccctgcaaggttgttgatgttattacctttaagactggtgagcatggccatgccaaatgccactttgttgccatagacatattcaacgggaaaaagctcg

SEQ ID NO: 53357 - DNA, 298 bp, Zea mays
  Clone ID: LIB3068-029-Q1-K1-H4
cccacgcgtccgcccacgcgtccgcccacgcgtccggtcctccgcaaaaccctcctccatgcgccgcctgccgccgccgcggcggtcccctctcggatctcttccctcctccgcctcatcccctctgcatctttttctgaggtaagcggaggtggggaagaatggggcgcctcctcacccggaggcggcggcggcaggggtgggggtgggaactaatagagctccacctggtgtaccggcctcaccaaggaccatttcgacggatcctcgcccttcgtcagtcgtactgtcccttccg

SEQ ID NO: 53358 - DNA, 219 bp, Zea mays
  unsure at all n locations
  Clone ID: LIB3068-029-Q1-K1-H6
cccggtcgcccacgcgtcgcacgcgctcgcccgcgtncgccagcttccggtcctgccaaaacccttcggcagcggcgccggccgacgacgcggcggacccctctcggatctcttccctcctacgcctcatcccctctgcatctttatctgagagaagcggaggtggggaagaattgggcgccttctcacccggaggcggcagcggcaagggtgggggtg

SEQ ID NO: 53359 - DNA, 112 bp, Zea mays
  Clone ID: LIB3068-029-Q1-K1-H7
tgaaaaaaaaaaaaaaatataataaaaaaaataaaaaataaaaaaaaaaaaaaaaaaataaaaagagaaaagggaaaaattaatgaaataataaaaaaaaaaaagggcggcc

SEQ ID NO: 53360 - DNA, 295 bp, Zea mays
  Clone ID: LIB3068-029-Q1-K1-H8
cacgcgtccgcccacgctgccgcccacgcttccggtcctccgcaaaaccctcctccatgcggggcctgccgccgccgcggcggtcccctctcggatctcttccctcctccgcctcatcccctctgcatctttttctgaggtaagcggaggtggggaagaattgggcgccttctcaccctgaggctgcggcggcaggggtgggggtggagaaccaatgtatctttgactgtgattccggcctcaccaatgaccatttcgacggatcctcgccctccgtctatgcgtctgtcccttc

SEQ ID NO: 53361 - DNA, 431 bp, Zea mays
  Clone ID: LIB3068-030-Q1-K1-A1
ggaggaagaaaaaccggcctcacctcctgcggctccagaaccagaaccggaacaagtgcctgagccagaacccgagccagtgaaagaggaagcaccagaagctgaaccggatttgctgggtctgaacgaaccgaaccctgctgcaactgcgatagaagagcagaatgctttggcgctagctattgttccgatagatgatgctccgaaagctgctcccacttttggaaatggagtcactggctgggaactggcccttgtgacagcaccaagttcaaatgagaccgccgttgccccaagcaagaaactggccggtggtctggacttgctgacccttgacagcctgtacgacgaggcgaaccggagagcgagccagccagcaagctacaacccctgggaggcgacccccgacgcgcctgccccgatgatgacca

SEQ ID NO: 53362 - DNA, 190 bp, Zea mays
  Clone ID: LIB3068-028-Q1-K1-G8
aaaaaaaaaacattttttattttacaaaaaaaaaaacacaaaaagggaaaggttaaaattaaaaaatggacaatccaaaactacgcacctcacactggctacccctcttatagatccacgtttattacacttctatccattattaaactcttttataatttatccaaacttcaattcattgacctaactt

SEQ ID NO: 53363 - DNA, 289 bp, Zea mays
  unsure at all n locations
  Clone ID: LIB3068-028-Q1-K1-G9
atccccaaaaaagatttcttggttgtgctgctcttgcagttttgtagtanggtgtccattgtagcaatagcaggggtgaccgttgcttgggtttgttgacctgcgtagcacttaagattgtgtatctaaagctgtagggattcatgttcatgcgattatgcttggatataccgagtgacatcgtcgaacataaagatgacttgtacattcctcttgttcatcgagagtcatgtgacttttattaaaagaaacaaatacattgtgatatcaatcacgatatatgtttttt

SEQ ID NO: 53364 - DNA, 407 bp, Zea mays
  Clone ID: LIB3068-028-Q1-K1-H1
cacgcgtccgcgtccacaaacacaaagtttgtggctgaccgatattgctcatcatcatttggctgttgcatttatttttctgagtgccggtcatatgtatcgaactaacttcggaattgggcacagtatcaaagatcttttagaagcacatactcctccggggggtcgattaggacgtgggcataaaggcctttatgatacaatcaataattcgattcattttcaattaggccttgctctagcttccttaggggttattacttccttagtagctcaacatatgtactctttacctgcttatgcattcatagcacaagactttactactcaagctgctttatatactcatcaccaatacattgcagggttcatcatgacaagggcttttgctcatggagctatttttt

SEQ ID NO: 53365 - DNA, 336 bp, Zea mays
  unsure at all n locations
  Clone ID: LIB3068-028-Q1-K1-H11
cgacaccacgcgtcctgatccatctatccgaggagtattgtttagtgatactattgtcatgttttgggacatgatcaatcggggtatggagnccccaccagaattcaggccagcaatgtctcaaatcgtccaagacctagctaggattgtaggtgctagtagtgaggtatcagagtgacaaataaaggaggaacagtaaaacatctagcttgccagtggcgtggccagcgaagatccctagatccatagcgcagtgccaggggcactctatctatcagcatttatattggacgagattgcggctagtgtacatgccattttggagcctcatttact

SEQ ID NO: 53366 - DNA, 328 bp, Zea mays
  Clone ID: LIB3068-028-Q1-K1-H3
ggaaacccgcggcgacccacgcgtccgctaagcccatggtagtggagaccttttctgaatatcctcctcttggtcgctttgctgtccgtgacatgaggcaaacggtggctgtcggagtcatcaagagtgtggagaagaaggatccaactggagccaaggtgaccaaggctgccgcaaagaagaaatgatgtgtctggctggttctgtgtttgcttgagggaaacctagtggaaacataaaatatctcgtcttgttcacgtcattgtctgaactatgctcgcaacgtttgcctggtcgatttagaatggttattttcgttaaaaaaaaa

SEQ ID NO: 53367 - DNA, 379 bp, Zea mays
  unsure at all n locations
  Clone ID: LIB3068-028-Q1-K1-H5
cggacgcgtgggcgccgccccgctgtctccgccggtccgcccccgtccctcccctggcccggatcgcgtcgtcccgtgtcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagntgcccttggagctggtgtggggataggggctgcatacactgaatgctcatacttat

SEQ ID NO: 53368 - DNA, 350 bp, Zea mays
  Clone ID: LIB3068-028-Q1-K1-H8
gtgagtctgagctgaagaggaggaggaggaggaggagaagcagcagctcacccgggggagggagagcgaagatgcgccgcgtcacgctgttgctcgtcgccgccgtgtgcgcgctggcggcgccggctgccgcggtcgtcactgacggtcttctcccgaacggcaacttcgaggatggcccgtccaagtcggcgctggtgaacggcacggtggtgtcgggcgcccacgccatcccgcggtgggagacgtccggcttcgtggagtacatcgagtcggggcacaagcagggggacatgctgctggtgcgtgccgcaggcgcgcacaccgtgcgggtgggcaactaggcgtat

SEQ ID NO: 53369 - DNA, 269 bp, Zea mays
  Clone ID: LIB3068-029-Q1-K1-A3
gattcttatgcttcttctacctcccggcctcctcccccttcttctttgcctgcctggttagtagctcacctcacaccacacagctggcagacagccagacacgcgctgctttctgatctctccccggatcggaggctcctcccaacataccaccctgccagccgcgccgtcacgtccacgccggccgggcaccaagcaagcatggatatggtttcgcagtccgagcacctaagctacgtgcgctggacctactgcaacaccgtgctcgc

SEQ ID NO: 53370 - DNA, 303 bp, Zea mays
  Clone ID: LIB3068-029-Q1-K1-A6
tccacgcgttcgcaagccaccctcacgccacgaaacccgcaatcccagccgaagccggacgatgaagagggagggatggcagcacggcgccgtccgggccagccgcagcaaggtgcttaggacggccgtcggcgacgacaacttcgacgccgacgcggtcgtggcggctggggcagcggcggctgctaggaatccgacgaacgcgttccggagcacgggcaagggccggctggcccgatgggcgggctggcacgcgcacccggtcttcaaggcgcgcgacaaggtcaagggcgcgcgcaagct

SEQ ID NO: 53371 - DNA, 270 bp, Zea mays
  Clone ID: LIB3068-029-Q1-K1-B1
gttcggtttcgtgggtgagcggatcgagatggcagcgtcggatgttgagtaccgcggcttcggcggctgcctcgcctgggccacggacgaccactccctccacaacgccttcagcacctactgcgaggtcctcgagtccaagatcatcctcgatcgggagacgcagaggtcccgcagcttcggcttcgtcaccttcttcacggaggatgcatttgtgaacgtcatctatggtatgaactgcaatggatctggactgtcgcaacatcaccg

SEQ ID NO: 53372 - DNA, 346 bp, Zea mays
  Clone ID: LIB3068-029-Q1-K1-B11
cccacgcgtccgcccacgcgtccggttggcttctcctccccctccggttcgggttcgggttcgtgaggttctccggggttcggtttcgtgggtgagcggatcgagatggcggcgtcggatgttgagtaccgctgcttcgtcggcggcctctcctgggccacggacgaccactttcttcacaacgccttcagcacctacggcgaggtccttgatttcaagatcattctttatcgttagacgcataggtcccgcggcttcggcttcttcaccttctgcacggaggtagcgatgcggaacgccatcgaaggcatgaacggcaaggagctggactgtctgaacatcaccg

SEQ ID NO: 53373 - DNA, 61 bp, Zea mays
  Clone ID: LIB3068-029-Q1-K1-B2
aaaaaaaaaaaaaaaaaaaaaaaaaaaaaaaagggaaaaaggaaaaaaaaaagatagaaaa

SEQ ID NO: 53374 - DNA, 54 bp, Zea mays
  Clone ID: LIB3068-029-Q1-K1-B3
aaaaaaaaataaaataataaaaaaaaaaaaaataaaaaaaaaaaaaaaaaaaac

SEQ ID NO: 53375 - DNA, 209 bp, Zea mays
  Clone ID: LIB3068-029-Q1-K1-B9
aaaaaaaaaaataaaaaaaaaaataaatttaaaaaaaaaaaaaaaaaaaaaaaaaaaaagggaggataaaaaaaaaaaaaaaaaaggtctaccaatttaacaattcacaactttcttccgctttcattcaacataatatccttttttatagccgtaattattttaaattcattttccttaatttatcaacttcatcattttaaaaaccc

SEQ ID NO: 53376 - DNA, 323 bp, Zea mays
  Clone ID: LIB3068-029-Q1-K1-C11
tcgaagaacttgagatagtactacgctttctttactatcagtgagtatcatgtttaaaagagaagttgtttatttgtatctcatcttctgagtcattcgtcgctgcaatcctcaacgacaacctcattccacttgcttcattgtcctgcatcatactttgttacagttctcttgtaataattggcttctgcttcatatgcagctagtaataatattttattctcttgtcatatccttatgaaactttattcttgtaataagtcggctttacctcttcggagtttcttatacataaactcattctatttctcttgagcacttaa

SEQ ID NO: 53377 - DNA, 151 bp, Zea mays
  Clone ID: LIB3068-029-Q1-K1-C5
gagcagagagagactttctcgcctacatcccatcccgccgccgccgtctctacggtcgctaatgagccggggcatccagggatggagatgaagaagatcgcctgcgccgttcttgtctccgcctcggccacctgggcgctggccgcggagg

SEQ ID NO: 53378 - DNA, 375 bp, Zea mays
  Clone ID: LIB3068-029-Q1-K1-C6
cttaattcatgagttgtatggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggttcatggacaactgtttggactgatggacttaccagtcttgatcgttacaaaggacgatgctatcacatcgagcccgttcctggggacccagatcaatatatctgttatgtagcttatccattagactctatttaaaaaggttctgttactaaca

SEQ ID NO: 53379 - DNA, 328 bp, Zea mays
  Clone ID: LIB3068-029-Q1-K1-D1
gtcaactggtgtgggcagaacttggtaagcaagcaggagcggccatgcctgacggagtgacggtggaaggcggaggcgcgcctttcgcatcgcaccctctgagctctgaccctgctccgcgaagtttttttttttccttcttttttgacaaaagcagccgcttcatcaagcatctagacggccggttcggtgcgggtcgcggaagtacagcccaggtggcctgccggcctgttgtttggtcaagctgagtgggcgcgcgcgtagccatgcctcactcaactgctgacctgtaacatcgaaatggtctgctctgcgtctcgtggtccgc

SEQ ID NO: 53380 - DNA, 187 bp, Zea mays
  Clone ID: LIB3068-029-Q1-K1-D2
cccacgcgtccgcccacgcgtccgaaaaaaataaaaaaaaaaaaaaaaaaaaaaaaagaaaaagagaaaaaatataaaaaaaaaaaaacagaccaaccaatctataacaatctcatcttcccatacgcttgcatcctacatcctatccattctatcgtcccccttaatttcacttcactgcccttta

SEQ ID NO: 53381 - DNA, 206 bp, Zea mays
  Clone ID: LIB3068-029-Q1-K1-D4
tccgctcaggatcctgctgcgaatgtaaggctagatgtacaccgcgaggaagaagagccagagggataagggccttgagcccttcgagttcgaggactccgtcgcccatgctttcttcgacctggagaacggtaaccaggagctcaagagcgacctcaaggacctttacatcaactgtgctatccatcttgatgttgcctggagca

SEQ ID NO: 53382 - DNA, 110 bp, Zea mays
  Clone ID: LIB3068-029-Q1-K1-D6
attgtcggactccactgggctcgacctgtgcttcgcgctgccggccccgacgtctgctcctggggccatggtgcctatcatgacgctccacttcgacagcgccaacatgg

SEQ ID NO: 53383 - DNA, 371 bp, Zea mays
  Clone ID: LIB3068-029-Q1-K1-D9
atcaagcggttcttggtgaggaacattgttgagcaggctgctgtgagggacgtgcaggaggcttgtgtgcatgatggatatgttcttcccaaattgtacgcaaaggttcatcactgtgtctcatgcgcaatccatgcacacattgttcgtgtccgctctcgtgagaacaggatgaaccgtgagcccccgcagcgcttcaggcgccgggatgatggcccaaggccaggtcagggcccaccgcgcccaggtgctgctgccacagcagctcctcctgctgccgctcctcgtacctaagttcaggaatgcgattcatggcttagttctctcacctatgggataatggacttttcctgttttgaaaaccaatgtac

SEQ ID NO: 53384 - DNA, 362 bp, Zea mays
  unsure at all n locations
  Clone ID: LIB3068-028-Q1-K1-C8
ccgcccttttttttttttttttttttttttntttttnnnttttttttttggcagggggaagggtcatcttcttaccttgaaactgaggtacttcatttctattagataattgctgctaaaatatggttacattattaacgtctggctgtttcgtcacgcagctaccaacatatctatatcttctccgtgatctgcataacaaattagataatttgaatccttcaatcaagccttttcttagtacttctaaagcaaaatatactcctactcattgccataagagtacacaagattttcttgacaaaatccagccactattcttagttttaaggaagcatctggatggagcagtttcaatgatc

SEQ ID NO: 53385 - DNA, 128 bp, Zea mays
  Clone ID: LIB3068-028-Q1-K1-D1
gatacccgctcgcccacctcgtaaaaaaaacaaaacattcaatttaaaaaaaaaaaaaaaaaacgggaaaagtaaatttaaaaagggcgagccaaaccaacctaaactcaacaacccccccaacaaaa

SEQ ID NO: 53386 - DNA, 154 bp, Zea mays
  unsure at all n locations
  Clone ID: LIB3068-028-Q1-K1-D10
cctcnctgactacnacttcccnctccntatcctccccaatggcgtggtcgcctacacgctcgacaacgccacgggcgcctttacggtcacgctcgacgccttcgctttcggcagcgggtcctccgtctgcgagttcttcatccagggctcctac

SEQ ID NO: 53387 - DNA, 53 bp, Zea mays
  Clone ID: LIB3068-028-Q1-K1-D8
ctaagatgaaccatgtttgtgcaatagtggtgtgtttttgtttcctgctggtt

SEQ ID NO: 53388 - DNA, 277 bp, Zea mays
  Clone ID: LIB3068-028-Q1-K1-D9
cccactcgtccgcccacgcgtccgattaaaaatataaaaaaaaaaaaaaaaaaaacggaaaatgtaaaattttagaaaaaaaaaaaaccacaaacaaaaaaaaaaagggcgccccttttaaaaaatccgggcttactttcccattccttcaacatcataccttttttataggtcccctaaatttaattcactcccctaaattttacaacctccctactttaaaacccctttctttccccaacttaattccctttccccacattcccctttttccaac

SEQ ID NO: 53389 - DNA, 308 bp, Zea mays
  Clone ID: LIB3068-028-Q1-K1-E11
cgtactcttgggtcgaaattaaaatttataaaaaaaaaaaaaaaaaaaaagcaaatgttaaatttaaaaaaaaccaaacccaaacacaaaaaaaaaaaaaaaaaaaaaaaaacgccccctccccctaacaaaaaccagccttcccccctctaacattcctcaactttaccctcccttcataccaaccctaaattcattcttttgcccccccttatacaaattcttttccctatattccccatcttctccccttttaaaccctttgctacccctaccttttttcccctcctccctttaccccatttacc

SEQ ID NO: 53390 - DNA, 361 bp, Zea mays
  Clone ID: LIB3068-028-Q1-K1-E12
gtcaatcataagatctggatttgttgtcattccttctacctgtaaagatgcgagtgtttttgtttagccatgtgttttgcaatctgctcataacgaatggttttacattctaggatttctattgcttgcaggtaggttactggttgcacttgtttgtgaatacttggagtgaccacaactaagtcacacaatgaaactttaagtgtaacctggtgaccggtgaccattcataatatttcatttttacattttggatatcaatatccattaatatgtttccctattttgtttgtatatcagctgaacttctgatagaatgaactgaaagacttctctaacaaaagtggagcttgagggagca

SEQ ID NO: 53391 - DNA, 347 bp, Zea mays
  Clone ID: LIB3068-028-Q1-K1-E2
tgtccatctccctgctcctccgccttcttcttgatccagccaagccagggatcggcgtgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatata

SEQ ID NO: 53392 - DNA, 201 bp, Zea mays
  unsure at all n locations
  Clone ID: LIB3068-028-Q1-K1-E3
cggactcctgggtactaccataactttaatgggaggttcagtcgcgtgaacaatggcgccaatcaagctgtggccgcgtaaaggcatcaaggcggtangcttacatcaaactaggaaaccataagctacattcaaatgaacttaatgccaggattattcttaataagaacattgctttcaaacaacttgggtatttttttt

SEQ ID NO: 53393 - DNA, 312 bp, Zea mays
  Clone ID: LIB3068-028-Q1-K1-E6
acgaccacgcgtccgaaaaaaacgtaatcaacacaaacaaattaaaaatcaaaaaaaaaaacacaaacaaagggcattggtcaaaattaaaaaacagagccacacaccccaccatacaaaaacataacacccaaatcaacccacctaaacccaacccactagccaaaaattaaacaacgttcatacttggcaacccctttaaaaaaaccaaattacattacacccaacacaaccccacttcctcccctaaactcccactcaaacaaacaccccccggtcgccctataaaaaaattcctcaatcaaaaacccc

SEQ ID NO: 53394 - DNA, 298 bp, Zea mays
  unsure at all n locations
  Clone ID: LIB3068-028-Q1-K1-E9
cccacgccgtccggcgaacaaccaaccaactccgatgtcctcgatccaacaaactgcgagcgaagcggacggacgactggggacgagacgaaggcacggaacggagggaggggagggaccgagggagccagtgagcgagccagactacccacctactaggtccagcggcaatgaggggcagcgagatgttgaccgcctcggggggcaccggcacggccccgtccacggcctcctcgtcgtcggcagcggcggcggacctggttgccggagccgggggcttgggcgccatcngcgtggg

SEQ ID NO: 53395 - DNA, 204 bp, Zea mays
  Clone ID: LIB3068-028-Q1-K1-F10
cccacgcgtccgcccacgcgtccggtcttcatgctgctcatgtggtgctggtccgagaccttcgtcgtcagcttctactacctccgcggccacctccaccagacctggtccgtgccccgctacggcttccagtacttcctgccggcggcgaagaagggcatcaaccagcagatcgagctggccatcctgcgggccgacaggatg

SEQ ID NO: 53396 - DNA, 338 bp, Zea mays
  Clone ID: LIB3068-028-Q1-K1-F11
ttgactttcacagacccactatgactgcctacgcccatatagatagagaggggttggcctaaggataataaaacgtttgaggaaggttaccgcttacgatatacctatatatagatagtgtagtgttgtagtgtgttaagtagatcggtcccatataaagttgcaatgtatctgcaatgagttcatctactccggggtgttctccgcacttctcaagaaagaaatagttggaaattccccggatcgtctgcgcttggcttggtattcttatactgaatcgctgttggataaaagaaagcataaagtttttaagcctgcgttctcgttggcgaaaccac

SEQ ID NO: 53397 - DNA, 280 bp, Zea mays
  Clone ID: LIB3068-028-Q1-K1-C7
aggtggtgctgatcggcgactgggcggttggcaagtcgcagatcctcgcgcgcttcgcccgcaacgagttcaacctcgactccaaagccaccatcggcgtcgagttccagacccgcaccctcgtcatcgaccacaggagcgtcaaggcccagatctgggacaccgccggccaagagaggtacagagctgtgacaagtgcttattacagaggtgcactgggagctttgcttgtctatgacattaccagacgccagagcttcgatcatataccccgctggct

SEQ ID NO: 53398 - DNA, 85 bp, Zea mays
  Clone ID: LIB3068-028-Q1-K1-F2
cccacgcgtccgcccacgcgtccgcttacgcgtccgcccacgcgtccgccgacgcgtgcgcggacgcgtgggttctagatcgcga

SEQ ID NO: 53399 - DNA, 435 bp, Zea mays
  unsure at all n locations
  Clone ID: LIB3068-028-Q1-K1-F3
cgcacgcgtccgcccacgcgtccgctgtaaaaggattggctctgagggttgggctggggggttccggccccgaacccgtcngctgctggcggaatgctcgagctgctcgcgcggcgagagcgggccgccgcgtgccggccgggggacggaccgggaacggccccctcgggggccttccccgggcgtcgaacaaccgactcagaactggtacggacaaggaagaaaatgatcctgagaaaatgctttcacgtggaacagaaattactctttatttgagagatgatgacaaatatgagtttgctgaccctaccaagattcaaggcttagttaagaactactcgcagtttgtctcattccccatatatacatggcaggaaaaatcaagaacacatgaggttgaagaggaggaaagatcaaaaaggtgaagagctactt

SEQ ID NO: 53400 - DNA, 307 bp, Zea mays
  Clone ID: LIB3068-028-Q1-K1-F6
ccatcaccctgcttcaagattaagctcagagagttcattcactggacatgtaacttttatgcagaggctgcggctacagtcaggccttaacaaaggccagcgtcctagtactgatgattcatcaagctgcattatagacgaaccacgaagtcagcacaaagcagaaaaagcagagattgaagaagatgcgagtacaaacctcgctggaagtgctgatgatctacctggtaatatccatgatgatgagcaaaagaacatccctgaacatggtgctgaaatgacttctccagaagccaaatctgttctg

SEQ ID NO: 53401 - DNA, 156 bp, Zea mays
  Clone ID: LIB3068-028-Q1-K1-F8
tcaacaaccctcgccaccgactaatggttctactgatggaactggatatacgaaactttatgcagaaccctcagctgcacgagttccaattccacaactttccgacttcttacctacgctgagcttctcatcgtgctgcacaacattatggcttac

SEQ ID NO: 53402 - DNA, 118 bp, Zea mays
  Clone ID: LIB3068-028-Q1-K1-G1
cggacgcgtgggcggacgcgtgggctgacgcgtgggcggacgcgtgggagaaaaagtgaaatttaaaaaaggaaaaaaaaaaaaaaaaaaaaaaaagataaaactaaaaaaaggggcg

SEQ ID NO: 53403 - DNA, 318 bp, Zea mays
  unsure at all n locations
  Clone ID: LIB3068-028-Q1-K1-G12
cggaataccggggcggccacgcgtccggctaggtagccagccagaaggacgttttccgtatgatgggaggaagaacantggcccggccggtcgtacttgcgctggtgaccatcatcgccatcgcggcggccgagggggaccaggtgaagtgtggcgggtgctctccgtgcggcggcgccgactgcccggtgctgtacccgttgccgtcctcgccaacgtactactactacagccctaccccacccgcgacctaccccggggagtcctcgttatactaccagtcgccgccggcgggcgcgtacatccagatcgggagcg

SEQ ID NO: 53404 - DNA, 410 bp, Zea mays
  Clone ID: LIB3068-027-Q1-K1-G7
ggtcctgttcatggctggcgccgcgctgctcgccggggctgccggcgccggcgcgcagcggggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgc

SEQ ID NO: 53405 - DNA, 220 bp, Zea mays
  Clone ID: LIB3068-027-Q1-K1-H12
gccgcgcatgcctttagcgacggctctgtcgttggctggctccaagctactcgccggggctagtcgcgtcatcgcgcaacacggcgcgtagagcatcatcacccggcccatgttccagaacatgctgaaccacaatgtctacagccggtgccagggcgccttctacacctacttcgactccatcgaagcctccatcaagttcctcagcttcagcaccacc

SEQ ID NO: 53406 - DNA, 235 bp, Zea mays
  Clone ID: LIB3068-027-Q1-K1-H3
cccacgcgtccgggggcgaagccagaggtaactctgttggaggctcgaatcgatacttacgtgggaatcggtcgtctgacttgggtatagggactaaagactaatcgatccatatagtagctgtcaccctaataaggtttacttaggatagctggagcctacacgagtactatcgggtataagccaatgattagaggtatttggggcgcatcgccctcgacctattctcaaactg

SEQ ID NO: 53407 - DNA, 419 bp, Zea mays
  Clone ID: LIB3068-027-Q1-K1-H5
gcaaagagggccgtctcatccgagttaaggaagccatggagcacaaggaggctgggtgccgggcccccgagggacccatcctctgcatcaataactgtggcttcttcggcagcgcggcgaccatgaacatgtgctctaagtgccacaagagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaagaagagggttgggctcacgggattcaact

SEQ ID NO: 53408 - DNA, 431 bp, Zea mays
  Clone ID: LIB3068-027-Q1-K1-H6
cgtctggctgcagagcactagagccctgctgcctacccttgccgccttgcgtattgtgtgtacacttcacaatatggcaagagctcttgcctacggtggagcagctgccgcagctggcttcgtctcgccgtggcttgccgtgctcggtgcggccatgctctccgtctgggccatcacgctcgccatcctcctctgtggcgacagctcagacaacccgagaccaagatacaatcctgccgttagtgcggctatagcagctggtggcggagggggctgtggtggcgggggcggtggtggtggagggggctgtggtggcggaggcggtggtggagggggctgtggcggcggcggcggcggcggatgctagagttcatcgcatgcatccgatgcaccagcggcatcagttgtgctggtctgcagaagctaagatg

SEQ ID NO: 53409 - DNA, 187 bp, Zea mays
  Clone ID: LIB3068-027-Q1-K1-H9
ggcttgcggtggatacctaggcacccagagacgaggaagggcgtagcaagcgacgaaatgcttcggtgagttgaaaataagcatagatccggagattcccaaataggtcaaccttttgaactgcctgctgaatccatgagcaggcaagagacaacctggcgaactgaaacatcttagtagccagagg

SEQ ID NO: 53410 - DNA, 330 bp, Zea mays
  unsure at all n locations
  Clone ID: LIB3068-028-Q1-K1-A1
ccacgcgttcgctgacgcgtgggaaatgattcattngacccagtcggcaaagagggccgcggtagataggtgacccaataaggcaataatgaacccatggtcggagtagtggtgtcattacatgaacataagttactatttaattagcatggagaatagaaggtggcgatcatttccttagctcctgttagtgtccctgaacataagttacccatggtctgagatgttacatctttctgagctatcttctctcggtttgtacttctgttagtgtccctggcaccatatcattcatttggagatattcaatcagctgtgtggctatgtaaa

SEQ ID NO: 53411 - DNA, 171 bp, Zea mays
  Clone ID: LIB3068-028-Q1-K1-A10
accacccggccgcggcgctgcagatcgggcacttcaccgtggagcctgaggaggccgccgacctctcctacatgaccaagtacgcctacaacagctacatgaacatgatggacctcgcgcccggctacttcgaccgagtcttctacgactacgaccacttcaactgatcca

SEQ ID NO: 53412 - DNA, 441 bp, Zea mays
  Clone ID: LIB3068-028-Q1-K1-A11
gaagctgcaccacgaaccttgattatggttttttcgcgggcggctactgcgcgggataacggtgaaggactactggatcgtccgcaactcgcggggcccgaagtggggcgaggctggttacatccgtatggagaggaacgtcaacgccagcactgggaagtgcgggatcgcgatgatggcgtcctacccgacgaagaagggcgcgaaccctcccaggccgtctccaaccccgccaacaccgccggctgcccctgacaatgtctgcgacgagaacttctcgtgctccgcgggcagcacctgctgctgcgcgtttggcttcaggaacgtctgcttggtctggggcttgttgccttttcagggcgccaccttgctgtaagattaccccaacttgttgtccccgggctattcttttttttaaattcataaattttaatttttttt

SEQ ID NO: 53413 - DNA, 335 bp, Zea mays
  unsure at all n locations
  Clone ID: LIB3068-028-Q1-K1-A2
nccacgcgtncgtccacgcgtncgnctacgcgtncgcccacgcgtncgccgcaacgacggcgccatcttcaacaccggcaccgggatggtcttggacgccaggccatctgcgggggctaatgctactgctagccaagtcatcgtgtcgcccgccactgggagtcccacccagcagtggacgctcatgctgtgatctcatctacggctcatgagtcatgactgtgggggcagggcagtactgcactgcaacagctagctggtgtgttttgtgtatatatctggcgagctaggttgttaaagcaagcattagctattttaccagtacaataatgcat

SEQ ID NO: 53414 - DNA, 216 bp, Zea mays
  Clone ID: LIB3068-028-Q1-K1-A3
cacgcgtctcggaaaaattattttattaaaaaaaatttaaaaaaaaaaaaaaaaaaagggcgggcgcgtcttttagaaacagggttgggggcccctccattcaacggggtagcctttttatagggtccacttaaatgaactcatttgtccgacgtttaaaacgtatattactgggaaaaaccttgatttaactgacttaatttttttaacgtccaa

SEQ ID NO: 53415 - DNA, 356 bp, Zea mays
  Clone ID: LIB3068-028-Q1-K1-A7
tgcacttgtctgggacatcgatcgcgttgtcgtggagacgcagctcatcgcgcacgagaaggccgtgcacgacatcgcctggggggaggccggggtcttcgcctccgtatcggccgacggctccgtccgcgtcttcgaccttcgggacaaggagcactccaccatcgtctacgagagcccccgccccgacacgccgctactaaggctggcgtggaaccgctctgacctccgctatatggccgcgctgctcatggacagcagcgccgtcgtcgtgctcgacatacgtgcgcccggggtgccggtggccgagctgcaccggcaccgggcgtgcgccaacgcagtcgcgtgggcgccgc

SEQ ID NO: 53416 - DNA, 299 bp, Zea mays
  unsure at all n locations
  Clone ID: LIB3068-028-Q1-K1-A8
gggcaccctatggtacatgattcgcgttgtcaagaacacncacttcatcgggcaccgttacattacacgcggcataccctcnctccaanccncattaatagtctccatatcaaccaaccaattcgaccccatgttacacacttctgcacaaaaaacaatacaacatctcctactagagctcccttccctacacgcaaatactaaggctacattaaaacccttctgaccttcactatattgcctcaactatgatcgacaccatcgcctgcgtcattcacaacatacattctccctgggtg

SEQ ID NO: 53417 - DNA, 372 bp, Zea mays
  unsure at all n locations
  Clone ID: LIB3068-028-Q1-K1-B9
cgcacgcgtccgcccacgcgtccggctccaggtggtacaggttcaagggggctcaggactgatgcgccgaggtgaccgtcgtctcacgatcacnacgagtgcgggcatgaatgggactcagctctatgcggtcctgatgacagtttgcttggtggcttgggtaattatgttatggccttggcagagcaacaggaaaaaaaagggccttaaaataaggtcatgataattattttgtatctaccatagtagttgtttgatatcgacgcctctctctctctctctctctggtattactttatatgtttgttactgtcctttcatttgaatctataggatggtcaaagtggctgatgaaagaggagaaagaaacaa

SEQ ID NO: 53418 - DNA, 358 bp, Zea mays
  unsure at all n locations
  Clone ID: LIB3068-028-Q1-K1-C1
tctagatcgcgatctagaactacacggtcgcatggcgtgccagtgggatgcagtcagcgaacggcgcgcgggcgtgaggcantcntgtgctgtgcgcgagaatgggaggggttgcaggaagccgggacgggagccatacgctggggcgcttgagccggattgctccagcttggacgcctcctctggatagctgatggactcgcttccctaactcaagagttgccatgtgtcttcaagccgccctgatgagagaacccacaaggagatccaggccaagaatgacaacgtcnggacggacatggggctaaccttctagagcattgagaccatatgcagagaggtccagatcaagaacgac

SEQ ID NO: 53419 - DNA, 179 bp, Zea mays
  Clone ID: LIB3068-028-Q1-K1-C10
ccacgcgtccttccactcgtccgcccacgcttccgttttaaaaaaaaaaaaaaaaaaaaaaagaaaatgtttaatttattaaataacaaaacacaaatacacaaactcctaaaacccacaccactctaatatttccatcctcccgcatcccacataacaaccccattttttttcctttt

SEQ ID NO: 53420 - DNA, 329 bp, Zea mays
  unsure at all n locations
  Clone ID: LIB3068-028-Q1-K1-C3
cggttcggatacccggcgcgcccacgcgtccggttcgtcgtgcggcaactgcgcgaccgccgacgcccgacggcaggtgcaccaggtgttcgtcgaccccttcgcgaggcctcngttccatccttcgccggaggcgaccgcccgtcaacaggacttgatctactactcactagcggtgtagaggcgaagagaagaacttgaccatgagcagcataggcacaggttacgatttgtctgtcacgactttctccccagatggtcgtgtcttccaggtcgagtatgccaccaaggccgtcgacaacagcgggactgttgttgggatcaagtgc

SEQ ID NO: 53421 - DNA, 349 bp, Zea mays
  Clone ID: LIB3068-027-Q1-K1-G5
acgcggactcgtgggcggactcgtgggcggactcttgggaaaaaaaaaaaaaaaaaaaaaaaagggaaaataaaaaaaaaaaaaaaaaaaaaaaataaaaaaaaaaaaaataaaaaaaaaataaataaaaaaaaataaaatattaaataaaataaaataaatttattttaataagttcaatttttacaacaatctttaatgaaaaaactttatcattaacctaatttaatataatttaaattaaattcccctttttcaaaattgattaatatggaaaaatcctgttataacctacttttataaaatttgcgtaaacttaattttaaaatattatactctttttaaaaat

SEQ ID NO: 53422 - DNA, 119 bp, Zea mays
  unsure at all n locations
  Clone ID: LIB3068-028-Q1-K1-C4
acgctcactctttattgcactcgtgcgctttatatataangacaaggggctagttatttgtcatgagtagttgctaggtgttgtagacccatacatctatagactggtgagtaagggac

SEQ ID NO: 53423 - DNA, 171 bp, Zea mays
  Clone ID: LIB3068-028-Q1-K1-C5
ttttatattggagtggccagctcaccagacagtttgaatccctggcactcttctacttgagctgcttgattggagagatgtacattgccacacaggaaaaactggcatttctgtaagcccagttaatttttgctcggccaaaaaaaattaatgcgatgtttggtttctatg

SEQ ID NO: 53424 - DNA, 360 bp, Zea mays
  unsure at all n locations
  Clone ID: LIB3068-028-Q1-K1-C6
ctagatgtaactgctaagatcaatcaagctctagtnngattctcatatattcatggatgggctaatattaatatggtcgagccaattcacgattcctcatatcttattcactttggcttgaccaatcctcttaatcacttcaatctctattatgatcatatttatgcatagtgatttctcaggacttgtccatatattcaaaccaatatagagaccatattatatccatttgcattgtctcactggttatttgaccttgtgttgagccttgttcactgatcattatacactattcaagtatgttcatcatactgaatttcctgttcaacacttagcaaacttgttagacctttaaatgtg

SEQ ID NO: 53425 - DNA, 432 bp, Zea mays
  Clone ID: LIB3068-027-Q1-K1-E3
cactgccacacggagctagctagctgcaccgatcctctcgctcgcccgttaggtagctgacagtatctagccagccagcgaggagccgccgttgcttcctagctgcacctccgcgcgcggtctgcaggccagtcggtctcgatccacggccggccgaagaagaagacgccgacgatgaaggtgtcggtgctggcgctgtggtcggcggcggcggcgctgctgctggtgctggtggcgcatgcgccgtcggcggcggagggctcccaccacggcggcgcgggcctcaagctggggtactacaagaagacctgcccgggcgtcgagaacgtggtcaagtaccacgtcgccaaggccatcaaggccaaccgcggcgccggcgccgcgctcgtccgcctcatcttccacgactgcttcgtcagggggtgcgacgcg

SEQ ID NO: 53426 - DNA, 433 bp, Zea mays
  Clone ID: LIB3068-027-Q1-K1-E5
gtcttacgcctccaaaaccctagcccgtgctcggccggcgacgaggatgcctggtatgccgacggacggtggcggcgcaatggtaccttttacaggggagcctggccaaggggcgcccccgccggcacccgtgcggccaatccgccacggcgtggcgccgcccatcttccgcatctacgtctcctggtccagcggcaaccttctgcaggtcgcgtgcctccgcccgccgaattcggacggtggcggcggcacggaggaggtcgttgggagtgtggtggaggtgaatctcggcgacggtggcagcggtggctcggaggccgaggagaaaattgacgaggcggagatgcggaagatcgagtacgggtcagtgccggccttcgcgctgctgcagagcaggaagaacaccctcgcagatgttgctactatgtcgcac

SEQ ID NO: 53427 - DNA, 393 bp, Zea mays
  Clone ID: LIB3068-027-Q1-K1-E6
cttgagctctcccctcagctcatctccctccctatatataggaggctctgccggctgcaaggttcccaagcgcccaaggcagcggagagctagctccctcctcctcctcaggtagcgagcgagcgagcgagctcctctgcccctctgcacctggcctcccttctccgctgcagcaccgtcgttttctccgttgacgactgctcgaccagtgcgcgcgctcgcgctgcctataccttacctagccagagcgcggcgcgcgagagggagaacgaccaagaggggaggagatcgatcgatcgatcgatcgagatggccttcctcaacatggagcagcagacctgggccttcaccttcggtatcctaggtaacataatctcgctgatggtgttcctt

SEQ ID NO: 53428 - DNA, 369 bp, Zea mays
  Clone ID: LIB3068-027-Q1-K1-E7
aaacaattccagttccattacaatcccgttccacgcgatgccaaaacaacgtttgcgggaggcttgacagcggacatgggagacctcgccgcctcgctcacgccttacccgcacagcgcgccgctctacctgctctacgacgccaccagtatcgccaacgccagccgcggcctagcgccgccgccgtcgctcctgggcgactacggctgcggcttcgagttcgccactactccgacgcttattaacggctgcggcacggcgctgcgcgcgtgcgccagcgacgtgtctgcggcggtcttcgcgggcgagctgttcccgctgagcctgccgccgctgctgcatcggctgcccgttcgctcggctggagcc

SEQ ID NO: 53429 - DNA, 434 bp, Zea mays
  Clone ID: LIB3068-027-Q1-K1-E9
actatattaatttttctaacagatatggccaccttcaagcattaaagatacaggttcgcgccttcacactgaactgaaagaagcgatagtccaggttagatccttaaaatctgtttatgatttctcagtaaaccattgattttgtccatgtatatgttatttgtcacaatatttacgtcactttatgtccaagtgataatatctgcaagttaatagtccctccattccaaattgtaagtcattttgacatttgtagcacccagatatatgtatttttgggtaacatagtaaaaaactatgtatctagattgaaaagctagaacaacttgcaatatagaacagatggaggactaactcggtcaattgtgtacattatgtaagtactgcaatgtaattaatctcttctatgctattacggatacatgtcatacatt

SEQ ID NO: 53430 - DNA, 439 bp, Zea mays
  unsure at all n locations
  Clone ID: LIB3068-027-Q1-K1-F11
aagtttaatgacctacgtcagtttctgcgtactaaaaactattcgctagttgagtcgttgcggcatattcaaaattattagctacagttgttcctgcatgcgccagattctcatgtgagatgataaaaacgtcataattatttgctaagtttaatgacctacgtcagtttctgcgtactaaaaactattcgctagttgagtcgttccggcatattcaaaattattagctacagttgttcctgcatgcgtctaatgtccttcggtgaacttgtctgtcattatcatttaaaaacgtatctagatgcattatggaagatttttagtttcctttgttatatttgagaagttatatattgtatataccgagagatgcacctgtgtattatttgttgtagcttcgaatgcgagacgtatggttgcagtcattntattgtagtta

SEQ ID NO: 53431 - DNA, 166 bp, Zea mays
  Clone ID: LIB3068-027-Q1-K1-F12
cccactcgtccgaaaaaaaaaaaaatatttaaaaaaaaaaaaaaaaaataaaaacaggagggacaaatccataaaaatataaatacacactaatatacaaaaaaactaatctaccatactctatattgcctattcttaacttgtcttggctcaccacagtcttctt

SEQ ID NO: 53432 - DNA, 308 bp, Zea mays
  Clone ID: LIB3068-027-Q1-K1-F2
ccacgcgttcgcccacgcgttcgccgactccttcgaatcggagcccgtgtccgtcgccggcggcttcgccattcgcctccggtgcccacgagctacgcttcctcctcttcgtacgctccgtctcatgacgtgaaagagtataaactgtcatgactgacaggcttctcacgaatctaatcttcatgtgctgaaccgtcgatcgcacggccatgctgcaagcctacccccatgccatcatcaatgcatacaaaactggaactgcccaagaagctataacatggtattagactgactaacaatgccatgac

SEQ ID NO: 53433 - DNA, 435 bp, Zea mays
  Clone ID: LIB3068-027-Q1-K1-F4
cggacgcgtgggcggacgcgtgggcgcggagatcgaagagaagctgaggcctagcgccggacccgccgccgcatcagccatcagccatggcgctggccgctcgcctcgtctcacgctcccgtcagctacattcggttcaagcagcttttgcgaatggaggtgtcactcaagttcgctcctttgccaaggatgcagctccagctgaccgtcctcctgttagtggggatgatctcctgaagggcatattctttgaggtaaagaagaagtttgagacagctcttggcgtccttaaaaaggaaaagatcactattgatccagacgacccagcggcagtttctcaatatgcccaagtcatgaagactgtaagggaaaaagcggatcttctttctgattctcaaaggattaaatataccattgagacctttaccaggggca

SEQ ID NO: 53434 - DNA, 327 bp, Zea mays
  Clone ID: LIB3068-027-Q1-K1-F7
acgagttctatcgggtaaagccaatgattatagggaagaagaagatactactaggaaccatgcttgtctcgtttactcttttttttttcgtgtccccattcttcttcgtagctttcacttttatttttttttttttgtttttctggtggacggattattccgttgggggacgacgaggtcgggatttaaatttgtttcctcgcttgcttgatcgtggagatccatctataatctatcatcgtcaatcataagccatgttttgtctgcaagaaaaaaaaataaaataaatacaaatattaaaaataacatttaatgctatttatttta

SEQ ID NO: 53435 - DNA, 371 bp, Zea mays
  Clone ID: LIB3068-027-Q1-K1-F8
cccactcgtccgaccactcgtccgtccactcgtccgcccacgcgtcccgaagagggggaggctgtatcaagggcatcccaagaagcagctcagaaggaagctgctcttgcaaggaggaggcaagagaaggccatggctcttggagctgaacctgagaaaggaccacgtgttactcgggttctcataagattcccaactggagagcgcacagagcggagattctacagttctgcaaccgtcgctttcctctatgactatgtcgattctctagactgcatgaaagcgcagaagtacaccctagtttcgaattttccacgcgttacatatggtccagaaaagcaatccctgacgcttgaagaagcaagcttgca

SEQ ID NO: 53436 - DNA, 444 bp, Zea mays
  Clone ID: LIB3068-027-Q1-K1-F9
ccggttccgcgtgcctttccccacctactctcgcggctctcgccagccagtctagggtgggggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaaaaaaaaaaaaaaaaaggcggccg

SEQ ID NO: 53437 - DNA, 431 bp, Zea mays
  Clone ID: LIB3068-027-Q1-K1-G1
cccacgcgtccgaaaaagagaagtgatgaacactatgcttcaagggagcccctccgaatgcggaggaagaagcccgaaccaattaagcaattgaatccaaaatttgaagagaactacatcaagggtcttgattatgatcctgatcgagaaagggcacaaatgaagaagctgcggaagcgtgtcaagagtgagatgaagggggcgaagcgtgagctgcaaaaggataattatttcctgtctgctgtgaaggagaaagagaggaggaagcgagatgaagagagagctgagatgtatggaaaagccatggcgttccttcaagaacaggaaagtgctttcaaatctggacagctggggaaaggaaagggtaggaaaaggatgcggtgatactctattgcaggggggcagctcggccagtgtaaatatacgggatt

SEQ ID NO: 53438 - DNA, 347 bp, Zea mays
  Clone ID: LIB3068-027-Q1-K1-G10
cccactcgtccgggacctcccaagacctggcatctccagtgaatgcgacgccggggaccgccggccgtgcgtcctctctcctcgtgcgcttcgcccgtctccacagttggtgcagaaacagtgcaacagtgtttacggggtgaactgctggagttggcgttagatagtcgatggtctactgccgccgtgctctctcactaccagtgtcccaccaccgtcatgcatgttttgcggcaattgccggctactatactccttcgtctccaatcatcaggcaccagcttgcgacgcaacttggattctctcctctcctctcctctcgttgcaacaaggcagtccaatgaatg

SEQ ID NO: 53439 - DNA, 433 bp, Zea mays
  Clone ID: LIB3068-027-Q1-K1-G2
cggacgcgtgggtctcactctccgctggtcgctcactcttgcagctccacccttcactcggggttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcatgcagccgccgaggcggaggccgcggctcctgctggtgccgaggagcccgtcgcggccgaaccggccgacgaggctgaggctgctgctcctgctggtcccgaggagactcctgcggtcga

SEQ ID NO: 53440 - DNA, 186 bp, Zea mays
  Clone ID: LIB3068-027-Q1-K1-G3
tcgttcacacatccatctcaatcagcacaagaaggttactcttcaagatacacacttgcatcacccgtggtatgtcattacctttagggtctacctattcccacttatcataagcataaccctcagacttatcatctacacccacacccacacacgatctacaaacacataccgtcaatactgacc

SEQ ID NO: 53441 - DNA, 359 bp, Zea mays
  unsure at all n locations
  Clone ID: LIB3068-027-Q1-K1-G4
cggacgcgtgggcggacgcgtgggcaatcctccttattgttccacacaaacagaaacacgcagggtctctgttctgttcatcctcacactgattgagttcttgtggtctctcaaccagcatctgatacccaattcctcgcacaaacctgccacacgcaatgtccaagaccgagagcaggaagctgtcggacgactatgaggttgcggaggtcctcggccgaggcggattctcgatcgtgaggcggngagtgagcaagtcagaggggaaggcggcccaacaggtcgccataaagaccctgcgaaagctgggcccggccaccacgaccggcgggagcacgccgtcgcagcaaggctcaaat

SEQ ID NO: 53442 - DNA, 403 bp, Zea mays
  unsure at all n locations
  Clone ID: LIB3068-027-Q1-K1-E2
caaatgtattggttagtgatgatgacagtagattcttgcttccctatgcatttgcagccacactatcggtagtgggcattctgtatatcagaaatgcatcaagtacatgtcagcatgcatctgccattgggagctaccaaaaatcatttcttgcccatgttctcagagacaaaagagtactgatcctggtcttagctcaagcaagcatccattttgctgtctcagccttttggtttctctgggcaccaaccatagtggctgacggaaggtatgctcaactgtcagtaatctacccctgtttcttggcatcaaggatgcttggaagtgctggttttccatggttttacggagccatagcccccttncggaacgaggacagcttgacaatagcttacgttggtgc

SEQ ID NO: 53443 - DNA, 422 bp, Zea mays
  unsure at all n locations
  Clone ID: LIB3068-027-Q1-K1-B8
cgcacgcaacaagtacgcaggcagcgcagcctcgagccgtcgccatggcgagcaagcaccgggtcctcgccgcatgcctgctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctgccaggcttcactccgncgggctcctacacgatctacatgaaagatgtccgggacgac

SEQ ID NO: 53444 - DNA, 437 bp, Zea mays
  Clone ID: LIB3068-027-Q1-K1-B9
atttcttttcgctgatgtcatctacatatgtcacttgttaaatgattttataatggaaatgtatggttgtgaatttgtcaatttatacttaggcccgtttgttttgttggaattgaattccattataataatcataatttagacaaactaattaagttaatatatttatatatttaatatattagtatattatcctgaatcatatgagagatatagttatacgctacacgtatgctatagagaagtaagtataagagtgtgctataagttgtatattagaaaagtagcatgtaaatttatagaaccaatttttatctctcaccctatgaatttgagatagacttatatataaactttgaaaagttatggaatgtcacattctaaaaaatagcctactccattagttagattccaattcttcgaaatgaagaaacaaa

SEQ ID NO: 53445 - DNA, 403 bp, Zea mays
  Clone ID: LIB3068-027-Q1-K1-C1
gcgacgccaagcggccaagacggagaggagaacaattggggacggggaaagtccagggggaagccacggccaccggcgcgatgaaaccgtcgctgtcgaagaagaagggcaagaagaagaagaagtcctcgctgccggccgccgcaccggcccctccgccggcggagggcgctgcggatacggaggcatgtcccccgctgcccggaaccataaccctagccgctgccaccgctgctgcggcggtggtttcggagacggagtccagcagcagcggcgaggcctcgacgtgtccatccgcctgcttcaccgcaagctcgtctgggaccgcgtcctcgcactccttctctgccttgtcctcgtcggcgtccacagcttcgtcgtcggccgccggcgaggagcggcg

SEQ ID NO: 53446 - DNA, 271 bp, Zea mays
  Clone ID: LIB3068-027-Q1-K1-C10
cggacgcgtgggaaaaaaaaaaaaaaaattaaaaaaaaaaaaaaaaaaaaaaaaaaagagaggtgtaaagctccatactagaataccgcgttacattctacgtgcttgctacttttatagcgcttccatacttcaatctaattgcactttagtgtcacctattttaaatggaataaccttggaattacacaacttaaccgcggttaaacccatttgcaacacatccaaattgcgtcatatcgcataggcctttagagatctggcttaataa

SEQ ID NO: 53447 - DNA, 441 bp, Zea mays
  unsure at all n locations
  Clone ID: LIB3068-027-Q1-K1-C12
ggcagccctgagcgggtgcagcagccacgcgtcgtccgcgtccatgctgccgacgccccgcagcgaggacgagatcctggagtcggccaacgtcagggccttcagcttcaacgagctgaggaccgccaccaggaacttcaggccggacagcgtgctgggcgagggcgggttcggttccgtcttcaagggctgggtcgacgagaagacgctcgccccggctaggcccggcacggggatggtcattgccgtcaagaagctcaaccaggatggataccagggccacaaggagtggctgactgaagtgaactaccttggaacgctgtcgcacccctaccttgtgaagctcgttggctactgcctcgaggacgaacagcgcctnctcgtctacgagttcatgccacgtgggagtctggagaaccatctgttcaggaggagctccta

SEQ ID NO: 53448 - DNA, 431 bp, Zea mays
  unsure at all n locations
  Clone ID: LIB3068-027-Q1-K1-C4
cccacgcgtccgatttgacaaaaaaggatggtggcttgttaaagatggaagcttcaaagggcggaaggaaaggggtaatgggtatcgatgccgaagtatttgaggttagccccaacttccatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatgtttttagccaatttccaatctttcgtgtatttgtgtagtttttactctnttattatccatttttgttttcccgtgtaataccaacaaaaacttgtgtagttgtgttattttctgaggacaaatttgtttcaaagatgtgttta

SEQ ID NO: 53449 - DNA, 268 bp, Zea mays
  Clone ID: LIB3068-027-Q1-K1-C6
gtcgatggtgatggaggagcctctttaatcgctgaagtcttcattgtgcgtgtgtagctgagattctttcatttctccatcctgagttctttacctctcttctatctatagttctattcataggcattcatgaaaattttaccgagagaaaagataggaagggaggtttaattctggccctatgggtgtggaagctttggtgatgttagttcgatatcttacaagttgtaaataacatgcaataatagcacgtaatttgtgaatattt

SEQ ID NO: 53450 - DNA, 160 bp, Zea mays
  Clone ID: LIB3068-027-Q1-K1-C9
cccactcgtccgataatacaaagatttctcttctctcgtaaactaagctagctacgggggtccatcataaacgagcaatgtctattgataccgaaatatctcatgttaatcacaattacccatattgtacctcatctagaatactaatatctacactctt

SEQ ID NO: 53451 - DNA, 439 bp, Zea mays
  unsure at all n locations
  Clone ID: LIB3068-027-Q1-K1-D1
tcggccgctgctccgggctgctgttctgcgcctccacaaggctttggcctctgtgttgtaagttgtaagcttcacctccagccatgggtaaagagaagtcccacatcaacattgtggttattggccatgtcgactctggcaagtcaaccaccactggccacctgatctacaagcttggaggcattgacaagcgtgtgattgagaggttcgagaaggaagccgctgaaatgaacaaacggtccttcaagtacgcctgggtgcttgacaagctcaaggctgagcgtgagagaggtatcaccattgatattgctctgtggaagtttgagaccaccaagtactactgcactgtcattgatgcccctggacatcgcgacttcatcaagaacatgatcatgggtacctnccaggctgactgtgctgtcctgatcattgactccac

SEQ ID NO: 53452 - DNA, 54 bp, Zea mays
  Clone ID: LIB3068-027-Q1-K1-D10
cagactcctgggaaaaaaacaaactttctttcaaatctaaaatcacaaacaaac

SEQ ID NO: 53453 - DNA, 284 bp, Zea mays
  Clone ID: LIB3068-027-Q1-K1-D11
cggactcgtggtctgacgcgtgggcggactcgtgggaaaaaaaaaaaaaaaaacatggagtgaaaaaaaaaaaaaaaaaataatacaacaaccattctaaaaatacccttctttcgtactcaaatctacaacatcttaaattttcctattgaacctcctatctttaatatcccgacctacgttctacaacatcttaactacaacttccctttccttcccccacatattcttctttcagttcatcctttttacgaacactgtattaaatacctataattccccaa

SEQ ID NO: 53454 - DNA, 316 bp, Zea mays
  Clone ID: LIB3068-027-Q1-K1-D2
tcggacgctgctccgggctgctgatctgcgcctccacaaggctttggcctctgtgttgaaaggggtaagctttaccttcagccgtgggtaatgagaagtcccacatgaacattgtggttattggccatgtcgactctggcaagtcaaccaccactggccacctgatctacaagcttggaggcattgacaagcgtgtgattgagaggttcgagaaggaagccgctgaaatgaacaaacggtccttcaagttctcctgggtgcttgacaagctcaaggctaagcgtgagagaggtatcaccattgatattgctctgtg

SEQ ID NO: 53455 - DNA, 427 bp, Zea mays
  Clone ID: LIB3068-027-Q1-K1-D7
cgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaagccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtc

SEQ ID NO: 53456 - DNA, 434 bp, Zea mays
  Clone ID: LIB3068-027-Q1-K1-D8
gcatcctcttcgaagttcgaatcgaatcgcgccgcgatcacccacctcatggcggacaaggagcctgtcgtggagcggccagaggcgggtgaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttttcaagcacaagcagaccggcaaggtccgcctagtcatgcgccaagctaaaacgcttaagatctgcgcgaaccacctcgtggccttcaacacgaagattcaggagcatgcgggcagcgacaagtcgtgtgtttggca

SEQ ID NO: 53457 - DNA, 435 bp, Zea mays
  Clone ID: LIB3068-027-Q1-K1-D9
gggacccggggcggaagaagagagagaagacgtctctctcctctcggcgtccccgtgccggaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgctttgacaatttctaaggtcctgctctccatctgct

SEQ ID NO: 53458 - DNA, 424 bp, Zea mays
  Clone ID: LIB3068-027-Q1-K1-E1
caaggaatggaggagggcaatgacgagggcccaggagaggcggccattgaagaaccagttggttctcttggctcaatgtcgcgtctgtcgcatctattcatgtataatccagaaatggaggatggcaatgacgaggactcaggagaggaggcggccattgaagaaccagttggttctcttggcgcaatggcgcctctattcatgtatgatcaagaaatggaggacaacgaggaggatcaggcacactagatgcagattgcaccagctgcagcgaagcctttgttttgtgttgctggggcggctctatttatgtaatgtggaatggagggattgcgcaagcttaaaagtatggctggatcggccttgttttttaactggttctctagttactgccatctaatagccaacatttttcccgcttttg

SEQ ID NO: 53459 - DNA, 441 bp, Zea mays
  Clone ID: LIB3068-027-Q1-K1-B11
cccacgcgtccgcccacgcgtccgcggacgcgtggggtttgatctgcccgtcgttttctggtcttttaattaaatccctgatgcacagtcatgtattgatctggtttggtgttcctagatgcgtgtaataaatggggaaaaaccatgtcgtaataaaatcaatttatttttaatgaaaataatacatagccggattacttctctaatcttacgatttctggtctatttcttattaaacgaataaggtctgaatcaaggtcagagccggagatgtgcatgggtgcatctcatatggcacatcgcagacaaaagattgcatagttggctccgatcctatttggcaagtgaatcagagatggcaatggcccaatgggctcggatcctatttggctagtgattagagatggcaatgcccaatgggtacccgcgatccgatacttt

SEQ ID NO: 53460 - DNA, 442 bp, Zea mays
  Clone ID: LIB3068-027-Q1-K1-E11
agcaggagcacggcggcgaggctccgcgaccagatccctgcaagaagacgcggctctcgtcccctctctgcactatccacggtagccacggccacccgaggctgatcccagggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgccggcgtaggtatcttcgacgt

SEQ ID NO: 53461 - DNA, 226 bp, Zea mays
  Clone ID: LIB3068-031-Q1-K1-H7
gctctacacgttctaacattccttccgccatccttctacctcatacattttgtatagagacaaattcactaatatgggtgcacatcgagataccactgactcactctataaacattatcaatgatcaaattaatctgcttattctacatcgagcatatcacttatcacggattatctaagatgtaccgaacgatacgccttgccaacaatacatcagcctgaatat

SEQ ID NO: 53462 - DNA, 264 bp, Zea mays
  Clone ID: LIB3068-031-Q1-K1-H8
gaagaggaagccggagcctgtttaatcgctgaagtcttcattgtgcgtgtgtagctgaattgtttcatttctccatcctgagttctttacctctcttctatctataggtctattcataggcattcatgaaaattttaccgagagaaaagattggaagggaggtttaattctggcccttaggtgtggaaactttggtgatggtaggtcgatatcttaccaggtggaaattaccatgccattatagcacggtatttgtgaatattt

SEQ ID NO: 53463 - DNA, 374 bp, Zea mays
  Clone ID: LIB3068-032-Q1-K1-A11
caaaaattatcaagactggttttgcagcaattcatctgatatactttttcactggtggtcctgatgaggtaaaatgttggcagatcagacgccagactaaagctcctcaagctgctggtgcaattcacactgattttgaaaggggtatcatatgcgctgaggtaatgaagtttgaagatctgaaagaactgggcagtgaatctgctgtaaaggctgctttaaaatacatgcaggaggggaaaacctatgtggtccaggactgggacatcatcttttttcaaattcaacgtgtctggtggcgggaagaagtgaagaatgtatgaagatggtagcatcacagtgttttacgtcttaccctcaatttctcattcaac

SEQ ID NO: 53464 - DNA, 183 bp, Zea mays
  Clone ID: LIB3068-032-Q1-K1-A12
ctcacgcgtgcgcccactggtacgttcacgcgtacgcccactcgttcgtcgaccggtggctcggcgaggagggcagctatctagcttagtacgtgtactggtccaacggccgtgagacctagaaccccatcgtctacaacaagcatttctctttgaagaacttattgaagctgtgcggcaggc

SEQ ID NO: 53465 - DNA, 142 bp, Zea mays
  Clone ID: LIB3068-032-Q1-K1-A2
aaaaaaaaaaaataaaaaaaaaaaaaaaaaaattttttaattaaaaaaaaaataaaaaaaaaaaaagaaaaatttaaaaaataaaaaaaaaaaaaaccaaaaataaaaaaaaaataaacattttaaaaaattccattataaa

SEQ ID NO: 53466 - DNA, 399 bp, Zea mays
  Clone ID: LIB3068-032-Q1-K1-A4
gaggatatagagaggaagaacagctcgtccgttactcatgaagagcagcccacacctggtgctgagcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgttggcctgcaagccttctaattcggccaccaccaggttaagtgcaccgacacctttcttggcatttgccggcccaagtgctagatcagagaggaagaacccgcgcttctgctagctgctatagcttcgttctttcg

SEQ ID NO: 53467 - DNA, 349 bp, Zea mays
  Clone ID: LIB3068-032-Q1-K1-A7
cccacgcgtccgcccacgcgtccggcttgaagttagcgctgatgaacttctcttgtaaatggatgtgctccctcctaggtttgctcctttaggaccttgtattattgagtgttaacttggaatttcgtctgattggtccctagtagttagttaggtgtggaagcaacatttgctatagccgtagtgttaggagtaccatgtgttcgttgtggtcaggtccatggtgcattggtgctgagccttaagcggaatgaaccctatgctcgctgtgaggcccatggcatcgtgttgtcgggtggtgttgtagcttgttgatgccctattttatattattatacgcgattgaagc

SEQ ID NO: 53468 - DNA, 472 bp, Zea mays
  unsure at all n locations
  Clone ID: LIB3068-032-Q1-K1-B7
ctggcgttcgacaagatggggagctacggcaacaacggcggcggtaataccaacaacaacagcgacggcgtggaggtgaagagctacttcaacaagtccgccgggagggcggcgagcaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcngtgctatccgccgggactgcccctcttcctctacaactactccacgcaccagctccacggcatcttcgaggccgcgagcttcggcg

SEQ ID NO: 53469 - DNA, 315 bp, Zea mays
  Clone ID: LIB3068-032-Q1-K1-B8
cccacgcgtccgcccacgcgtccgatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctg

SEQ ID NO: 53470 - DNA, 330 bp, Zea mays
  Clone ID: LIB3068-032-Q1-K1-C10
gattcaaggtactggaactaccctgaagattttagcccagagaggtttcagaatggcggggtcgactacaaagggaccggtttcgagatcacccccttcggtgctggtcgtcgacgctgccctgcaatcatgtttgccacttctactctagatattgcattggcaaaccttctctaccacttcgactgtgctcttccggatggaatgagcccatatatggttgataagtctgatcaatacgggatgggtgtcaccaaaaagttagaccatgatattattaccatcagatatgtatactgtactatggcatacgtattggttgtggttaaa

SEQ ID NO: 53471 - DNA, 285 bp, Zea mays
  Clone ID: LIB3068-032-Q1-K1-C2
gggcccacgcgtccggccacgcgtccgcccacgcgttcggttctatcccactcccgatcagcagctgatcgcgcactcttgcaactcgatcatgcgttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgtccgccgtcgtgcccgaggaggctgcccccg

SEQ ID NO: 53472 - DNA, 343 bp, Zea mays
  unsure at all n locations
  Clone ID: LIB3068-032-Q1-K1-C7
cccacgcgtccgcccacgcgtccgccagtacctagtcctacgagcagtcgcacgcaagtgtcaggagacgaaacggtcgacatggctcgcacgcaatctgccgtagcggtcgccgtggtggccgcggtgctgctgctggcagcggcggcgacgacctctgaggccgccatcacctgcgggcaggtgagctccgccatcgcgccctgcctctcctacgcccgcggcacggggtccggcccctgcgcgtactgctgtagcggcgttaggaacctcaagagcgccgtcagcaccgtcgacgacaggcgcgccgactgcaactgcctcaagaacgccgncaggggcg

SEQ ID NO: 53473 - DNA, 348 bp, Zea mays
  Clone ID: LIB3068-032-Q1-K1-D11
cggacgcgtgggcgcgggtcgcgggatcaaggagccagagagcgggacgcagcgagcggtccgccggagatcgagaccgtagctagggtttgaggcgccgggctgcggtggacgagatgtcgacgccggcgaggaagcggctgatgcgggacttcaggcgcctgcagcatgacccgcccgccgggatcagcggcgcgccgcacgacatcaacatcatgctctggaacgccgtcatattcgggccggatgatacgccgtgggacggtggcacgttcaaagttaccttgctagttacagaagattacccaaacaagccaccaatctgtcgatttgtctctaggatgtttc

SEQ ID NO: 53474 - DNA, 489 bp, Zea mays
  unsure at all n locations
  Clone ID: LIB3068-032-Q1-K1-D2
cccacgcgtccgcccacgcgtccggctgcatttggagcttgtgcaagagcttcttccaatttggagagagaagagaccgatcaagtcattggtgacaggcaggccaattctgcttgcacttgaggatattgatggcagcccttcttttttagaaaaagccctgcgctttcttgagaaacatggaataaaggtggaaggaattttgaggcagtctgcagatgtggaagaagttgacaggaggttgcaagaatatgaacaaggaaagactgagttttcagcagatgaagacgctcatgttgtcggtgactgtgtaaagcatgttctccgagagctgccatcatcccccgtgcctgcttcttgctgtacagcattattggaagcgtttcgcctggagactaangatgctaggataaatgctatgcgttcagctatatctgagacatttnctgagcccaaatcgaggttgctgcagagaattttaaaaatgat

SEQ ID NO: 53475 - DNA, 316 bp, Zea mays
  Clone ID: LIB3068-032-Q1-K1-D3
cccacgcgtccgcagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgca

SEQ ID NO: 53476 - DNA, 266 bp, Zea mays
  Clone ID: LIB3068-031-Q1-K1-H6
gccgatggtgatggaggagcctctttaatcgctgaagtcttcattgtgcgtgtgtagctgaattctttcatttctccatcctgagttctttacctctcttctatctatagttctattcataggccttcatgaaaattttacccggagaaaagattggaagggaggtttaattctggcccttaggtgtggaagctttggtgatggtaggtcgatatcttaccaggtggtaattacatgccattattgcacgtaatttgtgaatattt

SEQ ID NO: 53477 - DNA, 402 bp, Zea mays
  Clone ID: LIB3068-032-Q1-K1-D8
caatccgaaatctcgagcgttcgcgcctgcgatcacagcaaagaggaggccacagcacgacagggccccagggttcctactctcgtggcatcggcagcactgaggggaagatgtcgtcggtgttcagcggcgatgagaccgtccccttcttcggtttccttggcgccgtcgtcgctctcgttttctcatgcatgggggcggcgtacgggactgccaagagtggcgtctgcgtggcgtccatgggtgtcatgctcccagagctcgtcatgaagtccatcgtgcccgtggtcatggctggcgtgctgggtatctactgcctcatcatcgccgtcatcatgagcactgtgatcaacctcaaggccaagccatactacctctttgacggctatgcctacctgtcga

SEQ ID NO: 53478 - DNA, 349 bp, Zea mays
  Clone ID: LIB3068-032-Q1-K1-D9
gccaggagggccataaaacaaaacacccttaggtttggtgagagtgaggccaatgtccgtgagatttttgacaaggctaggcagtctgctccatgtgtcctcttttttgatgagctcgactccattgctactcagagaggaagcagtgttggttacgccggtagtactgctgatagggtgttgaaccagctgcttactgagatggatggcatgaatgctaatatgacggtttttattatcggtgcaactaacagaccggacatcattgatccagccttgcttaggcctgttcgtattgatcagcttatctatattcctctttccgatgagcaatccaagcttcagatct

SEQ ID NO: 53479 - DNA, 173 bp, Zea mays
  Clone ID: LIB3068-031-Q1-K1-F12
cggactcgtgggggccggcggcgaggtcgttactgagcctaccggtccacttggcgtgctcaagggcttcaaggacctgcctcccgggatgccttccgtgctcttcgtgactgcattaacttgcttttgtgggttccggtcattcttttacacaacgactggattggcccgga

SEQ ID NO: 53480 - DNA, 394 bp, Zea mays
  Clone ID: LIB3068-031-Q1-K1-F2
ctcggactgatgattggttttggtgtggtagaatttgatggcaactcctcttttatttgtgggaagatgagatgtagtttattggtgacaacaaaaaggtcaaggttataaaatccatctgaaaaggaccaggcaagactagaggggatgaataggtctgttataaaatttactcaaagcaatggttagtgataggtgcgccagttctaggaaaaaatgtactagcggtgcaacggttctaggcgcaactatgctactatcacaaaatagagcacctcatgaacataattcaaaatctacaacaagaaaagtatattgagtaaattactagtgttcccagtagtgtatagagactatttcatcacttttcctaagatggacgctctagcacaag

SEQ ID NO: 53481 - DNA, 299 bp, Zea mays
  Clone ID: LIB3068-031-Q1-K1-F3
ctcgatctaacgcctgcttcctccatcactcttatactcatggcgacaccatctctaatttgcgcgcaatatactcatcactttattctctacaacacaaacgtcaccgttctcaaattcatctccaaaatgaccacccactactcgtattttatcaatctgtctcatataaaatttactcaaagcaatgcttagcgatcggagctcaactcctagctaaatatcaactagagcaccaacgtatctatcctcatctatccttctatcatattatacttcacactataaaccttatttaa

SEQ ID NO: 53482 - DNA, 310 bp, Zea mays
  Clone ID: LIB3068-031-Q1-K1-F5
ggagagtgagcctgtcagtgtattgtgtctggcgtggtcaagaaccaaatcaatgttggaccgaccgactgagagtttggagtgtgtatgatttgctattactctagtagagtgtgggtatacctgggcagaatgtgtcctcaaaagttgggggcctgtctgtgtactgtgtgcgatggacgccctaagtaaaaaaaaagggcaggtgatggtcgtgctccaggtgatggtcgccctaatcagagaatgtatgctaaaaaaaaagccagagtgtttggctcctggttcatgttatgctgaatcttggaat

SEQ ID NO: 53483 - DNA, 65 bp, Zea mays
  Clone ID: LIB3068-031-Q1-K1-F6
aaaaaaaaaaaaaaaaaaaataaaaaaaaattttttaaacaaaatccaaaatatatcttaggagg

SEQ ID NO: 53484 - DNA, 356 bp, Zea mays
  Clone ID: LIB3068-031-Q1-K1-F7
gccacgcgtgcgaccacgcgtccgcccacgcgtacggccacgcgtccgaccacgcgttcgccgacgcgtacgtccacgcgttcggacccacacgttcggccacgcgtacgcccacgcgtgcgaccacgcgtgcgaaaaaaaagcacaccggacaccgaacgatgatgcagtgctcttacgggcgatgggaccctacctatagctgaaccgatataaaagggcggccggtttataggccccaaagataagtcttcgcgatgccaccgcatacgttttctgacgtgctacccaaatgcaaatgacgggacgtccggtctcaacaaatttaatggcgaaaccctgtcgggtcacaaccg

SEQ ID NO: 53485 - DNA, 444 bp, Zea mays
  Clone ID: LIB3068-031-Q1-K1-F8
cccacgcgtccggttcttgcctcgttgggatttgatggcgtcggaggtggaggacgaggcggggactccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcctttcgtttgcaaa

SEQ ID NO: 53486 - DNA, 421 bp, Zea mays
  Clone ID: LIB3068-031-Q1-K1-F9
gcgcttccttccttgcttcccctgccctcttctttttattccccgtctcctttgttcgcttgcgggctgcggcaagggggagggagaggacgtgacgaggggaggggaggggaggagggagggcaggcggtccgacgaatgcacagtcccggagaatattggtgaagcaataacttgatattgggttctagaccaaagaagcaatggaaaaggaatcatctgccacatacgagccaaaaaggaacagtgaaataagggtttttgagagttcagatgagatttcaacggatcttgctgagtatatctcacaagtttcagaaatttctgtcaaagaaaggggataccttgccatcggcttatctggaggtcccctagtcaagtttttggggaaactctgtgaaactccatacaacaagacact

SEQ ID NO: 53487 - DNA, 141 bp, Zea mays
  Clone ID: LIB3068-031-Q1-K1-G12
cctgctcctgccggactgcaggaatgtcgttactcagcctagcaaaccgcttggcccagcgaacattcctgaaacacccttaactctagatggcatactttctgctatagactgccagttcctcaatcataaagttacaac

SEQ ID NO: 53488 - DNA, 266 bp, Zea mays
  Clone ID: LIB3068-031-Q1-K1-G2
ttcacgctgacgatcactcttcctgtcacactctttgataccctctccaccactcatttcagggaggattcgatcacgcgtactgacgaccacatacaggtacacgttctaaaacccatccgaccacgactacgcaagactacaacagatgaataggtctgttataaaatctacttaaagcaattgttagtgataggtgctccaacctctatgaaaaaatgcactatcggtacacaccattctaggcgcaactatgctactatcac

SEQ ID NO: 53489 - DNA, 72 bp, Zea mays
  Clone ID: LIB3068-031-Q1-K1-G3
cccacgcgtacgcccacgcgtacgtccacgctttcgtccactcgttcgaaaaaaaaaaaaaaaggaagaatt

SEQ ID NO: 53490 - DNA, 210 bp, Zea mays
  Clone ID: LIB3068-031-Q1-K1-G4
cagaaagttagctagctgctatcgtggaagtgcccatatgcgagagagagaggcaagctagcggggagggtctttacaggctagccagccagctggtagctcctgcggacaaggcgatggttggtgccaactttaactttggaccgagcttcggcttggtctttccggaagaagctcccttgtggtcaataaagacaccatttaccttaa

SEQ ID NO: 53491 - DNA, 287 bp, Zea mays
  Clone ID: LIB3068-031-Q1-K1-G6
ctctatcgtctgccaacgacgcgattggcgattccatttctaccccgagacctccaggcgggcgtccctgaaccctcagccttctacgtcccgcctcggcactcgacggtcgacggcacacaccgcgcagtctcgagacaggaaccggaggaacgaggatggaggatgactcgccgctgacgaatacgatgaacggtgcggtgacaggactcgccgagaagaccatctggggcaccgtcgtcgccacctggtacaacaggccccttgaggagcgccacgtagagctc

SEQ ID NO: 53492 - DNA, 258 bp, Zea mays
  Clone ID: LIB3068-031-Q1-K1-G7
cggactcatgggcacggatatcacagcttgctttcatgtgctagcttactctggcatcatggggatcgtgaacctggtctagctatagcgtcgaagaggaactagtacttagacgctcgcgactctggcgatgaccgttctgatggcgaccaacggacagtgttcaagtgcagacgcgcgaccggctatagaccggtgaagcgcgtacaggacgatactcccgctccttccgtcggtgctaatagacaggatgatgcc

SEQ ID NO: 53493 - DNA, 404 bp, Zea mays
  Clone ID: LIB3068-031-Q1-K1-G9
cccactcgtccgcccacgcgtccgttggtgatcgcccagtacaccgtccgtaccgtgcagaggaccgttcctgctgctgtgcctgctgttgtctttctctccggtggacagagcgaggaggaggccaccctgaatctcaatgccatgaacaagctcagcaccaagaagccatgggccctgtccttctccttcggccgtgccctccaggcgagcaccctcaaagcctgggctggcaaggtggagaacgtggagaaggctagagcggtcttcctcgccaggtgcaaggccaactccgaggctaccctcggcacctacaagggtgatgctgtcgccgacaccgaaagccttcacgtcaaagactacaagtactgagttgcttctctttgcgatcccgttgttttgga

SEQ ID NO: 53494 - DNA, 344 bp, Zea mays
  Clone ID: LIB3068-031-Q1-K1-F11
tcgcccactcgttcgtccacgcgtccgttctggatgaaggttagcaaatgaagtacgtcgtttgaagtttgtcctagaaaaaaggtttcaagcattctccttgttggagactgatatctcctgttcctggatcctaatgaactgctttagaagctctgataattgtgcctatggaaacaggtcttggatgtggttaacaagatgcccagcttgagaaagatttccttcctagcgcattctctgggtgggttggttgctagatatgctattgcaatactccactcagtctcagtggaaacaaataatgcatgacaaagtagtgcacttactgttcctacacaaga

SEQ ID NO: 53495 - DNA, 199 bp, Zea mays
  Clone ID: LIB3068-031-Q1-K1-H1
tcctgattcccggtcgacccaccgtcctccacgcgtcgaaaaaaataaaaaaaaaaatatataaaaaataaaaaaaaaaaatattaaagggaaaatcaataaatcaaatatgaacacaaaaaaaaaaaaaacataaattaaaaaatatactattttataattccattcaaaataacaccatataccttatctgatatac

SEQ ID NO: 53496 - DNA, 420 bp, Zea mays
  Clone ID: LIB3068-031-Q1-K1-H10
cggacgcgtggggccgttggtaaggatgagcaaaggcccagttccgtttgccaacatcgggaagagagcaaaagatcttctgtacaaggactacaactttgaccaaaagttttctttgtcgacgtctagcggctctggtttgaatctcacagccactggtgtaaagatcaacgaagacttcattggtgatatacggacacaacataaaagcagtagaactactattgatgtcaccgttgatagtgattctaaagtgtcaaccacagtcactgttgatgaagcactaactggtttgaagacttcattcgccttcaaagttcccgatcacaagtctgggaagcttgatctgcaatatgcgcacaatcgtttttcattgaactcgaccattggtttgacatcagcacctttggttgaactggc

SEQ ID NO: 53497 - DNA, 253 bp, Zea mays
  Clone ID: LIB3068-031-Q1-K1-H12
cgggccgaccgcactcgtacgcccactcgttcgcccactcgtactaaaaattaaaaaaaaaaaaaaaaaaaaaaagaaaaaaaaaaaaaaaaaaaaaaaaaaaagaacaaaaaaaacaaaaaaaaaacaaaaaaaaaaaaaaaaaaaaaaaaaaaaaaaaaaaaattaaatatcacagacaaaacaataaaataacaaccaaaacataataaaataataaacaaacacaacatataataaatacaactactaa

SEQ ID NO: 53498 - DNA, 74 bp, Zea mays
  Clone ID: LIB3068-031-Q1-K1-H2
gtcgatggtgatggaggagcctctttaatcgctgaagtcttcattgtgcgtgtgtagctgaattctttcatttc

SEQ ID NO: 53499 - DNA, 264 bp, Zea mays; identical to SEQ ID NO: 53462
  Clone ID: LIB3068-031-Q1-K1-H4

SEQ ID NO: 53500 - DNA, 414 bp, Zea mays
  Clone ID: LIB3068-031-Q1-K1-C1
gataagtctttgacatttcagcatagacaggagcaatgacacggcatggcccacaccatgaagcagatcgacaagctcgtgggcgcgaacaaacctgagctcgagaagaaagtgctagcagccgctgatgccagtacgtcctagtgacacaagtggaagtgggcaaacgatctgtgatggctttccggtgtatagtttccatggttcatttgtgtgcttgtcccatgtttgcctggggacgatgacgttttacaattttggcccccatcgcgcgcactcgtctgtttctctcatggaaggccgtgtgaacctgtgcctgtgtttgacaaatgaacggaactttatatggaccaatgcttaaaagtctttgcaacctaatttttaagggttggttgcatgaaaaaaaaataaaaa

SEQ ID NO: 53501 - DNA, 187 bp, Zea mays
  Clone ID: LIB3068-031-Q1-K1-C11
acgccacagctgccacagagacatcatacagcggtactactggcgagtctgagctgaagaggatgatgaggatgaggataagcagcaacacacaccgacgacggagagcgaatatgcaccgcatcgagctgtagctcgtccgcggcctgtgcgcactggcagtgcccgctgtacacggcggcaatga

SEQ ID NO: 53502 - DNA, 219 bp, Zea mays
  Clone ID: LIB3068-031-Q1-K1-C2
acgctcggcccattcgtagttcaacacccgccaacagtcttcgcgcggagagcgcaatcaacagacagaggaactgctggaagctagcatcttacccactcataagctatggcagttcatcgcaccctctttgcttgcgcgtcgtcgcatgctacgcactacaatggcggcctgaccgcgcctgtgcatcggacgcaccctgcctgtcgggctgtctcg

SEQ ID NO: 53503 - DNA, 291 bp, Zea mays
  Clone ID: LIB3068-031-Q1-K1-C3
caagcaccacaagcacgagcaccacctgcggcgttgctgcgggtgcatggcgtcgtgcctgctggcgctggtcctcatcgtggccttcgtctcgctggtggtgtacctggcgctgcgcccctcgaagccgtccttctacctgcaggacctgcagctgcgcatgcccatctcgctgggcgacccgtcgctgacggcgtcggcgcatgtgacgctggccttccgcaacgccaacgaccgcttgggcatcttctacaagcgcctggacctgttcgtaacctaccgcaacaaggc

SEQ ID NO: 53504 - DNA, 127 bp, Zea mays
  Clone ID: LIB3068-031-Q1-K1-C5
gttatagatcgcgacagtcgtccgttgactctttttatcataaattagataaggtacacgaggttgactaattacttttgaataacttcacaaatcatatggaagaaccatagcatttcgcgattca

SEQ ID NO: 53505 - DNA, 117 bp, Zea mays
  Clone ID: LIB3068-031-Q1-K1-C6
tcccacgctttcgcccacacatcaatcctgctctaaacaagaactccctcctacacctgcgagagctatcaaacaagctaacgcggctaacatacaccccaccagactcaatctctc

SEQ ID NO: 53506 - DNA, 328 bp, Zea mays
  Clone ID: LIB3068-031-Q1-K1-C7
gcgctcgccgctatcattcgtttctggagacccttctagccccgccgtcaccacaccaccaatggcaggactcggatcaaaggccctcgccgtggtcgccgtcctggcggccgtcgtcctctcggtggcctccgcggccgaggcgcccgcgcccagccccgtcttcgccgtcgccggcgcgtcagcgccgttcgtcgcggccctcgtcgcctacttcgtcgccttcctcttcgtccgcgtcctgcactgagcctatggtgcctttccaccgtcgtcgtcgtctagatctatttattggagtggcatttcagtagtacttgttctaggg

SEQ ID NO: 53507 - DNA, 216 bp, Zea mays
  Clone ID: LIB3068-031-Q1-K1-C9
tcgccttcggatgaaggatcccctttctttacctggaggacatccaactgaggctcatgaaaaactacggatagagtcgaccactgtgcgctggcttacgccatgaacgatgagttctgcagagtgctccatcagcatatgaagttcttctccagcaacccatgctcacgtctcactcaagacgtgtacgaagataaatgagcatagtatacacac

SEQ ID NO: 53508 - DNA, 415 bp, Zea mays
  Clone ID: LIB3068-031-Q1-K1-D10
cccacgcgtccgatcaagggctgctgtgtgggtccaaagaagagggtggtgaccgtccggcagtccctcctgaagcagacttcccggctggcgctggaggagatcaagctcaagttcatcgacacatcgtccaaatttgggcacggtcgcttccagactaccgatgagaagcagaggttctttggcaagctcaaggcgtaaggtgctgcggtgcagcgaagtcccatttctcaaaatcatcaaactgagatactttggtttgtaaccttgctgtaccaagttttgtagccatggtccggtcgtctatggattgctccatgcttcagaactgcactgtctatgttttgcgctatctgggttgttaatggcccaaaaaaaaaattaaaatttttatatgttttcctacattaatatt

SEQ ID NO: 53509 - DNA, 354 bp, Zea mays
  Clone ID: LIB3068-031-Q1-K1-D11
cccacgcgtccgcgaggagcaccccatcaagttctctcaggcattccatttgctgccggcagctgggtccttcttcgtgcagaatgacatgttccgcctgaactatggctaaaagacagccgaaaactcttgtgatgaacgaatttgttaagggcttcatgttgagacgatgaataccgactgtcgccgctactctcatctcctttgtatctcctctgttggctgattaactgttattacaagaaattgctggacttgttttttccagttgttttgaatcatgtattatggttgcatgggcaccatttcttcgtgggatgtgaattgaaacagtccaaatcaattggtgtgggc

SEQ ID NO: 53510 - DNA, 212 bp, Zea mays
  Clone ID: LIB3068-031-Q1-K1-D12
tcttcctcccacgcttcctctaaaagcaccatataattttccctccaacatcacattctcagtgtgcatgtctttccttacacgtacataatgtcatatcacatatgaaatattgatcaatgacattcaaacaatgttcatacaaaataacaagctaaaccatctcttttactcacaatgaatacctcctctacactataaactcaagtact

SEQ ID NO: 53511 - DNA, 333 bp, Zea mays
  Clone ID: LIB3068-031-Q1-K1-D2
ctcggcctcccgttttgcctcgccgttcttcctgatctaatgggctaatggccattcccctggctgagatgtgtaagatacttctacatgttctcaccctcgcagagcttgttatggcctatagatgtaaccgcctttgttaatgcctcgatgtagcccccagcgagcatcgcatagcacctgttatgttgtcagcgtcgctactgataatcggttctgttggtcaatgctactataataatcggttgtggtgcaagtaatgtgaatagtgtaagagtgtttcgtgttcaaaaaaaataacatcgagcgtacatcttaatcggccaactgaac

SEQ ID NO: 53512 - DNA, 159 bp, Zea mays
  Clone ID: LIB3068-031-Q1-K1-D3
tcgggtacgcctggactgacccgtgaactgacgcgtattaataagcggaggagaataaacttacgaggagatctctagtaacggcgagcgaacctagagcagcccaacttgagaatacaacaggcctcgccttctaaattgtcctatgtaaaggcctcc

SEQ ID NO: 53513 - DNA, 56 bp, Zea mays
  Clone ID: LIB3068-031-Q1-K1-D5
cccactcgttcgcccacgcgtccgttgacgcgttcgttaaaactagcgctgtttac

SEQ ID NO: 53514 - DNA, 143 bp, Zea mays
  Clone ID: LIB3068-031-Q1-K1-D7
gaaatgacttgtgtatgacataggatacatggtatgactataagtactaaaattaaaaacgggggctattattctgaattaagaaggaataaaaatttaaagaattattctataaattattttaaaattaaaaataataataa

SEQ ID NO: 53515 - DNA, 196 bp, Zea mays
  Clone ID: LIB3068-031-Q1-K1-D8
gccacgcgaccgaacatgcgtacgtgccaacgtcttcagctccgatcggccattcgagacggggccttgtacacgtacggcggatccatgcatgactacagaccgacggaataagtaaactcaccctaaaactagtcagagctcactcgcacgctgacgctcacacttatactacacgtgctcagtaagaccacag

SEQ ID NO: 53516 - DNA, 338 bp, Zea mays
  Clone ID: LIB3068-031-Q1-K1-D9
cgtccgtaccatttctgattctgcttctcgacgcccgaggaaggcccatgagggggccaggtcctgtcattacccatggctgaacacaaccaccagctctagcagctcggagcagctcaagcatgacgacagaacacgacgggttcggcgcctacagccagtaccccaactacaagaacgactccttgaccgaaatctactgctccgtctagaacaattacgtcgagtacattaatgcattgaaccaacgcatgcacaagcagcacactctgagacgcctatgacatcgaccgcggctcctccgcactctacgacaagcactatgcaaagaacgaccc

SEQ ID NO: 53517 - DNA, 359 bp, Zea mays
  Clone ID: LIB3068-031-Q1-K1-B8
cccacgcgttcgggcagatgctgagagatgcataaaatgcaaagtttggattgaaagcacaggggaaagctagtggctttaaagaaaatgagggatcatccagtatcgctgttgaatcatccagtatggacattgacaaagctcagtctactctaccaaagaaacaattaactggcgtctatgatttggttgctgtcttgacacacaagggaagaagtgcagactctggccactatgttggctgggtcaagcaagattactgaaaatggatcgagtttgatgattactatccatacatgcttaaggaagaagacattttgaaactatctgttgaagttactggcacaatgcttatatct

SEQ ID NO: 53518 - DNA, 199 bp, Zea mays
  Clone ID: LIB3068-031-Q1-K1-E1
gccagcgccatggtcacgtcgactaccgccgacgccgtgctgtacccgacgtccgtggtcgggcttcgcctgaagccatttaccggggcgccccaagccgttccgcccgaaaacgggcgcggcggtccgtggcggagcgcgcggaactgagcccttcgctggtgatcagcctgagcacgggcgtgtcgatcttcctggg

SEQ ID NO: 53519 - DNA, 433 bp, Zea mays
  unsure at all n locations
  Clone ID: LIB3068-031-Q1-K1-E10
gtgatgaggtcatggtggacgtagaagaagctattgaaggacaacctgaagtcaatggagtttccaatcagttgatcaaaactctgaatatcactaaagatggctcaagcagaagcattgatgttctctctgattcaacagcacaagaatcatttttggaggcggtgaagcccagtggtcgtatcaatgcatgcttggccgtagggaaagatatgctctacttgtatggaggaatgatggaagtgaaagatagagaaattactcttgatgatctatattcacttaaccttagcaaacttgatgagtggaagtgtatcatatcggcctcagaatctgaatggttagaaatntctgaagaagaggaggatgatgatgatgagactgatgatgatgaaaatgaagagggggatgctagccagacagatgaagatga

SEQ ID NO: 53520 - DNA, 268 bp, Zea mays
  Clone ID: LIB3068-031-Q1-K1-E12
tcgcaccgtcaccgagtacgggccctacctccattacgaaccttcacccttgcacacagggacgattgtggagaagtgcactcttaaactagtcgatgagtacaagcacatgctgtgccaggccactgaaccactatctacgtttttgcagtatataacttatggccacatgattgacaatgttgtccttattgtaactgggacactgcatgagagagatgttaacgaacttttggagaaatgccacccattgggcatgtttgacagc

SEQ ID NO: 53521 - DNA, 192 bp, Zea mays
  Clone ID: LIB3068-031-Q1-K1-E3
ggttcgcgaggtcccattttgctttcccccctgtcttgcagtgcgttgatgcacctcggggcttttgtggccctccgctgctacttaagctctccgcccgtacacggcttcatctctcatggcactcgctgtcttctgatagctgctgctatatctacttcactaacctaagaagcgtctgtaggtctggat

SEQ ID NO: 53522 - DNA, 248 bp, Zea mays
  Clone ID: LIB3068-031-Q1-K1-E6
tcttcctcccatgcctcctccctctcctaccttcctacttaacaatatctgtcctccctatctaaactgcgtttcctacacttgcatccgaaacaatcaactttacactcctttctacccactgattaactttaataactctcaaagtatcattattacacttactccctcactcatacaataattctacaccaataacatcatttcacaaaatcttactacatttcatctcaacaaatacttcttta

SEQ ID NO: 53523 - DNA, 424 bp, Zea mays
  Clone ID: LIB3068-031-Q1-K1-E9
cccctcccgagtacacattttgtgtgtctattggaagagccatccccggaatccggggttggttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcatccgctggtagggacgatgactatgtgcagacctaatgacaaacatatcttcggtctttagcttccttatactgcaatcgcatgcatctgtataattgtgggtttccggaacgttgcacgttccgttagaataataataaactggtatgtacaa

SEQ ID NO: 53524 - DNA, 199 bp, Zea mays
  Clone ID: LIB3068-030-Q1-K1-G4
acgcgtacgcgcacgcgtacgcgattcgattacgactcgactcgactgctcgttcacggtggacatccactccatggacgagcgcgagcgccagctgcatcaccgtattctgggatacccatgcatgcccaagcaagaatgaccactgacgctagtctcgggggccgtacggcgacgtgcacggccactagcgacctgc

SEQ ID NO: 53525 - DNA, 340 bp, Zea mays
  Clone ID: LIB3068-030-Q1-K1-G6
acgcccacgcgttcgcccacgcgtccgcgattcgattcgactcgactcgactgctcgttccggctcgaccttcacgcgggtaacaggttgaccgtccgcggattcaccgtatcccgggatacgcatgggttccaaagcgtacttccgtgtcacgctcctcttgctgctcctcgtcgacgccgacgcggactggggacctgctgcacaggccgacgacgctgctgagctcccggatcatagagctattaccttgaaagagcaggtttcttcgaccaagattcctgtccggctcaagagtggcagcccgctgtgctcaacctgggaaaacttcacgggccaa

SEQ ID NO: 53526 - DNA, 388 bp, Zea mays
  Clone ID: LIB3068-030-Q1-K1-G7
ctcgtgctcagctcgtccttcccttccttcggcaagttcatactaatcttctgatccagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgccgaagaagaagaagccggtctccaagaagaagctgaagagggaaaagctgaagcagggggtctcggcgccaggggagtgaacagacaaggatgccggcgatccggccgtcctgaggcccgcccctatttacatg

SEQ ID NO: 53527 - DNA, 84 bp, Zea mays
  Clone ID: LIB3068-030-Q1-K1-G8
acgctcacccttactcttacccgtaccacacatacatttgtcgttctcatattagctcagggttagggcaccatgtgcattgac

SEQ ID NO: 53528 - DNA, 194 bp, Zea mays
  Clone ID: LIB3068-030-Q1-K1-G9
actcttgtatccacgacacaggttaccatgattgcttatgacggtctgaagcacagagtctctgacgtttgcctacctgatcttcagggtgactaggatcaagcttacaggaaaatcaggcttcctgctgaagatgtgcagggcaagaatgttcttacaaactcttttgcgttgaattttaccactgataaatt

SEQ ID NO: 53529 - DNA, 259 bp, Zea mays
  Clone ID: LIB3068-030-Q1-K1-H12
gtacgcctcccctggtgaagaaacctgagttgctcaccgaacctgaccatcagcaggtggggattatccaaagggacggtcgactgtgatcctaactcaataactcgagttgtagcacgcctatagcaacacccaatgattgctaactatgattgtaccttacatacccagaagaatctttcgtcgcacgctaaatcaatactaatgtccaaacaactaatctctattaccaattgtgtcaatagactaatccattcat

SEQ ID NO: 53530 - DNA, 396 bp, Zea mays
  Clone ID: LIB3068-030-Q1-K1-H5
cagagattgccagtactattacttgtggttaacatggacttctcagctggttcctacttcacatgatggcctgtcaattctgcttctgagagctacagtttggctgatggttcagttgaatcctatggaggagaaggaatcatgccaccttcaagctacttcatgacagccagatcagatcacaatttaaaattcagtgtgcatgaacaggattccactatgcttccaaacgaccaattgacctatgctggcgctaggcagactgatctattacctggcgagactccatctaaggataagctttgtgagaatcttctggagctttaacgactgcagaataacagcagcctaccgagttaattaatgcccccaagggtacttcagcacaattcaaca

SEQ ID NO: 53531 - DNA, 293 bp, Zea mays
  Clone ID: LIB3068-030-Q1-K1-H6
tcggccgccctttgatattttttttccacacgatattactgttctcgttgatctcaggttagggcacctgcgttatgtttcaaccgatctgccgacctaaccaaactttccacccggatctgtcttgcgaggccatcccttcgatccaaacggaccttcgatgccaacgtttcgacccaccgaatatttcaaatcacggtataagtagtggtactttactagcgcccggatgctactacttatcctacacctctaaagataactacacatattaagactttttgtcaaactca

SEQ ID NO: 53532 - DNA, 258 bp, Zea mays
  Clone ID: LIB3068-030-Q1-K1-H8
actcattcttccgcccctccagatttcttttcttccatttcacattttatgacacctactctagattggaacacttctaccgacccatccacacttctcacctcacaatcactttccccaccatccaacctcttacgccctgacttgtatccaaaaatatatcctttgccccaatttcaacccacgtaataagtttaataaccacaaaattagttatatttcacttacacccgtatgcttccacttattctacacctc

SEQ ID NO: 53533 - DNA, 209 bp, Zea mays
  Clone ID: LIB3068-030-Q1-K1-H9
aaacacataaaacgtccttaaaaacccattaaacaaatgatatcaaaactaactgggctagagacacatgccagaccttctaacatatccaatcttaccttcccatccatgcaacttactatatcttctatcctgatccctacattacaatccaatgcacgatgtctacaacattgtatactgcaaaaaccctaccctcacccaactta

SEQ ID NO: 53534 - DNA, 220 bp, Zea mays
  Clone ID: LIB3068-031-Q1-K1-A1
tcgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgctaccactccgaaatactccatagcacgttatgat

SEQ ID NO: 53535 - DNA, 289 bp, Zea mays
  Clone ID: LIB3068-031-Q1-K1-A11
tcgcccactcgtccgcccactcgtcctttgactcttgggcggacgcgtaggtctagagcgaagtctgcctcccttcttgggcatgtttaccgactacagggtgaacgtattcattacagcagcacctaacatgaccatgattgtaatcataatactagtaccagtcgcaatctcatttctacagtgcttaaacctatcaatcaacctaaccgactaagggctactatggatgaaggactggaatcgtgcatcaatctcgctcacaattcttacctggacgaccgcggaa

SEQ ID NO: 53536 - DNA, 389 bp, Zea mays
  Clone ID: LIB3068-031-Q1-K1-A2
cccacgcgtccgggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaagcgggagctcgccgtcttcttcggccagacgttccacgaaaccaccggtggatgggcgactgctccggatggaccgtttgcctggggatactgccgggtgaaggaacagaaacagacggacccaccctactatggacgaggaccca

SEQ ID NO: 53537 - DNA, 393 bp, Zea mays
  Clone ID: LIB3068-031-Q1-K1-A4
accacgcgtccgaaaaaaaaagaaggctttaagcgatggacctgttcatggctggacgacgcgctgcgtcgcctatgctgacggcgccggcactcatcatggcgtgtggagcataatcacccggtccatgttccagagcatgctgatccaccgtggctacagatggtgccagggcgccttatacacctacgacgcctttatcgaggccgtcagcaagttccccggctttggcaccaccggcgactagcaaacacgcaggcgggagctcgacgactttattgtccaaaagttccacgaaaccaccagtggatgggctactgctcctgatggaccgtttgcctggggatacttgccggtgaaggaactaaaacagacggacccaccctactatgg

SEQ ID NO: 53538 - DNA, 202 bp, Zea mays
  Clone ID: LIB3068-031-Q1-K1-A5
ccgtgacttcatcaagaacatgatcactggtacctcccaggctgactgtgctgtccttatcagtgactccaccactggtggttttgaggctggtatctccaaggatggccagacccgtgaacatgctctccttgcgttcacccttggagtgaagcagatgatttgctgctgcaacaagatggatgctaccactccgaaatac

SEQ ID NO: 53539 - DNA, 109 bp, Zea mays
  Clone ID: LIB3068-031-Q1-K1-A7
cttaattcccgcttcgacccactcttccgccctcacttcatcaataacattatcactcttttctcccacgctaactaaactttccttaggggggacttcaccactggtg

SEQ ID NO: 53540 - DNA, 96 bp, Zea mays
  Clone ID: LIB3068-030-Q1-K1-G2
aaataaataaaacatcatataaaattatatttatctactaagaataaaataaatgcggaagggctaaaatcaaattgggcggtggctcttaaatgc

SEQ ID NO: 53541 - DNA, 204 bp, Zea mays
  Clone ID: LIB3068-031-Q1-K1-A8
cccactcgtccgaaaaaaaaaaaaaaataaaaaaaaaaaaaaaaaactaaacaaaaaatgaggggggactctaccaatagaaggttataaacactctctcatgcaaggataatcaatactctagaacatgctctaattacattaacctttcgaattattacatatcatttactgttacaacacgatggattcacccattaataa

SEQ ID NO: 53542 - DNA, 438 bp, Zea mays
  Clone ID: LIB3068-031-Q1-K1-A9
gcagaccctgccccggttcaactgccgtggccgtctcgtccccgtccagtccaggtttccgtcttcctctccgactccgccgccggcggaaccccaaccggcgaggatggggaacatcttcgtgaagaagcccaagattaccgaagtggacagggccatcctcaccctcaagacgcagcgccgcaagctcgcccagttccagcagcagcttgagaaggtaattgaagcagaaaaggaagctgcacggcagttggttcaacagaagaagagagacagagctttgattgcactgaagaagaagaaagctcaggaagagctgttgaaacatgttgacacatggcaaatgaatgttgaacaacagctctcagatattgaactagcaagtaaacaaaaggctgtatttgaaagcctgaaagctggaaacgctgcccttaagtc

SEQ ID NO: 53543 - DNA, 364 bp, Zea mays
  Clone ID: LIB3068-031-Q1-K1-B1
gtcggatctgagacgagacgagttaccatctcatcccaactccggaacgaacaagttaccatgtcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtccttggtgagatcaccaccaaggccaatgttgactacgagaagattgtcagggag

SEQ ID NO: 53544 - DNA, 263 bp, Zea mays
  Clone ID: LIB3068-031-Q1-K1-B3
ggggtgttgtggagtctgcagctggctactgaaggcggagccatggggaggggccgctggactgagcggtcaacaatcaacgcagcacttgaagcccgaacgcgtaaaagctacagcttcgcttgcaccaatccctatgctttaacgcgaagcttcatttgacggaccactacagacactgataggacaaaaacatttcagccaatctgtgtcgacaaagacgagtttcaacagcgatgatcctaactaaacaaggtgtatta

SEQ ID NO: 53545 - DNA, 260 bp, Zea mays
  Clone ID: LIB3068-031-Q1-K1-B5
ccgacgctttgtccgacacgtgatttctgttctacacgagatcatattaagacaactgcgagggttattaacaattctgccgcactatacaaacttcccacctcacagaatctcccgaccagataatgcaatcaagcccgatcaatccagccaagacgatattactgtccaaaattacgaacctcgctatacatataatcacctacatacttgaattaactcactagatcccgaaagttcactcgtactctacagctaat

SEQ ID NO: 53546 - DNA, 340 bp, Zea mays
  Clone ID: LIB3068-031-Q1-K1-B6
ccctgacttcatcaagaacatgatcactggtttttcccacgctgactgtgctgtccttatgagggactccaccactggtggttttgaggctggtatctccaaggatggccagacccttgaacatgctctccttgcgttcacccttggagtgaatcagatgatttgctgctgcaacaagatggatgcaaccactccgaaatactccaaggcacgttatgatgagactgtgaaggaagtctcatcctaccttatgaaatgcgagtacaacccctgataagattgccttcgttcccataacaggttttgagggcgacatcatgattgacagcgtcaccaacct

SEQ ID NO: 53547 - DNA, 450 bp, Zea mays
  Clone ID: LIB3068-030-Q1-K1-D10
tccacgcgtacggagaacatgaactggtagttcaagatccttctggtagtgctcccaaaggtgttaatagttaaagattatgtggacgaacctcatgtatcaacaactaccatgagatcgagcggtgaagtacctcaagatcatagtgccaccgaggaaaacccaaaaacaattgacagcattgttgaaaggagaccatctctaagcagtcagattagcattaccctaagatcaagtggtgaagtacttcaagatcatagtgccaccgaggaaaacccaaaaacaagtgaaagtattgttgaaaggagaccatctctaagcagtcagattagcattaccctaagatcgagtggtgaagtacttcaagatcatagtgccaccgaggaaaactcaaaatcaagtgaaagtattgttgaaaggagaccatctctaagcagtcagattagcatg

SEQ ID NO: 53548 - DNA, 377 bp, Zea mays
  Clone ID: LIB3068-030-Q1-K1-D3
agaagaaaggcatagcagcgggcagcggcatgggcaccagccccgtcatccctgcgacggtgctcttcgtcgctcttcttgtcgctgtctgcttcggcgccaccgtcgtcaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgacgactgccatgactgcgaggcgtcgacggccgacgactgctttgactgcggtgactttatcttaagcctgaccgagcccccgtctgcacacctaggccgtgggactgct

SEQ ID NO: 53549 - DNA, 315 bp, Zea mays
  Clone ID: LIB3068-030-Q1-K1-D4
cagtttcttgtgccgttgctgtagaaaccttgaagatatataaggaaaggaatattttaggacacgttaacaaaattgctccaaggttccaggagggaatcaaggccttctcaggaagcccaattgttggggagatacgcggtctgggactgatacttggaactgaatttgtcgacaacaaatctccaaatgatccatttccagctgaatggggtgttggttcgatatttggcgcggagtgcgagaagcgtgggatgctcatcagggtggctggggacagcatcatgctgtcacccccgctgatcatgacttcca

SEQ ID NO: 53550 - DNA, 367 bp, Zea mays
  Clone ID: LIB3068-030-Q1-K1-D6
cccacgcgtccgcaccagacgtcggccgagtcctggggtaccggccgcgccgtgtctcgtgatccgccgcgtccccggcggcggcacccaccgcgccggccagggagcgttcggcaacatgtgccgcggcgggcgcatgttcgcgcccaccaagatctggcgcaagtggcaccgccgcgtcaacatcaacctccgccgcgtcgccgtcgcctccgcgctcgccgccaccgccgtcccggccctggtccaggcgcgtggccaccgcatcgagactgtccccgagatgccccttgtcatttccgacttcgcggagtccattgagaagaccttccaggcgctcaagatccttaagcagatcggcgcccac

SEQ ID NO: 53551 - DNA, 341 bp, Zea mays
  Clone ID: LIB3068-030-Q1-K1-D7
acgagcagatgcacggcctgctcaagcaccaggactccccctacatcagagctattggattccgctacgtacgatacgttgcagaaccgaagacactttggacttggtatgaaccctatatcaaggatgacgaggagtttgcacctggatcaaatcgtaaagtgactacaatgggcgtttatgtgcgtgatctcctccttggtcagtactatttcgacagtctccttccacgagtgcctctcccaatcctccgacaggtcactagccaccttgagaagctaaagctttcaacaagcagtcaagaatgactggggattccaacaagcttgaatcaaatgata

SEQ ID NO: 53552 - DNA, 157 bp, Zea mays
  Clone ID: LIB3068-030-Q1-K1-E1
aacacgcgttcaatattagggtcaaaaattaataaaatagctaaccactgcaacgggacgtgcaaattccgaatatcagctgtaatgcaactacacaggtcaactacaccgattctgactttaccgtggataatatactggatataactgactctgt

SEQ ID NO: 53553 - DNA, 401 bp, Zea mays
  Clone ID: LIB3068-030-Q1-K1-E11
cccacgcgtccgcagctgacctgtatgaaaggttctgcgctccggttggcagcctgttgggggccggcgaggctgcctgcattgaccactccggatcggtgcacggagcttactcgtcaggcatcgctgccgcagaggactgccgaaggcgtctgtcggcgcagctaggcatctcggccggcctgttccaggtcgggaaggctgccatgagggaggagatgacggctgaagccatggtccccttccagatattcaggctgtgagagagaatctattcaacaccgtctttgtgtcaccggtttgttgcttgatgtaattgtaaaatggtgtaagaccttgtttgctggaatattcgatggtggatgctgattatcgtcaggtaaacaacccaaaaatttgtt

SEQ ID NO: 53554 - DNA, 438 bp, Zea mays
  Clone ID: LIB3068-030-Q1-K1-E2
cggacgcgtgggcggacgcgtggggccgttgccgcagccgctgcttttcgttcgtcttcgtcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacttgcgttaatcacgagacatgaatggttgat

SEQ ID NO: 53555 - DNA, 338 bp, Zea mays
  Clone ID: LIB3068-030-Q1-K1-E6
caacgagaaggtgcaggacctgcttctgctggacgtcactcctctctctctgggtctggagactgccggaggagtgatgaccgtccttatcccgaggaacaccaccatccccaccaagaaggagcaggtgttctccacctactcggacaaccagcctggtgtgttgatccaggtgtacgagggtgagaggacccggacccgcgacaacaacctgcttgggaagttcgagctctccggcatcccaccggctcctcgtggtgtcccccagatcacggtctgctttgacatcgacgcccacggcattctgaacgtgtctgccgaggacaagacgacggggc

SEQ ID NO: 53556 - DNA, 70 bp, Zea mays
  Clone ID: LIB3068-030-Q1-K1-E8
taccggtaccaaatactaacaaactatttaaacaacccttccactaaaagacatcattgatgctaatgta

SEQ ID NO: 53557 - DNA, 342 bp, Zea mays
  Clone ID: LIB3068-030-Q1-K1-E9
ggtgggttggcttctcctccccctccggttcgggttcgggttcgtgaggttctccggggtgcggtttcgtgggtgagcggatcgagatggcggcgtcagatgttgagtaccgctgcttcgtcggcggcctcgcctgggccacggacgaccactccctccacaacgccttcagcacctactgcgaggtcctcgagtccaagatcatcctcgatcgggagacgcagaggtccctcggcttcggcttcgtcaccttctccactgatgaggctatgcggaacgccatctagggcatgaactgcatggagctggacggtcgtaacatcaccgtcaactaagcccatt

SEQ ID NO: 53558 - DNA, 190 bp, Zea mays
  Clone ID: LIB3068-030-Q1-K1-F1
aaaaaacatacaaaataatacagaaaataaaaattaaacaataacaataaacatacataagattacgttagaataagaagatgtatatgtaaataaaaaaaaaaaaaaataaaaaaaaaaaaaaaaaaaaaaaaaaaaaaaaaaaaaaaaaaaaaaaaaaaaaaaacattaaaaaatacacaatttaata

SEQ ID NO: 53559 - DNA, 237 bp, Zea mays
  Clone ID: LIB3068-030-Q1-K1-F12
tcgcccactcgtccgtccacgcgtccggatagttagagagagagagagacaggatcgatcgagagacggtcatgtccttttggctgtttggtttattcatatcacaacttttgagtgtatacaagattatttatgtggcaaacctcaaagattgtaaggcgatacatgccgaaaaaaaaaaaccttgcggagttaggatattcacggttttaatgttcgtttgaaccttgtttttca

SEQ ID NO: 53560 - DNA, 433 bp, Zea mays
  Clone ID: LIB3068-030-Q1-K1-F2
ccagaagacaaggaaagagaaagagctgttaataaggttagtaagaagcctaacagggggggcaataatataccaggtttcacgagtgcaggtgtgagattggcagcctttcctgggcctggtgtgaagaaagtgaaaaagattgtcatcaagaagattgttaggaagattggtgccaaagataaacaaactagtagttcaaccgtcccagaaaaggacatcattgatgctaatgtaaatgcctctgaaaaagaagaagctaatgcaaatgtttctgagaaagaagaaagtgagatcacaacatcatcttttgagaaggatgctatttctgcacacaatttggtcagtactagtgatacagctggagttgttaacagtgtggaggtccaaaaggaacaaaatagtgatttggtaaatctgaagaaaacaatgc

SEQ ID NO: 53561 - DNA, 244 bp, Zea mays
  Clone ID: LIB3068-030-Q1-K1-F3
gacagtctctctgcatgtgtccgtgcgtgtcagagtgtgtgtcagaactatagcagtggcggttgcgtactgcgagtgacatgggctcaattaagagatcgtcatctggtctggtggctgtagtggtgctcgttgccccatgtgtgccgctgaagattgtgtctatgattggcttcatatactatgactatctactctcatgtatagcagaatgggtcctggtatatcaagcatgttacagtct

SEQ ID NO: 53562 - DNA, 203 bp, Zea mays
  Clone ID: LIB3068-030-Q1-K1-F4
catcctatcttgaaatatttcatctcatctcaatctgatctagatcccacctaatctaacatttaaccttcataatgctttccacattaaattcattataccataatactattaacatatcttaccctaaataaatacctttttactaacccagtccataaacatctatccaaacctaacatcatttgtcatctttatctcat

SEQ ID NO: 53563 - DNA, 307 bp, Zea mays
  Clone ID: LIB3068-030-Q1-K1-D1
tcgctcacacattacagtcatgcatgtgcaactttgaactaattcaaactggacaactgctatgggctcatataatctgatataggatgactgatcgtacctgatactcttattaccggcgacatattagagctaatacttgcataacaccttgacatgcttgaagagcgcattaacttgataaatagctgacacggactatgaccgctcaattgatgatacataatcacttaaccgatcgcaaggtctacggacacgagacgcatcatacatatctctagcctatcaactttagatagtaacattg

SEQ ID NO: 53564 - DNA, 400 bp, Zea mays
  unsure at all n locations
  Clone ID: LIB3068-030-Q1-K1-F6
gaatttcccgggtgcgacgccacgtcgtctcggctcaaccttangtattattccacaccttaaaatatttattatgtcttagtacatgatctccatctnntatcttagagaagaggtctnnnctcttanntcttaagtgngatggtcgatcttaaatcttgaatnnaatatttctatcttaatttcaaattctgatcctttagatcccactctatatctatacccatgtaagttatgatatatgcctggtcgacataaataaaatattagtgcccatttaattctatataaccatnnntcttatccctaaattaataccctttggacttaatcccgtcccataatacaacataccctaactctacattccataggtttggtctaaatccaattttgtttc

SEQ ID NO: 53565 - DNA, 241 bp, Zea mays
  Clone ID: LIB3068-030-Q1-K1-G1
gcatgcgtacaacgtcgtctaacgcatcgtaaactcatgtgctccccctggcaccgactggttctagagaaatgatgtcattctcttcaatgctgctaaagggggactcaacactgtcttaaaatgacggtagacgtgtctaggtcagtaataagagtgtgtaaaatctgaatgagatacgaatacctctgcaatgatgaaaatctaatgatgcgcgtatctcattagataacaaggcggt

SEQ ID NO: 53566 - DNA, 347 bp, Zea mays
  Clone ID: LIB3068-030-Q1-K1-A12
acgcccacgcgtccgcccacgcgtccggtgcgacaagctcatcatggactccatcaacaggaggtacgtctacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcataacatgaggaaggagcaggggaaaccgtgtgacagacccaacatcgtcaccggtgccaacgttcaagtctgctgggagaagtttgcaaggtattttgaggtggagc

SEQ ID NO: 53567 - DNA, 353 bp, Zea mays
  Clone ID: LIB3068-030-Q1-K1-A2
cgcgtccggtaggaagataaaccggccttaccttctgttgctccagaaccagaaccggaacaagtgcgtgagccagaacccgagcgcagtgaaagaggaagcaccagaagctgaaccggatttgctgggtctgaacgaaccgaaccctgctgcaactgcgatagaagagcagaatgctttggcgctagctattgttccgatagatgatgctccgaaagctgctcccacttttggaaatggagtcactgtctgggaacttgcccttgtgacagcaccaagttcaaatgagacctccgttgccccaagcaagatactggccggtggtcttggacttgctgactcttgacagcctg

SEQ ID NO: 53568 - DNA, 72 bp, Zea mays
  Clone ID: LIB3068-030-Q1-K1-A3
aaaaaaaaaaaaacaaaaaaaaaaataaaataaataaaaaaaaaaaaaaaaaaaaaagaaagggggcctaaa

SEQ ID NO: 53569 - DNA, 375 bp, Zea mays
  Clone ID: LIB3068-030-Q1-K1-A4
cggacacgtgggaccaggctgacctcgcgcagatcacgaaccactgcctcaacaagggcgtgaccctgaaccacagccactgacatatgaatcaccagaaactgaaccgaattcgctgtatctgaactaaccaggctctattgcaactgcaatagaataccagaatgctttggcactagctattgaatcgattgattatgctccgaaagctgctaccacttttggaaatggactcactgcctgccaactggcccttgtgacagcaccaacctcacatgagaccgccgttgccccaagcacgatactggccttaactctgcacttgctgactcttgacagcctgcactactaggctaaccgtacagcgagccagcc

SEQ ID NO: 53570 - DNA, 350 bp, Zea mays
  Clone ID: LIB3068-030-Q1-K1-A5
gtcgctgcatctggccgctcgaagcgggatcctgtactgcatccggaaactgctcgcctggggcgcggatcgtctccagagggactcagcagggaggattccttacgccgtggcgctgaagcgcaaccacggggcgtgcgcggcgctgctgaacccgtcggcggcggagcccatggtgtggccttccccgctcaagttcatcagcgagctggacccggaggcgaaggctctcctggaagcggcactgatggacgccaatagggagagggaggagaagatcctcaagggcatcaccaagtatccgcaggcatcgcctacttcgccttgcgagcacgatgccattgacgaag

SEQ ID NO: 53571 - DNA, 430 bp, Zea mays
  unsure at all n locations
  Clone ID: LIB3068-030-Q1-K1-A6
gccaggaacaccttgccggcctgggtgctgaggaacacgcgggcggacccgtccgggtgcgccggcatgttgaggtaggagccgttgccgacgcgctccaggaacatgctgcggagcggcagcgccgccgggcgggtggagttgaacgccgcgccgccgccgtccaggcacggcgacctgccggcgccgcccagcgagccgcagaactcgcccgcggactgccacagggtaacggatgtagagacgacgtgagtatcactggtttaatcatagacgttaccttgtaatggcgtgatcatgttcattttggagtgtgggtagtcccctagttttttataacagcgaatctctcgtctacgcctccaaatcgtcgaagccgcacctaatgacctncataatggcaaatttctctctatcagtggagcaacca

SEQ ID NO: 53572 - DNA, 401 bp, Zea mays
  Clone ID: LIB3068-030-Q1-K1-A7
gggcgtcatcgctatccgcccgcgggcgctacccctaccctattgagggtggtgtccttggacctggtcaccacaatgcgagaaccctcgcctcggccttcttggggtctttcgctggtgctcgtccgatgttggggctctgaaggttggggctgctgggttggtgggtcggcggacgacatgaggtcttcggaggaaactttgcttggttggtaccaggcgagcggcgacgacttttcgatgtcgtctctccttcttgaaggcgcggcccaaaagacctctagtttgtgtgttcgtcggcgttgtggaggctctttgtcactccgcttggctcggtggtgtctgggtcattgtcgctttaagcgtctgcttggctcccaagttcggcgttgtggatcttt

SEQ ID NO: 53573 - DNA, 143 bp, Zea mays
  Clone ID: LIB3068-030-Q1-K1-A9
tctaccatgcttacctctctcttatccagaaccacatccacaacaagggcgggtcccttaaccccaactgggggcatattaatcaccagaaactgaaacgaattcaatctatctcaacgaacctaactctattacaacttcaa

SEQ ID NO: 53574 - DNA, 391 bp, Zea mays
  Clone ID: LIB3068-030-Q1-K1-B1
cggacgcgtggtactaaaccaatgcgatctctacccattgctgtgaatgtcaaaggcaaggactaaaatcaatcacgggtaaacaatacaatagatactataactatatataaagaaacactaatcctgagggtctaattatttacagcacctgattttatttacgagattttcactgaccctatttactatatagctacacctaagttcaatgtaacggccttggtttaatcagctcggaatgaagaaactcttgagcttgcctatattactactttgtgaaatgactccctttgtgtaggttgacttataacctaaaggcccaagtcaaataccactacctataacgttatcatacttattgccaatggcgacagcccttcacccgccc

SEQ ID NO: 53575 - DNA, 384 bp, Zea mays
  Clone ID: LIB3068-030-Q1-K1-B12
cgggccgacccacgcgtacgcacacgcgttcgaccacgcgtccgtccactcttccggcaaccggtccaacactttgacgcgcagcttcagcaatggctgcctccaccatggcgatctcctccactgcgatggccggcacccccatcaaggtgggttccttcggcgagggccgcatcaccatgcgcatgaccgtgtgcaagcccaaggtcgctgcgtccggcagcccctggtactgtccctaccgcgtcaagtacctgtgccccttctacggctagccccctagctacctgaccggcgagttccccggcgactactgctgggacaccgtcaggctgtccgcctaccccgagacattcgtcaagaacctgcagctgtaggtgatcc

SEQ ID NO: 53576 - DNA, 73 bp, Zea mays
  Clone ID: LIB3068-030-Q1-K1-B4
cggacgcgtgggcggacgcgtgggcggactcttgggtcgatgtcggctcttccagcaccggagtctatatcgc

SEQ ID NO: 53577 - DNA, 421 bp, Zea mays
  Clone ID: LIB3068-030-Q1-K1-B6
cggacgcgtgggccggccaccgccaccctcgatcacgccgtccgtcgaggtaaggtcagggtggggagggtcagtgtgctcaacgatgcgctcaagtccatgtacaacgctgagaagattggcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcatcagccctcgctttgatattggcgtgaaagacatcgagggatggactgcaaggctgctcccgtccaggcagttcggatacatcgtcctcacgacttctgcaggcatcatggaccacgaggaggcccgccggaagagcg

SEQ ID NO: 53578 - DNA, 435 bp, Zea mays
  Clone ID: LIB3068-030-Q1-K1-B7
cccacgcgtccgcccacgcgtccgactactcatccgtcgccccacggaagtttcggcggcgccggcgtgctcgtgatctcaaccaaggcgtgtctccgctccggtcacccgtcactccacgcaaacatgtcgaggaggaagaccagggagccaaaggaggagaacgtcacccttggacccactgtccgtgaaggagagtatgtctttggtgttgctcacatctttgcatccttcaatgacactttcattcatatcaccgatttgtctgggagggaaactctggttcggatcaccggtggcatgaaagtgaaggctgaccgtgacgagtcgtcaccttacgctgctatgcttgctgctcaagacgtcgcacagcgctgcaaggagcttggcattactgcactgcacattaagcttcgtgccaccggaggcaacaag

SEQ ID NO: 53579 - DNA, 366 bp, Zea mays
  Clone ID: LIB3068-030-Q1-K1-B8
acgcccacgcgtccgcccacgcgtccgactacttatctttcgccccacggaagtttcgtcagggccggcgtgctcttgatctcaaccaaggcgtgtctccgctccggtcacccgtcactccacgcaaacatgtataggatgaagaccatcgagccaaaggacgagaacgtcacccttggacccactgtccgtgaaggagactatgtctatggtgttgctcacatctttgcatccttcaatgacactttcattcatattacccatttgtctgtgatggaaactctgcttcggatcaaccttggcatgaaagtgaaagcttatctttacctagacttcaacttacgcttgctattcttgctgcttaat

SEQ ID NO: 53580 - DNA, 431 bp, Zea mays
  Clone ID: LIB3068-030-Q1-K1-C1
cagacacgtgggctcgccagtggctggcatcattgcgttcaatgcgctcctcgtggtagggctcctgctcgccgtcaccttcctcgacgcctccgctaacgagcaagcccaggcggtcatagaggagaagaaggcggaggtccaagactggcacggcggcggcggctacccggggcacggctgcggcagcagcggaggctaccctgggcacggcggcggcggctgcagcggctacccgcactgccggtggggctgctgcaaccgcgggtaccatggcagctgccggtgctgctcgcaccctgatcagataccagagcccatgtaccgtcctgagctcgtcgaggtccacaactaaatagtaatgagatgcgctgctactatatatacgggtacgtatgccctatgggaaacagagcacacgcgtagtacgc

SEQ ID NO: 53581 - DNA, 56 bp, Zea mays
  Clone ID: LIB3068-030-Q1-K1-C11
cggactcgtgggaaaaaacaaaaaaaaaatttaaaaaaaaactcaactaaaaacac

SEQ ID NO: 53582 - DNA, 330 bp, Zea mays
  Clone ID: LIB3068-030-Q1-K1-A10
tcgccactcgttcgggcaccaccaacgacgactaatacggccgtggcaccggctgcgggtagggcagcaagccctctggcgacgactcgtacgccggcggcggctgtggcgggtacggcaagcagtccggtggaggcgcggacgacgactgagagtacggctcctcccggtacgactcggagaagtacaggaaggaggagaaggagcacaagcacaaggagcacctcggcgagatgggctcccttgccgccggcgccttcgccctgtacgagaggcactaggcgaagaaggacccgtagcacgcgcagcggcacatgatcgaggagggct

SEQ ID NO: 53583 - DNA, 443 bp, Zea mays
  Clone ID: LIB3068-030-Q1-K1-C12
cccacgcgtccggcggacgacgacccatgggtatcctatccaggggcaatcgaatatagagtttcttgtggcgtggccaagggcggtgccgagcctgtaccagtacgacgactcaggccagaacacacggcgtatggtatggtacacagcaaggccgtgttgttgctgtaagttttgtaatttctgtttccttcttctcggcttcgcagcatgcagttgctgtatatgatggaagaacactctgttactgggcatgttgcgcggtttccacgcgtgtaagtaatgtagaagtcgctatggtaggtatttccataccgtcattagtggatcattgaatttttttgtaagaaggttattgcaatgccctttttccgggcatgaataagaaaaaggaaatatgcttatatgcatggtattaataaaaaaaaaaaaaaaaagggcgg

SEQ ID NO: 53584 - DNA, 325 bp, Zea mays
  Clone ID: LIB3068-030-Q1-K1-C3
tctaatcttaatatctcctactactaccattatctgcaccaacgggctcttcgggggagcgctcctgctcgccgttgccttgctcgccgcctcctcttactaataagcccatgcggccatacaagataagaaggcgtaggtccaacactggcacggcatccactgctacccctagcacagctgccacgacagctgatgctaacttgagcacggatgttgccgttgatgatgatacccgtactgtcggtgtggctgctgcaaccgcgggtaccatgacgtctgcctgagctgctcccacccttatcagattccagatcatatgtac

SEQ ID NO: 53585 - DNA, 255 bp, Zea mays
  unsure at all n locations
  Clone ID: LIB3068-030-Q1-K1-C4
cctctcggcatgaacccgagttgccagggttaggcaggtgccgttaacgcatgaaacagataaccttctttcccgaggctccaccgctcggctgttcttccggacccttcctaatcgnntcgccgtcttggccgccacagtcccaggcttcgtggagaactcttaatccnncgattcccttcttcgggtgaccgcgcccgtgatcgcgtctanntctgctcgggtttctccctcgtcccctttagggaaatcggc

SEQ ID NO: 53586 - DNA, 135 bp, Zea mays
  Clone ID: LIB3068-030-Q1-K1-C5
aaaaaaaaaaaaaaaaaaaaaaaaaaaaaataaaattcaaacaatcaaaaaaaaaccaaagggacaggctcaaacatacaaaaaactaaacactactataatatcaccataatatcaattcacttctcgcctttt

SEQ ID NO: 53587 - DNA, 451 bp, Zea mays
  Clone ID: LIB3068-035-Q1-K1-B11
cctgactctgcttggcatcataggaataaaggacccctgtcgcccaggtgtaagggatggggtacgcctgtgcactactgctggtgttaaggtgcgcatggttacaggagataatattgaaacagctaaagctatagctctggagtgtggaatactagatgcaaatagtgttatttcagagccagttgtaatcgagggaaaagtgttccgcgagatgtctgaaagtgcaagaggagaggccgcctacatgataattgtgatggggagatcctcgccaaatgataaacttttgcttgtccaagctttaaaacgaaaaggccatgttgtaactgttactggtgatggcacaaatgatgcccctgcattgcacgagggccgctatatgtctttcaatgggcatttcaaggacagatgttgctaaagaaagctctgacattataatcttggatga

SEQ ID NO: 53588 - DNA, 418 bp, Zea mays
  Clone ID: LIB3068-035-Q1-K1-B2
cggacgcgtgggcggactcttgggctgactcgtgggctgcaaaggattcagcacgccgcgggttgcgaagggagcttctaggcagccctacaccacacgtcaatcgggctggctgagacaatggcacagactcttggcggcgcgaacgcgactaactgatcctcccgccggcggccagcagatgctctggctgctagcatgcaaccttacttagacgcggcaacacattatacagctcaacatatcctagaccctctagatcaaatacatactccgaaatcacatatgtaaggatgaactactgcctcttatactaggggctatgactatagaatggcgatcattaggccattaaacatgacttgcttgacaacattctaaatgaagatctcgtcatcttaatgcaagagatcgatct

SEQ ID NO: 53589 - DNA, 451 bp, Zea mays
  Clone ID: LIB3068-035-Q1-K1-B3
cccacgcgtccgcagttgtcatagtagtgctgctctacttgatcatttctgctttctgtggaggcctttcgttgtcatcatgcagatcatgagtaacacaccagatggctttgcccctcccttaaatggagggtagaacaccatggaatgatgcctgctgtgttgagcaccggagcttccggaggcaaaaaaaaaaaggagatcgatggataccactgtggtttccagtaacttggatcagtttgtacagtggacgagtggagttggccgttgctgtttttgatgtcgccatggttgtgggtgaactcaaaccttaaatcgtggtgtgcttagcatctttcttggcgtgtcaaactgtcgttgtgacttgtgagggatgggactagtgagttgggttttgtagagttacttggttatcaatgtgcagacatatatgtatgccgcgatgagt

SEQ ID NO: 53590 - DNA, 443 bp, Zea mays
  Clone ID: LIB3068-035-Q1-K1-B4
cccacgcgtccgggaacagtagttgcaaaatcaagggatgattctgagcctcctttgctgattacttgcgaaggacttgaatatgtagcgataagcaggcctctaccaattatacgtgggcgagcactatttaaactcaagatatctcagctctcttccaaatgtgacaataagctcttccgtattaaattctctacacttcacatgcaaagatattcttttctggaagcatattccaaaccgattcgctgtatatctcgaagccgcactgtccgccccttgggtcctacaaagcgggcgagttctgcaacagcaaatgaaattgacatgctcagtaatggccaaaggtttgttagtactgacaaagtaaatagtcgtggacattcagtgtgtctgcatacgcccatgtttcccaagatagaagatggaatggtggaagtagt

SEQ ID NO: 53591 - DNA, 389 bp, Zea mays
  unsure at all n locations
  Clone ID: LIB3068-035-Q1-K1-B7
ctgactcttggtcaaactcttagactgactcatgtacgcacacgtgggcggactttcgggtggattantcaagaacaaaataactcacaaaattaacattaacactagatgcaataacaccctaaaatatgactgaatcgattcctgataagaaattcatccttaatatctcgaatcatgacttataagcatactgaaattatccattatacttatgattctctccaatgactttgcaacgtagatcaatgaacttgtccctgaataaatattatatctacaactatgttcatttactatcacctaaaattcatcatcgctcataatctaacctgtctcataaaattttgacctaacttacattccatattactagtttaactgtctat

SEQ ID NO: 53592 - DNA, 403 bp, Zea mays
  Clone ID: LIB3068-035-Q1-K1-B8
cacactcgtgtgcaaacacttagcatgactcttatcctgactcgctggctaactcctaagcactctcatatgtaacgatcaacactcctctaccaatcatacctttgcgaccactatttaatctcaagatatctcaactctcttccaaatgtgacaataatctcttccgtattaaattctctacacttcacatgcaaagatattcttttctggaatcatattccaaacctattcactgtatatcttgaaccctcactttactcaccttgggtcctacaaactcggtctaattattcaacagcaaatgaaattgacatgctcaatactgaccaatgttttgatagtactgacccagttaatattccctgacattcagtgtatctgcatacgcccatgtttccca

SEQ ID NO: 53593 - DNA, 349 bp, Zea mays
  Clone ID: LIB3068-035-Q1-K1-B9
gcggcacgccttccgccattcacttcgcctattacaacggggtttcagccatcttcaataacaggagctgctagagctaattgaccctttgttcctccacaaaacctactaagagcaaatccttagattgggtggaaaggttcatcaactactagtgcatttcgtcctgctgaaccaaggaagatttcggagattcctgctgctgcacgctacattacagtatctcatgctgctgggaagcattctcttaccacgcttggttttgatttgaatgttgcctatgaccaatctctctaggaagatatcccacagagttctgcacatactacctgctctgaatctggaaata

SEQ ID NO: 53594 - DNA, 402 bp, Zea mays
  Clone ID: LIB3068-035-Q1-K1-C1
cccacgcgtccgcccacgcgtccgcccacgcgtccgcccacgcgtccgatttggaggccgtggggggtcccttgcgaccggttctggtcgatttctcgggcagctccagctgaattcaagatgccgctgtgacccaccgctgcctggtttcttggaggaaggaaattttgcttcaattgggcgtcgttgagctagacccctcctccagctcttgatccggtccatggggctctgccatggcaagccgacgcaaatcccggaggctgaggcggaggaggatccccacgtagcctccggcgcgggcgacggcggggacggggcgacctcgccgtcggcggcggcgcccgcggcgaagccaggcacgccgaaacagcccaagttcccgttctacctgccgagccc

SEQ ID NO: 53595 - DNA, 312 bp, Zea mays
  Clone ID: LIB3068-035-Q1-K1-C10
cccacgcgttcgaggaaggggaggtacggtccggagacagcagcgaggagcgcggtgccggttcccgctgcggcagcgaaggcggcggcatcctggagggtgtatgaacgccacgaggacgaggacgaggaccagggcggtcgcgctgctgggccccagggcacgaggagtgcaacgaacaggagaaccgcatggagggagaagaggtaggggagtgtgaagagggggtgcggacgtaatgcggcggaggaagcggctgtggacgacactgggagagagtctatccgagtccgcggattgtggtgcgatcga

SEQ ID NO: 53596 - DNA, 447 bp, Zea mays
  Clone ID: LIB3068-035-Q1-K1-C11
cggacgcgtgggcagctcatcatcacattcgcatacatctcttctagcacgcaaagatcgagctataggtagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttgggccgccggtgaagtcgtaccggaagagctgcttccagcaggccagcagcaagcaggcggcagcggccaaac

SEQ ID NO: 53597 - DNA, 441 bp, Zea mays
  unsure at all n locations
  Clone ID: LIB3068-035-Q1-K1-C12
tcgcccacgcgtccgctctggaggcattacttccagaacacacagggtcttaggtttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagtttggattacactccctgcggcagcgacactggtacatccagagcacttgtgccacaactggcgagggtctgtacgaaggcctggactggctgtccagcaacattgcgagcaaggcttgaatatcaaatgcgaactgactaggagctccggatgtatcaatggaaacttaagacagaatcgcctctacaacctgttaggtgtcttctaccggcacaatatattntttg

SEQ ID NO: 53598 - DNA, 390 bp, Zea mays
  Clone ID: LIB3068-035-Q1-K1-C2
cggacgcgtgggcggacgcgtgggcggacgcgtgggaaaaaaaaaaaaaaaaaaaaaacggaaaaaaaaaaagagaaaaaaaaaaaaaacaatataaaaaaccacaaacaaataaaaacgaccatccatctaaaaacccctactttacggccccctacattcaatacactaaccttcattttgcccacctaaactagtacactcccccacttttccaacctaatcaccttgcaaaaccttcccctttccccacttattccccttgctaaaaatccccctttttccaacttccccaacagctccaaagtctgaaccgacagtgcttcccaccctttccccagccttaatgcccaataaaacccccccttaaacgcacctttaaacctgcac

SEQ ID NO: 53599 - DNA, 441 bp, Zea mays
  Clone ID: LIB3068-035-Q1-K1-C5
gtgtgtgtgtgtgtgtgtgtgtgtctgcgtgcagggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggacggcatcgactacgccgtcgtcaccgtgcagctcccggggggcgagcgcgtgccgttcctcttcaccgtcaagca

SEQ ID NO: 53600 - DNA, 445 bp, Zea mays
  Clone ID: LIB3068-035-Q1-K1-C6
tgcagcgtcacaagcaaaccgaagctagtcagtcacacacagctctgcagcttccatccgcaaagaagaaggaaacaagctaaccatgatgatgagcgccaagaagattgctcatctcgccaagaaatggcagaggatggccgcgcaagggaggaagcgcctcaccttgggggcggcggcggcaaaggaagtcgacgagtgctgcggctctgtggcgagcaagggccattgtgcggtgtacacggccgacggggcacggttcgaggtgccgctggcctgccttagcacccctgtcttcagggagctcctgcagatgtcacaggaggagttcggcttcgctggcggcgatggcactggcaggatcacgctggcctgcgacgcggcggtcatggagtacgccatgtgtttgctcaggagaggagcctctgccgagctagagcaggcg

SEQ ID NO: 53601 - DNA, 435 bp, Zea mays
  Clone ID: LIB3068-035-Q1-K1-C8
cccacgcgtccgcccacgcgtccgcggacgcgtgggctggatcgctatctcttttctagggcccagggaaagctagctagctcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcaggggggaagaaagaggtggaacaacgcccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgc

SEQ ID NO: 53602 - DNA, 378 bp, Zea mays
  Clone ID: LIB3068-035-Q1-K1-B1
cggactcgtgtgaaaaacaaaaaaaaaaactaaaacaaaaaataaaaaaaaaaaaaaaaaggaaacaatcatgggagaaccaaacttacaaactcttacctacttcattaactactaccttatccaaccacctatatcttacttaccttacctccattatccacattatggactttgacttcccttaccttacccaatttattcgcttatacactatcaccctttatgatttcttgaatgacaacatctagtcccacacctaacaaccatccaaccatatccacgacatagaccttcattctcaccagaccatgtatgctccattacttcctctcgctttgccggctccgcccatgcctgacatatctcttcctacac

SEQ ID NO: 53603 - DNA, 423 bp, Zea mays
  Clone ID: LIB3068-034-Q1-K1-G5
gtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaggtcctcgagcgccttcccgacggcggcgccgacagccacgtctcctacacgcaggaccgctacgtcttccacgccaagcgcaccgacggcatcaccgcgctctgcatggccgacgacgcctccagaagacggattcccttcgcatttttggaggatattcatggaaggtttgtcaagacatatggccgggctgcgctaaccgctcttgcatatgcaatgaatgatgaattctcaagggtcttgagc

SEQ ID NO: 53604 - DNA, 411 bp, Zea mays
  Clone ID: LIB3068-034-Q1-K1-G6
ctaggcgagagcacgcactgctggcggcgcggctaagaccgagagccgccgcgcacattattgttcgcgcgaggccagccgccggttgcattgcatggcgcagctgccgcccaggatcccgaccgaggtgcaccactggcccgaggggggccagcacggcgcggcggcggcggcgtgggcggacgacttcgccgagttcgcggcggcgcggcggggcgcgcaccgcaggtcgctcagcgactcggtcgccttcgtcgaggtggcgccggccgacggcggggccggcgagttcgacaggctcgacgacgaccagctcctgtccatgttcccacccgacgaggccggcggcagcggcggcggcggcgggtcgtctgcggccgggtccgagaacggcggcagcagcgacagcga

SEQ ID NO: 53605 - DNA, 386 bp, Zea mays
  Clone ID: LIB3068-034-Q1-K1-G7
cccacgcgtacgatccaaggccctggccatcgtcgagaaagttgcagatgaacctgctggcgagaagcctgcccctgcgaagcaagggggctccaatgaccgggatctcgctcttgcaagggtggaaacagagaacaggaactctttgatcaaagcttgggaagagaatgagaagacaaaagctgacaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtg

SEQ ID NO: 53606 - DNA, 285 bp, Zea mays
  Clone ID: LIB3068-034-Q1-K1-G8
cccacgcgtccgctcacgcgtcctaaacaaaaaaaaaaaaaaaaaaaaaaaaaagggctgcctatatgcctgatcctgagtaacaagggcgctcctacgacatagatcttggtctatcaagggagctaacacaaattcactaactctttgatcaacaacttgtgaagagaataaaacgacaccatctcacaactaagttgctttgaaagtattcgctattctttcatgtgacatcacagagaaagcactcattcaagatgaactgaagaacatttatgaacaact

SEQ ID NO: 53607 - DNA, 393 bp, Zea mays
  unsure at all n locations
  Clone ID: LIB3068-034-Q1-K1-G9
ctagggtttttgattttagccgccgccgctgctcatctcacatccctcgagaagacgcgtgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgangatgatgatgaccttgatctttttggtgatgaaa

SEQ ID NO: 53608 - DNA, 385 bp, Zea mays
  Clone ID: LIB3068-034-Q1-K1-H10
cccacgcgtccgcccacgcgtccggcgatatgtatccacggatagcttatgatcagattaggcccatgccaccccttaggtctgctggttcctcgagacctcaaagttttattacaagagatgctcctgacacgtcaaggagccaaccatatgctggcaaatccaccatttctattgatacagtacagaggactaatggaatcactccatctactgcagctctgcctaaggcccctgttatggatgaagccccgcttacagttactggattgctgaactcgttgggtcttgagaagtatgttgttctttttcaggctgaggaagtggatttgtctgcattgaagcaaatgggagagagcgacctcaaagacatgggggtaccaat

SEQ ID NO: 53609 - DNA, 425 bp, Zea mays
  Clone ID: LIB3068-034-Q1-K1-H11
tgcttctacgagaggatatagagaggaagaacagctcgtccgagaccatgaagagcagcccgcacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttcgttctttcggcggcggcccgtgcat

SEQ ID NO: 53610 - DNA, 421 bp, Zea mays
  Clone ID: LIB3068-034-Q1-K1-H12
ggagcacaagcacaaggagcacctcggcgagatgggcgcccttgccgccggcgccttggccgtgtacgagaggcacgaggcgaagaaggacccggagcacgcgcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgt

SEQ ID NO: 53611 - DNA, 302 bp, Zea mays
  Clone ID: LIB3068-034-Q1-K1-H3
tcccactcgtccgtccactctttcgcacactcgttctctcgtccggtcgaaatgaagctgagaggctttcctcctcggcgggtagatcttcctgacttacccaactacacagatcctaatgtctctaacacccttacgtccatctaggccgtcctctagcatatgctccagttgctatcttgcattctattttacaggcttactgttattaactctcacacttgttcttctttcctatgtctcttcaactattacttatgacaaacctattaaatcatctgttactctcgtactataatcaa

SEQ ID NO: 53612 - DNA, 425 bp, Zea mays
  unsure at all n locations
  Clone ID: LIB3068-034-Q1-K1-H4
cccacgcgtccgcccacgcgtccgcagctgtcgatccaattgtcacttgctctccctccgacgggctaattaaggccggtgcatccctcttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgtcacaagatcgangatgaggtcgcgggcggcgcggccgtc

SEQ ID NO: 53613 - DNA, 381 bp, Zea mays
  Clone ID: LIB3068-034-Q1-K1-H6
cccactcatactcacatacactgatatccttaactgcctcatgagataggtctagggggggtgcttatctcaggggactggcgatgtatacaatcatacctatccatccgaccaagctggtgacgttgcaatctcttacgacacaatcgtgaaggtgattcacatcgcttacacattacaggtacaggagcaacctgctttcgacccagagtcaatgtgatattacataaaaagatacatcatgaatttgactgctgagtgctacacttatactgcacatgtcatgtcattggacatcgtcggtctaaactaatgcttaactagcaagctgttggaccttgaatccgtcgatcccgatagcttgaatgacgatacgctcga

SEQ ID NO: 53614 - DNA, 392 bp, Zea mays
  Clone ID: LIB3068-034-Q1-K1-H7
cccactcgtccgcccacgcgtccgagaaaatgaaggatgacccgaaattcacctatgatgaaactgttcagattgcaatatctgcattgcaatcagttctccaggaagatttcaaggccactgagatcgaagttggtgttgtgagaaaagaagaacgtcttttcagagttctcacaacagaggagattgaccagcacctgacggcaattagtgaacgggactgagctgccatatgttggacatttgatccctacacactgcgccgtgccattgtgcttcagcactgccatttagtttgacatcaaatgaactgagtgtaccatttcatgtctaacactgaaaacaagctcgttgattgaatttggcacagtttggttttgcattgctaaaaa

SEQ ID NO: 53615 - DNA, 408 bp, Zea mays
  Clone ID: LIB3068-034-Q1-K1-H9
ctcacgctcggctctcaagcacgcgcttggccctgctcgcttcttgtcgcgcgcgcaggcttgttgctcgctcggcttcctacctctctcttcccatggccggcttccagacccggctgcactccatcgccggccagtcgctcgcccatgccgagctcctggcgccggatcccctgtgagctttctccgtcggccatggatgccggtgagcttatcccttggtgccgcgagctcgctgtagagttttaagcacgcttcttccctgctgcgcagctccctcagcgttcctcccgtgcttgcgctcgcccatggtggctccctgtgctcggcgctccagctcgtccggccgcggcctcgtcgaactgctttgccttccatggccgcgtcaagcttgggaccctgcttgct

SEQ ID NO: 53616 - DNA, 320 bp, Zea mays
  Clone ID: LIB3068-035-Q1-K1-A3
ccgacgcgttcggaagggttgtgtcctagccagccgtcaaagatgagctgctgatggtggggatgatgatgggaggccactgctaccctactacgtaccctcctctatgtgtgctggcatccgtccccgttagacgatcgaggcgagaataacgcatagctctctgctaccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcatgatatgcaaggt

SEQ ID NO: 53617 - DNA, 444 bp, Zea mays
  Clone ID: LIB3068-035-Q1-K1-A7
ctcacaatctggcgaccgtgaactgtcagaggacttgctcgtgtatttcattgagcagggtaagaaagaatgttttgcttcttgcctcttcatttgctacgacctgatccggccagatgtggctcttgagcttgcatggatgaacaacatggtggactttgccttcccgtacctgttgcagttcattcgtgaatacactagcaaggtggatgatttagtgaaggacaagatcgagtcgcagaaggaagaaagagccaaggagaaggaggagaaagaccttgtggctcagcagaacatgtatgcgcagctgcttcctctcgctttgccggcgccgccaatgcctggcatgggtggtcctccacctccgatgggtggaatgggcatgcctcccatgggcgggatgggtatgccgccgatgggccctggtccgatgccagcattcgg

SEQ ID NO: 53618 - DNA, 447 bp, Zea mays
  Clone ID: LIB3068-035-Q1-K1-A8
cccatcttcggtttctttcctccggacttcgggttcctgcttgcggcgtccgccaattcggttccctacccaaaccctagagcaaagctgaatggccctcgccacgagctcgcgagagactctgcgccgccgccggtgactgctgatccgcccgccgccgccgcgcccggtgctctgtcacgcaggaggcgacggtatggcgtcgaggcagcacaatgcacagttccacaaatccaagacgctcgacaacaaatacatgctcggagatgagatagggaagggggcgtacggccgcgtatacaaggggcttgacctggagaatggcgatttcgtggccatcaaacaggtctcgctggagaacattccgcaggaggatctcaacataataatgcaagagatcgaccttttgaaaaatcttaatcacaaaaatattgtcaagtatctggg

SEQ ID NO: 53619 - DNA, 425 bp, Zea mays
  Clone ID: LIB3068-034-Q1-K1-G4
cccacgcgtccggagaaactagttactcgatcactgtagtgatattattactgaactcggaataagcaatgtcgacaattgcgacatccctcggcctgctaatccgtccgccaagatcatcagctggtacgccgtcctttgggtctctcaaaccagtagtggtgactctcccttgcgctcctgctgagaagaagcggcctcgatccatctgttactctgtggatgccaaggctaacgaccatgccttcaacatctctcccgttgcccttgtgcatcccaacatgccgccaacgtcgacgccgcgatgggagatcaaggaagatggcaaggaagtcaggctgacattcttcaacttgtcggagggtgctacaacgggcgacttccaggttgccgtggaggacgatgtgctcatcatcaagagcacg

SEQ ID NO: 53620 - DNA, 411 bp, Zea mays
  Clone ID: LIB3068-034-Q1-K1-E1
tccacgcgttcgtccacgcgtccggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagcagaagaggctgggcatcctgagtgggatttgcctgatgatgctgggacgtacaatgacactcctgagaagacccagttctttgcggataacggaacataccagaccgacaaggggaagttcttcctcacatggtactcaaac

SEQ ID NO: 53621 - DNA, 348 bp, Zea mays
  unsure at all n locations
  Clone ID: LIB3068-034-Q1-K1-E10
ccacgcatgcgctctggggatcgatggcactagggcagttgttgccacccaaagaggattttacatgtgggaggagctatatcaaagcgactgacggatcccgaaattatgaaatatattgaaaaatctatgagcatgccangagttacaccagtatcctgagctgatgaagctgcgtgagaacgacatattccagatggtgtatttcccggtgataaatgaagcctgtcgagtccttgattagggtatcgccgtcaatgcttctgacctagacatcagttcaatctttggcatggggttcccaccttataggggaggtgtcatgcactgggcagattccatcggcgc

SEQ ID NO: 53622 - DNA, 330 bp, Zea mays
  Clone ID: LIB3068-034-Q1-K1-E2
aaaaaaaaaaaaaaaaaaaaaaaaaaaaaaaaaaaatatattacataaaaaaaactgacaggcaggtgtatactgattggatgaaaaaggtcgaccgatatcgaggacccacttttacgatccacgtgttgctacgcacaaattcgatgtataaaggcccctatattgaaaccaagttccaatgttttacacgtagttaaacatgaaaaccctggggaaacccaccttatttcccttgtaataaataccctttaaaacacttgttttaaaaactaaaagaccctcaacaatctcctttccaaacagtcttttcaacctgtttcgcaaatg

SEQ ID NO: 53623 - DNA, 396 bp, Zea mays
  Clone ID: LIB3068-034-Q1-K1-E4
aacacgcgtgcgtgcacacttccgtagtctacatcgctccatgatccaaaagctgctcgactggtacacctgatgcgggtgtgaatacaacgcgtcgtataccgagttctctcctaccgattttcaagggccgccttggcgcacagtacaccgctgcgatgtgcgatagctgttccagtcgatggaccctacctgcggctgaaccgactccagggttggcggaccgttaagcataaaagataactcttcccgaggccccagccagcgtatccatgatttctaacatcgtcagctgcattcacgtgccggctctggaaatctcaacgcgactccctttaagacgacgcgcgttatcgctctatgtgcacagtttacctacatcattaagatctgctt

SEQ ID NO: 53624 - DNA, 281 bp, Zea mays
  Clone ID: LIB3068-034-Q1-K1-E8
cccacgcgtccgcccactcgtccggacgatagagaaggagctcaaccggcgggcggcggagacggcgagcaagcagcagctggagggcatcaggaaggtggccaagctccaagctgagtgcaggaggctgcaggccgcggcacaacggagggcgtcctccgtgaacgtcgagctccggcgtcctcgaacctcggcctgcttcaagtggttaacggttggccagcggacctgttcgaactaagggccctggtccttgtgaacggacctgaccagttcaagaa

SEQ ID NO: 53625 - DNA, 396 bp, Zea mays
  Clone ID: LIB3068-034-Q1-K1-E9
ctctgatgatggagggcaatagggcaggtgaagccacccaaaaaggattttacaagtatgagggcaagaggaaagcgactcctgatcctgaaattatgaaatatattgaaaaatctaggagcatggcaggagttacaccagatcctgagctgatgaagctaagtgagaaagacatagtcgagatggtgtttttcccggtgataaatgaagcctgccgagtccttgatgagggtatcgccgtcaaggcttctgacctagacatcgcttcaatctttggcatggggttcccaccttataggggaggtgtcatgcactgggcagattccatcggcgcaaagtacatccatggaaagttggaggagtggacaaagcggtatgggggcttcttcaagccct

SEQ ID NO: 53626 - DNA, 282 bp, Zea mays
  Clone ID: LIB3068-034-Q1-K1-F1
cccactcgttcgaaaaaaaacataatatttatacaaaaaatactaaaataccaaatactagatgcgatccaatctaatgcggagcttgatgatcgcataactaaaactactatataccttccactacctctatgctaaaccagtaattccatcatataaagggctcctcatcacatctgggctccattttccatacgatcctcataatagcctgtccaccctattaccatgcccacttctcttatcttttcccctgtcttcaaaccatttgaacctcaaaat

SEQ ID NO: 53627 - DNA, 215 bp, Zea mays
  Clone ID: LIB3068-034-Q1-K1-F11
acccgacaaagtcccaccagactcacctctacgtccaaacctatttttgacgctacaccatacctactgctgaacctaatgcactcttcgcggtcccttcaacacataacactactcttcccaatgcccccttctatttctacacactttctaacgtcgtaatctgacgatacatcccaaatgcggaaatcttaacacctattcctttatcatca

SEQ ID NO: 53628 - DNA, 425 bp, Zea mays
  unsure at all n locations
  Clone ID: LIB3068-034-Q1-K1-F2
cccacgcgtccgcccacgcgtccgcccacgcgtccgcccgaggatccacttcatgcttgcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctncaactncaccagtgttgtggaggtgttctcccgcatcg

SEQ ID NO: 53629 - DNA, 411 bp, Zea mays
  Clone ID: LIB3068-034-Q1-K1-F3
cgcgctggcaagacagactacagggccaggataaggctgattaaccaagacaaaaacaagtacaatacacccaaatacagatttgttgagcgatttaccaacatggacatcacagcacaaatcatctctgctagtatagcaagtgatatggatcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgatgccactggtgatgatttctctgttgagccagctgatgagaggaggcctttgcgtgctctctaggatgttggccttattaggactacaactgggaaccgtgtcttggtg

SEQ ID NO: 53630 - DNA, 428 bp, Zea mays
  Clone ID: LIB3068-034-Q1-K1-F4
cggacgcgtgggcgagggctcagttcgcacgcttcccaacatggctctcggtgccctagcccgcctcctccgccttgcgcccacccctcgcctcgcgcgccccttcgctgcaaaggtccgtgcgtctcggccgcaggaaccggagcttccgtcggaggacgacaacgacttcgccggcggcgagctcaccgcccccaccgagggcatcggcaagccgctcgccgaggtgctcaaagagctcgggaagagggttccggactcccttgtcaagacccgcgtcgagaataatggcttcgctatcaagtacatcccatggcacattgtgaacaaaattctcaacatacatgctccagagtggtcgggtgaggtacgcagcattgtttactcatttgacgggaaaacagtatctggtgtctatcgagtgactc

SEQ ID NO: 53631 - DNA, 316 bp, Zea mays
  Clone ID: LIB3068-034-Q1-K1-F6
ccctcgcgtccgataaaaaaaaacatattaataaaacaagaggaaaaaaaacttacgggggggacacttagaatcggggtgcgaaccaagatcagaccatcttgcgattcgggcggtctcgccgtccgaattgttgtctggagaggcgttctcttggactgaccggtcctaagctctgtggaaaggtacgcctgcgacgcttagtgccccgtcctgcccggaccctgtctctccacgatgcgccgtcaactagtcaggtcgtttgcgaatgcaccctaaatcatgcgggcaactctgtccatggcttaatacatgc

SEQ ID NO: 53632 - DNA, 427 bp, Zea mays
  Clone ID: LIB3068-034-Q1-K1-G1
gccgggcgttgatgttgaagaggtcgtccctggtcatgccgggcttactgggcactcctgcggggatgatgacgatgtcggagccctccagcgcctccccgagctggtcgtcccccatgaaccccttcaccagggcggtggagttgatgtgggagacgtcggccgcgacgccgggggtgccggcgatatcgtagagggagagggaggaaacgagcgggttgagcttcatgaggagcgagagcggctgcccgatgccacccgccgcgcccaggatggccaccttgcgctccggattggccgaggacgcgtagccgcggctgcggcggatgagctcggccgtggacttcagcagcgacagcctcatggcggcggctgggtcggggatcactcgctcgggcgtgtctcgctgtggattggtggggggagc

SEQ ID NO: 53633 - DNA, 398 bp, Zea mays
  unsure at all n locations
  Clone ID: LIB3068-034-Q1-K1-G10
gagcgatcccactcccgatcagcagctgatcgctcactcttgcagctcgatcattcttgagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaagagccagctgccccggcggagaccgagccagctgccgncgctgagcccgaggcggcccccgtggcggcggaggaagagacgccaaaggaggaagagacggcaaaggaggcggagccggagccggagcccgcg

SEQ ID NO: 53634 - DNA, 364 bp, Zea mays
  Clone ID: LIB3068-034-Q1-K1-D8
aataaaaacaaaaaaaactagaaaaaaaaaaaaaaaaaaaaaaaacacaaaaaaaaagggggggacaaatatacaaggcggggacggactcccgtcctgacggtgccttgcttccggctcgtgcctgcgaggccttgccttttatccaaggggaggttcgttgaatcgattgccacccactttacaacttcttgaccgggaaaacccttggtttaccactcttactcgcttgctaccacttacccttcttcctaacggtctttcacacaatctggctcgagccaagctcacttccctcctttttccccgcttatttcgccaatggcactccctttgctgcggttcctttagatcggagactggg

SEQ ID NO: 53635 - DNA, 417 bp, Zea mays
  Clone ID: LIB3068-034-Q1-K1-G12
aggtttcgcaggatcacttcacttaacttatttcatttcgagaaagagaacgattcttgtgcgatctagaaagaacgattcttcttcgaagcatgaaccaacccgcacctgccctcaaagcagatacgaatcacggaaactttgcctcttctgaagcgcagaaccagaaaacccacggcctgttgcttgattagaaaaaggagatccacggcctgtgagtaactacgccatgttacgaatcacagcctgacttgctctagatgaaagcataggtagtgacgacctattgttttcttctcagcggacccaatgagtaactacgccatgttacgaataaaagcgagggaaaatcggatgagcaacttttgcagctatatgaaatgcactttggaaaatcaggtcttgaggacgaaaaac

SEQ ID NO: 53636 - DNA, 180 bp, Zea mays
  Clone ID: LIB3068-034-Q1-K1-B6
actgcacctaccaaacacactccaacatctaattaataaactatctacctcaccatgcatgcatgcattattacttagagaacacaactatatacctacatctcatattaaccatgcgcatgtattactttactacactcatatccatcaatcaaaaataaatcaaatcaaactatactc

SEQ ID NO: 53637 - DNA, 316 bp, Zea mays
  Clone ID: LIB3068-034-Q1-K1-B7
cccacgcgtccgggaggagtacgatgagtctggcccggcaattgttcacaggaagtgcgtctaggcttcgcaagtgcctcatcgttgcctagtctcaagttatgtccccttcatttctcaagatacgtgtggcagatttgcatggtacggttcatttatcaaattatgcccaccccctctttgtatgttgtggctccatgtgcgagcacgctgtctgtcgtgacacctggttcgtcagatgttttgtcaaacttgcttggcttgattggttgtacttgtacctgtaagagctgatagttatatgaatggcttggac

SEQ ID NO: 53638 - DNA, 422 bp, Zea mays
  Clone ID: LIB3068-034-Q1-K1-B8
cggactcgtggggcgggctacatcgtcggcatgtccacgtgctacccgcgcccgggcgccgtcacggtgcgcgacggcgagccgctcaccgtcgtgtccaggtacagcagcgaccggcgccacacgggcgtcatgggcctcttctacatcctcgtggccgaccacgcccggcagctgccgccgcaggagggcctgtgcttcagcttcccggtcccatggtgcctaccgtcatggctgtcgagcaacctgtgagatcttttggtgttgaaagctggtgctatgttctaattagctgcttggttagggttcggttcggggctggtgatggtagggcaaattaagcaaggaaggccgcgtgggtccttgcgttactcatacagtagtagtaatgtaaaaatatagaagcagcggtcagtctactc

SEQ ID NO: 53639 - DNA, 434 bp, Zea mays
  Clone ID: LIB3068-034-Q1-K1-C1
gctcactggacttcgcaaatttgcagatgatgaaaagcttcatgctgagtgggcagcagccaagttatcttgcaagaagcgcctggccaaacatgtgttggatgtgacaggtgttacgattgatccaactagccttttcgatatacagattaagcgcatacatgagtacaagagacagctcctaaacatattgggagctgtttacagatacaaaaaattaaagggaatgagtgcagaagagaagcagaaggtcacaccgcgcactgtcatgataggagggaaagcgtttgcaacatacactaatgccaaaagaatagtgaaattggtgaatgatgttggtgctgttgtgaacaatgatcccgaagttaacaaatatctgaaggttgtctttatcccaaattacaatgtatcagtggctgaagtgcttattcctg

SEQ ID NO: 53640 - DNA, 361 bp, Zea mays
  Clone ID: LIB3068-034-Q1-K1-C10
cgcgctccgctccccacgccagcacgcccgagccccgaatcgagtcccctaccccatcgatgcccgccgcccgcctttccccgccattcttctagaacctacccagctctcggggaccttctctctcagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgctggagtggcggtttgcgcaggtctttggcgagcgcgccgcgggagaagatgtgcaagatggtaataaattcaaccggccgctggcctcttcggatc

SEQ ID NO: 53641 - DNA, 325 bp, Zea mays
  unsure at all n locations
  Clone ID: LIB3068-034-Q1-K1-C11
cccacgcgtccgcagcgttgccgagcgagagaaacagagctcccccctgtccaagtgggcaggtccaggacaccctccacgcacgcactgatggaacccctggtgttcgtgctgctcttggtggccatgccactcagaggatcagatggcgcgtggtgcgtgtgccgaccggacgtgtccgatgcggcgctgcagaagacgttggactacgcgtgcgggcacggcgcggactgcgccgncgtgctcccgaccgggccgtgctacagccccaccacggtgcgcgcgcactgctcctacgccgtcaacagctactttcagcagaaca

SEQ ID NO: 53642 - DNA, 409 bp, Zea mays
  Clone ID: LIB3068-034-Q1-K1-C12
cccacgcgtccggtgtctacctcattattttcggagtccgagtggcgaaacccgccgcggcgtccactgggcagtgctccacaggctcatatccgattccgatccctaagacctcagccgctgcggcatccacggtcaactcaagcgctggcaactggcaagggcagatgatctgtgtatagcactcgctaccttctcttgatttccccctcaggtcgctgaccaagggtcctgtccgccatggatgcggagcgaagctctgcacgcagcgccacaccttttggtccgccgtgcgatcgccaccgctagacgccacgcctgcggtgccttcccggctgaatcgcctattgcctaggaggtgtaacgcctgctgtcggcgccagactcccgcgaggtagccgcgagacac

SEQ ID NO: 53643 - DNA, 432 bp, Zea mays
  Clone ID: LIB3068-034-Q1-K1-C2
gctcactggacttcgcacatttgcagatgtatgaaaagcttcatgctgagtgggcagcaggcaagttatcttgcaagaagcgcctggccaaacatgtgttggatgtgacaggtgttacgattgatccaactagccttttcgatatacagattaagcgcatacatgagtacaagagacagcttctaaacatattgggagcttgttacagatacaaaaaattaaagggaatgagtgcagaagagaagcagaaggtcacaccgagcactgtcatgataggagggaaagcgtttgcaacatacactaatgccaaaagaatagtgaaattggtgaatgatgttggtgctgttgtgaacaatgatcccgaagtttacaaatatctgaaagttgtctttatcccaaattacaatgtatcagtggctgaagtgcttattc

SEQ ID NO: 53644 - DNA, 411 bp, Zea mays
  Clone ID: LIB3068-034-Q1-K1-C3
cccacgcgtccggccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggt

SEQ ID NO: 53645 - DNA, 335 bp, Zea mays
  Clone ID: LIB3068-034-Q1-K1-C4
cccacgcgtccggcagagtacatggagtcgacgtggcgcgcgaagacggtcggcccaggggtgccgtgtttctatctcgacgacggacggatgccgggcaactcgggcttcggcgtgagcttcttcatcagtaacgcgccaacaatgggatggctggacaggcaagccatctgctccgtggtccttgctttctacgggaccgtctacagcctggactacgaccagctcggcgagctcggcaacgggctgcgcgattcccgttgggcgatcatcagggtcgagaggcccgacgaggcgcagaacctgtctcaagatctcgacgacgcctgcaggga

SEQ ID NO: 53646 - DNA, 399 bp, Zea mays
  Clone ID: LIB3068-034-Q1-K1-C5
cccacgcgtccgaaaatgttgatatagtatcaaaaacttctactaatgaacaaggccaaacaactgatgaaattagaaaagaagaggatcctgttcacatcattcaagcatcagagaaagagatcgcagatgaaatagaagaaagtaaagaaatacatgaagacaatgctatttgtcatgataaattacagacaaattctgaaaaggaagagtcaccctcaaccgcattccaatgaaccatacaatgtggatgctaaaattgatgatacaacatctctatgcgaagaaataatccatgacaatacaagtataaatcctagagaaattgaagagataggagaaaacaaaggaccagacttcacttctgaaccttctgtagaatcatccatacagaacaat

SEQ ID NO: 53647 - DNA, 422 bp, Zea mays
  Clone ID: LIB3068-034-Q1-K1-C6
cccacgcgtccgaaaatgttgatatagtatcaaaaacttctactaatgaacaagggcaggcaactgatgaaatgggagaagaagaggatcctgttcacatcattcaagcatcagagaaagagatcgcagatgaaatagaagaaagtaaagaaatacatgaagacaatgctatttgtcatgataaattacagacaaattctgaaaaggaagagtcacctcaaccgcattccaatgaaccatacaatgtggatgctaaaattgatgatacaacatctctatgcgaagaaataatccatgacaatacaagtataaatcctagagaaattgaagagataggagaaaacaaaggaccagacttcacttgtgaaccttctgtagaatcatccatacagaacaatgttgaagactcaagcagtcatcac

SEQ ID NO: 53648 - DNA, 231 bp, Zea mays
  Clone ID: LIB3068-034-Q1-K1-C7
acttctactaatcaacaagggacggctacttataaagtgggctgagacaagcatcctattcacatcattacttcattaacacctgaaacctcaaactacgtagatctaaatgatcaattacatgcacactcacctattcgtcatgatctattacatactaatcatactaactaatacccacctgttccacactacatttatcctctcaatgagcatactttaatacaccat

SEQ ID NO: 53649 - DNA, 396 bp, Zea mays
  Clone ID: LIB3068-034-Q1-K1-C8
attcccggccgacccactcttcctcccactcttcctaaaacatagatattatttcacactctaatactaatgaaccaagggctgcttctttctatcggtgcgactaaccacatcctgttcacatcattcacccatcacagaatattatcccatatcacacccaccatagtatatatatacatgcatacacccctcttcgtcatcattaattactaacaaaccctctacatcactattcacctaccacctattccaactcaccatacaatttcgctactaccactgatcattcatcttctttattctaacctacaatccacgacaacacacctctaaatcctatatcaccctcatacataatataaaacaccctaccatacttcacttctcatcctt

SEQ ID NO: 53650 - DNA, 351 bp, Zea mays
  Clone ID: LIB3068-034-Q1-K1-C9
cccacgcgtccgcccacgcgtccggtcctggtgctcgcctccgcccaaggccacggccgacgacgccatgctgcagcggttcgcgctggcgcccgccgacccggcgtctaactccatctccttcaacgtccgcggaaccagctgcagcggccggccgagtgcccgccagcgccgcggaagccggtgtgggcgcctccgctgccttcgacgcccgccaacaagcgcagcaggccgtctccgccctcctccgcggcgccggctcgccgggccttcttccccgtcgcgcgacctcaccaccgtgttctgctccctgccgcccaagaagcggatccgcgtggtgtgaccctggcg

SEQ ID NO: 53651 - DNA, 158 bp, Zea mays
  Clone ID: LIB3068-034-Q1-K1-D10
ctacatcgatatactgacgatattcatgttaccttggagcacttctagcattaacaccttccagaggccgtcgacagtatttggccctgaagacattaagcggtccatcttgtcactgcagtacactggggaactcgctgcgctctttgagtctactg

SEQ ID NO: 53652 - DNA, 188 bp, Zea mays
  Clone ID: LIB3068-034-Q1-K1-D2
tcggattcccggtcgacccactctctcttcatctagcctctaaacatacaaatatatttacacgacttctacgttcataacggtcgttttcttaactcggtgtcccataattattctctatgctctaacacatcattctcccttaccttcaaactgtcctagcatatacctacgcatcacaactctct

SEQ ID NO: 53653 - DNA, 316 bp, Zea mays
  Clone ID: LIB3068-034-Q1-K1-D3
atcggcggctcctaccagcaggtcgcggaccaggactacgcctaatttattcaccacaccatcgtctccgctttggatgaatggattcaaacccatcgtcgtttgcttttgctcctcgccacgttcaattaatgcttgtgtatgcatgtatgtgccaatatgatgtgccgttgccctggtccattcatttcccttttttttgggggtgaaatagatgtaaagatctcgtcttgcctgccgtactcgcgctgtgttgggaaaaatttggttttcgttccaagtttgttaagtttatgcatggatttcttggctcctt

SEQ ID NO: 53654 - DNA, 288 bp, Zea mays
  Clone ID: LIB3068-034-Q1-K1-D6
gttgagggattggataccaggaaagaagaggagagaagctggttgaccgttcttgggggcagttcgtttttgcagggtacgctaccgattttctcttgtgtcaggcataaaaaacggttggaccgtctgctagtattccctgctgtttggtgttatcgtatcagaagacgtctgtagatgtacaattcctcaggccccttgtgttcggcttgaggaagtttccgttgtaccctggacctgctatatccggttgattcttcaattgtattcctaaaagttactacacac

SEQ ID NO: 53655 - DNA, 248 bp, Zea mays
  Clone ID: LIB3068-034-Q1-K1-B5
tcttcctcctactcttgggaaaaaaaaaatttaattaaaaaaaaaaaaaaacaaaaaaaaaagatagaataatactatagtgctggaaaaaaaaaactataaaaaaaacaaaacatcaaaaaaaaaaaaaataacctcgtctcttttcaatcttccactcttatctcctctcctattcaacactgtactctccaactctttctgcctaattcttatcaattatcccaattttcccaaacttaatgatc

SEQ ID NO: 53656 - DNA, 184 bp, Zea mays
  Clone ID: LIB3068-033-Q1-K1-G8
ccgacgcgtgcgttgaacaccacacgaattttctgaccaatatgatcatatgggactacgcactctttaaccataaacagatgttcctaccaatgaagacagcttagattacaatataattcgcccatatctttctaaatacaactgacctggaaacagatatgatactctactaatccctatg

SEQ ID NO: 53657 - DNA, 453 bp, Zea mays
  Clone ID: LIB3068-033-Q1-K1-G9
cccggagtccctggcgcggctgcgcggcctcgactcggtggacctctccagcaaccagctgacgggcggcatcccggcgtcgttcgccgacctgcccagcctccggtcgctggacctcgggcacaaccagctgacgggcagcatcccggcggggctggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggcttgccacgct

SEQ ID NO: 53658 - DNA, 423 bp, Zea mays
  unsure at all n locations
  Clone ID: LIB3068-033-Q1-K1-H1
gccgcatccacaacctgcctctctcgtcccctggcggcgtccgcggcaggatggcggaatctacggcgaggactgtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctctcagaagatctacggtggccgccagaggaatggctcccgcccaccacacttctgcangagcagtggtgctgttgcacgcaacatcctgcagcagctgcagaatatgggcatcatcgatgtcgatcccaggggtggacgcc

SEQ ID NO: 53659 - DNA, 446 bp, Zea mays
  Clone ID: LIB3068-033-Q1-K1-H10
ccgaaatcacggcctcccgactcctcgacaactagatccgagtttcaaggactagctgcaacggtcggacctggggcaatagacgatggacgagaagaccaaggagaaccaggagaagattaagctcaacaagcagctaccgtacctcgtcggcaacatcgtcgagattttggaaatgaaccctgaggatgaggctgaagaagatggtgctaacatcgatctggactcacaaaggaaaggaaaatgtgttgttctgaatacatacaccagacaaaccatattacttcctgtaattggattagttgaccccgataagctaaagcctgacgatttagatgcagttaacaaagacagctacttgatactagatacattgccttcagagtatgactcacggattaaggcaatggaagtagatgagaaacctactgaagattacaatgaca

SEQ ID NO: 53660 - DNA, 368 bp, Zea mays
  Clone ID: LIB3068-033-Q1-K1-H11
agaccaaggagaaccaggataagagtaagctcaacaagcagctgccgtacctcgtcggcaacatcgtcgagattttggaaatgaaccctgaggatgaggctgaagaatatggtgctaacatcgatctggactcacaaaggaaaggaaaaggtgttgttcttaatacattcaccagacaaaccatgttccttcctgtaattgagttagttgaccccgataagctaaagcctggcgatttaataggagttaacaaagacagctacttaatactagatacattgacttcagagtatgactcacgggttaaggcaatggaagtagatgagaaacctactgaggattacaatgacattggcggacttgagaaa

SEQ ID NO: 53661 - DNA, 227 bp, Zea mays
  Clone ID: LIB3068-033-Q1-K1-H2
acacacgtacgacatgactctatagactttggcttctaacaaggcaggatggcagcgtgctccgggaggactgtgacagtggcaagcgcccctcgaggccctaacggcctactgcggccacctcaagcgctccgagcagatcgacctcccgtctagctggcagacatgactgaaaactcgttcagttcaaggagcttactccgtatgatcctgactgctactacatc

SEQ ID NO: 53662 - DNA, 135 bp, Zea mays
  Clone ID: LIB3068-033-Q1-K1-H8
cggacgcgtgggcgcgtgtgatgcacgaataagcgtggctacgtaatctatcgtatgtatgcgtgtgtgtatgcatgtgcttgtgtatgatcgtggtacgaggaccgaaaaaatgtatgcaactctgatttactt

SEQ ID NO: 53663 - DNA, 432 bp, Zea mays
  Clone ID: LIB3068-034-Q1-K1-A2
ccaagatctgcgacctggctgacaaatgtgtactggcatcttctggctttcaaggtgagattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcaaggaacgggatctactttgatcatgccagtcctggacaatcaactaaaatcaccaagtcctctattactccctgtcagggatgctgtcacaccattgtcggagtcagaggccatcgatctagttaaagacgtgttcgcat

SEQ ID NO: 53664 - DNA, 427 bp, Zea mays
  Clone ID: LIB3068-034-Q1-K1-A3
gaccgcacgcgtccgccaagatctgcgacctgtctgacaaatgtgtactggcatcttctggctttcaaggtgaggttgaggctctgcagaagagcgtagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccaatcctggacaatcaactaaaatcaccaagtcctctattactccctgtcagggatgctgtcacaccattgtcggagtcagaagccatcgatct

SEQ ID NO: 53665 - DNA, 345 bp, Zea mays
  Clone ID: LIB3068-034-Q1-K1-A7
cccgtcccgacccactcttcctacaactctttctaacaactaaattttctttcaaaacactataaccaattctataagatagctttatatcctaggactggaatccaataactatctcatctctaacatcactataataaaaataacctatctcactacaatcttaaaacatctcatacacacctattttcaactaaaacaattccaacactttccacatacttctttacaattatacgatgattccccatctatagatcaaaaaacaacttctctatcaacacttatctacctcacaccaaatatcccttttgtaacattactaacacctctatcttcccactc

SEQ ID NO: 53666 - DNA, 376 bp, Zea mays
  Clone ID: LIB3068-034-Q1-K1-A8
cccactcgtccggccatgactctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgaccttcgccaccaaggtgtcaccctcaccctcgccatcgatcgtccgcggcaggcggtgcccgatgcgccggccgtctacttcgtccggcccaccctcgggaacgtggaccgagtagcggccgacgccgccgcggggctctacgggtctttccacgtcaacttctccaccttcgttccgcgacccctgc

SEQ ID NO: 53667 - DNA, 323 bp, Zea mays
  Clone ID: LIB3068-034-Q1-K1-A9
acgcacgcgtccgccgacgcgttcggacccacgcgtccgcttacgcgtgggttttgattttagccgccgccggggctcatctcacatgcgtcgagaagacgcctgctcctcgccgatcgatacgatggccgtcttctccgacctccacaccgtcgacggtctcaagtccctcgaggcgtcacctcgacagcaaaacctatgtgtctggtgactccattactaaggatgacatttaggtcttcgccgcggtgccgtctaagcctggcgctgagtttcctaatgccgcccgctggtacgagaccgtttctgcagctgtagcctca

SEQ ID NO: 53668 - DNA, 398 bp, Zea mays
  unsure at all n locations
  Clone ID: LIB3068-034-Q1-K1-B10
cggacgcgtgggcggacgcgtggggcaggcagcgagtgcaaccgcgagagcgatcagggatgggctccttcttctggaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtagaggcgatgccaacgttcgtgctggtcaaggatgggaaggaggtangccgtgtgattggg

SEQ ID NO: 53669 - DNA, 319 bp, Zea mays
  Clone ID: LIB3068-034-Q1-K1-B11
ctgccgcccctacgctccacaaactcttttcaaaacccactcccactccttcgaggtaggatctttatccccaggcgttcgacacctaagcctaccccgtctacgttcactccaagcctcaaacctacgacgcccaagcctacctcacacgacgtacacttattcccacaagtcttctacacctaagccgacccatcctacgtacactccaaaccctaagccaccggctaccaagcctaccacgctcaaaccgaccccgtcaacgtacaccccttcctcaaacccttcgacactcaagccgacctacacgacgtacact

SEQ ID NO: 53670 - DNA, 445 bp, Zea mays
  Clone ID: LIB3068-034-Q1-K1-B12
cggacgcgtgcgaggacttcgacgccctctatatcgttcgcatcgacatagctatgacggaagaatacgtacttgttggttggtgcccagtccatgacctactgctgcgctaacttccctgatgacaagggtgccagggccattgtcaaagccttcccacacataaaatgcactgtgctggcccctcccaagatcattgccaccaaaccggccgatggagcgaagataaactatgtcgaaggtgacatgttcagtttcattccacctgctcaaactgtcgtgctaaagcttgtgctgcaccacctgaccgatgaagagtgcgtcaagctcctggctcaatgccggaaggcgattcctccacggaaggacagcgggaaagttataatcggggatattatgattgaccactctgggcttatgctggaaactcacctgctgatggaca

SEQ ID NO: 53671 - DNA, 303 bp, Zea mays
  Clone ID: LIB3068-034-Q1-K1-B3
gccacgcttgcgctcactcgtgcgtggacgcgtgggttcgaggctgcccgccatggtgcgtcttgcttgcggtctgatccaatgacaccttccattggggcgcgaacacgctatcgagcgtctaagcaatcagctagctgagtcaccatgcgctcacgcgtaatcagtcttagacgcgttcagacataatccagctcacgatagctatgcgccactggattacaaaccaatcgcgatgtccagttgtgtgaatcatcaggtcctctcgtactaggttgaattactatggcggcccgtgtataa

SEQ ID NO: 53672 - DNA, 487 bp, Zea mays
  unsure at all n locations
  Clone ID: LIB3068-033-Q1-K1-G7
ctgctcgtactcggtctcggaattgcccgggtgcgactccacgtcgtctcgtcggaccgcctgtgggttttggttccactaccgagtatttctgggttctcgttgagcctcatcgtgtaggacagtcctgnncgttatcttgttaaccagagtgtgctcgcctcctagccaaaccttccccactctgaccaatgtnncttccgcctcggnnatcggcccggcgtaggcctggnngccttggagccaaaagggagggtgtcggtgccccgctttccgaacctcacggannataagtaaaataacccgttaaaagtanngtggtatttcacttttgcgcccggagggctccnncacttatcctacanncctctcaaggtcatttcacanaagtcggacttagagtcnaagctcaacaggggtnncttctttccccgcttggattccgccaaaagcccgttcccctttggcttgtggttttccgctggat

SEQ ID NO: 53673 - DNA, 350 bp, Zea mays
  Clone ID: LIB3068-033-Q1-K1-E5
gcagactattcagtaccacgccatatgattatggaccgcctaagtcaacataggagactgtacaatttagaaggtgaaggccatggtaaataacctggctgctcaaacacagtatcacggctcgctgaaaccctacagcacactcccaaattgctagcattgcattctaacttatactcagctagtcatcatacagcaaacatgcatcttaatcccactttctatcaaatcaatcgctatcaccaatattgtgaatcaacagatcatgtagcactaagctatacatctatgatagcaaagccattactcagcacaaacttacatttcacactacaatctacacccatctt

SEQ ID NO: 53674 - DNA, 450 bp, Zea mays
  Clone ID: LIB3068-033-Q1-K1-E7
cacataaaaccagtgcaagcagaagcagttcaatggcgagcagcaccatgtcggtctgcgtcacagtcttcggcggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgccctcgagctacctgacaggcgagttcccgggcgactacggctgggacaccgcggggctgtcggcggacccggagacgttcgtcaagaaccggtagctggaggtcatacactcccgctgggccatgctggacgcgttgggctgcgtgttcccggagctgctcgcccgcaacggcgtcaagttcggcaaggccgtgtggttcaaggccgtgtcgcagatcttcagcg

SEQ ID NO: 53675 - DNA, 409 bp, Zea mays
  unsure at all n locations
  Clone ID: LIB3068-033-Q1-K1-E8
gttcacatctaatgtgcactttaagattgctctacttcctgtgctttgctgggcgcttggtcatgttgctcgattcctaaggcgtaattttacacactcttctttatacaggaagtacttagaggacccttgcctatgggtagagacaaacaacactacactcagcctactttgttcgaatgctgaaatcaccctggggtttctcatgatcatctcgcttttctcgtcgagacgcaatataatccagacatttatgtactttcatcttttgaagttgatgtaccattctcctgtgacatctggttaccaccagagcgtgtgggcaagaataggccgggctgtaaacccgtacatntaccgctatgcgccattccgaacacacctatttcgcagtccagagatggtgctg

SEQ ID NO: 53676 - DNA, 458 bp, Zea mays
  unsure at all n locations
  Clone ID: LIB3068-033-Q1-K1-F10
cccacgcgtccgcccacgcgtccgcttccgtaaagatggccataactggaagaaaaagagggatggcaagactgtccaagaagcccatgaaaaactaaagattggtaatgaagaaaaggttcatgtgtattatgctcgaggagaggatgatccaaatttctttcgcagatgctactggctacttgacaaagagttggagcgcattgtcctcgtgcattatcgtcaaacatctgaggaaagtgccttaccaccttcgcatgtagaagctgaagttgcagaagtgcctcggatcaatatgattcattacacctcctcaacagattcagcctctgctcatactgagctatcttcttctgctgctgctgcaccagaagatatcaactcaaatggtggtggngcggtttctagtgggtatacttctgtatcttctttgggtgagtttgcagaaaccgacaatc

SEQ ID NO: 53677 - DNA, 415 bp, Zea mays
  Clone ID: LIB3068-033-Q1-K1-F3
ggggtctacggcgtctacgaccccgccggcgagctgcagttcgtcgggatttcgcgcaaggtgagggccagcgtcgagggccaccgccggaaggtccccgccaacctctgcgcctccgtcaaggtcgcagtatcagatgaggaggcaccagatcgatctgcccttaacaatgcctggaaatcatggatggaagaacacatagcggccacgggcaaggcgccaccagggaacgttgcaggaaaccacacctgggttggtggtgccccccagcggtccccggacctgcgtctgacgcctggacgccacgtccagctgacggttccgctggagcagctgatagaccggctggtgaaggagaacaggatggtggccttcatcaaaggatcaaggagcgcttcccagtgcgggttctcgc

SEQ ID NO: 53678 - DNA, 430 bp, Zea mays
  Clone ID: LIB3068-033-Q1-K1-F5
cccgcgcgtacgccattactagtaattggcaacaaaattgacaagcctgaagggttccggaaacaaaccttcacagaaataatgggcctaaagacgatcactgaccgagaagtggcatgcttcatgacatcatgcaagaactcgaccaacattgattctgtcattgactggctggtgaagaactcgaaaaagaagaattgaacttaaatctgtactagctattaaagcgcacgccaatctctctatttttgcatgtcgcatagcattggagctgtaaattatgcaagaggtattaatcagggatgttgtgttcataattttgttaacctggtttagcagtatgttggtggacagcgtctggtattgtgcacgcccgtgctctgaggctgcctcctgtgttccactcaattttagctgtgcgatttgttca

SEQ ID NO: 53679 - DNA, 317 bp, Zea mays
  Clone ID: LIB3068-033-Q1-K1-F6
aaagaaaaaaaaaaaaaaaaaaaaaaaaatataaaaaaaaaaaaaaaaaaaaaaaaaaaaaaaaaaaattttacaaaaacaaccatccaacctaactcaccactactatactgccacctaactcccatctactcacccttaatttacaacctcttacctatcatttccaccgtcgctccccatcaaaacccccttgttacccatcttactttacccgactcgcttaatcatttccacccctactcttatatctcttctaacccttccaccatcctttctcaccactactacactctctatctccaatcattatcccc

SEQ ID NO: 53680 - DNA, 425 bp, Zea mays
  Clone ID: LIB3068-033-Q1-K1-F7
ctgggagacctgatgcggttattagtactatcgggcgttgacggaattcaggggtccgggtttacaagggccgacggaggcgcaccggacaccgcgcgatgtgcggtgctcttccggccgatggaacatagctccatctgaaccgattccagggttggcggaccgttaatcagaatagataactcttaccgaggcccccgcctgcatctccggacttcctaacgtcggcgtctgccgccacgtactggctagtgaaatcttaacccgattccctttaggatgacgctcgtgatcgcgctatctgatgggtttcccccttaccttaggatcggcttacccatgtgcaagtgccgtgcacatggaacctttctcctcttcgtcctacaaagttctcatttgaatatttgttactaccaccaatatct

SEQ ID NO: 53681 - DNA, 322 bp, Zea mays
  Clone ID: LIB3068-033-Q1-K1-F8
accacacatacactaacacatttacaaactcatagaaaaaaaaaacaaaaaggcaaacggaaaaattataaaaaaaaaaaacgcaaacaaaaatataaaaataaaaaaaaaaaaaaaaaaaaaaaaataaaaaaaaacaatataaaccattattaattataatataaccgtttataagactaaacaaactacagtgaagcctctaacttaaacagacaagataaatataaatgagactaaaatataaaacttaaaaattaataaaaacatctattaccaaaataactacacacgatacatcacaatatgatgaactcacact

SEQ ID NO: 53682 - DNA, 462 bp, Zea mays
  Clone ID: LIB3068-033-Q1-K1-F9
cggacgcgtgggcggacgcgtggggtgaggctgctcgtccacatttcttacagtcctcggagatgggcctgccgtatatgcgaggttgcatcaggaagtctgcgcccgtgcgattttaagtacagcaaactattagcttctcttcaaactttcagatgcacatataattttgagataaggttgacatctgttcaagctgagccgtttaagaaaattattttgaaggcaatcagtcatctcacagaggaagtgcagaatgccagagctttggtagatgggcaactgttttcagaagagatgaacataagtacagaggacccacaccaagttgattttcttgtgccattcaagaatgctgtgcctgttgaagaatgcagtttagagggagttgctgggctcattcgctttattggatctgtcagcgccttggcatatttaggccctaaagaatctatttcagaa

SEQ ID NO: 53683 - DNA, 360 bp, Zea mays
  Clone ID: LIB3068-033-Q1-K1-G10
gcgcggactcttggttcgacccatgctttcacttataaccgttgcagactcacaaagtcaggggaccatctggagctgaacatgtactagtgaattcaaaagcttaatataagtataactctatgctagtcaactaacatgacaacatgctattcgtacagtgcatttgcaactagcataagttattgtaaaagtcgcttatatcataagatatgccgcattacgagccattgctaaaagtgatgtacagctaatatgtatactccatatatcacctatgcagcatcatgtatgtaaacctcctaaacaaagacatctgcaagatataattataccgcatctacataaacttcgacatga

SEQ ID NO: 53684 - DNA, 443 bp, Zea mays
  Clone ID: LIB3068-033-Q1-K1-G12
gtgccaaggaaatgacgaagctctctggtatctctgaaattatccctgagatggggatgggtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttctgcccctctgaattttctgtcgccgtgaccatcttcggcgggcggcgccaagctgggacatggggaaaggaacttggtgcggaggcttatgactgcaacaacatggtcgaacatgagctgcctggaagtgggatcctcatctaccagagcttctgtgctgctgaaaacgccgttgctagctcgcccaaatccggtcttcgctgcttt

SEQ ID NO: 53685 - DNA, 129 bp, Zea mays
  Clone ID: LIB3068-033-Q1-K1-G2
ctgacgcgtgggctgactcgtgggcggactcgtgggaaaaaaaaaaaaaaaaaaaaaaagaaaaattaaaaaataaaaaaaggtaaaaaaaataaaaaaatactatacaaataaaaaaagcgtcgtcct

SEQ ID NO: 53686 - DNA, 337 bp, Zea mays
  Clone ID: LIB3068-033-Q1-K1-G3
cccacacgtacgcccactcttgctccgacttatgcttataccaatacaaaaaaaaaaaaggaacattgtaaaatttcaaacggtctaaacaaacccagataccatacacattcataccacttcatcactctacaatatcaacacttacctccccttacattctaccactttacacaacttcaaaactaccaaaacccaatccattcccaacttatttccaactatataactcatacaaccttacactcaccaaatttcttagacttccaaaccacccacatttatccacataaatatatcccgaatagcacatgacaaactccctttaacaacactt

SEQ ID NO: 53687 - DNA, 352 bp, Zea mays
  Clone ID: LIB3068-033-Q1-K1-E4
cccacgcgtccggacgaccaatggatcttctgggtgggcccactgattggcgccgccatggccgcggcctaccaccagtacgtgctgagggccagcgccaccaagctcgggtcctaccggagcaacgcctaagttccgcccggacgcgccaggagctgggcaccgttccgattctgttcctccacatgacgccctgttctgtttccgtgtggccaggactccgcttgcttcctgctgttttctacttcggaccaaagtgtgacatatctttgctttctgtatatgtatgtaggaatgcatcatgtaaggagaatttggaatacaattgtgtgagtttttatccgatcacaaa

SEQ ID NO: 53688 - DNA, 429 bp, Zea mays
  Clone ID: LIB3068-033-Q1-K1-C3
cccacgcgtccgcccacgcgtccgcccacgcgtccgcggacgcgtgggggcggggtggggcggcctgatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgatgccaccgtgaccgcgctctaggtacgaccagtagtaaatcatcgacagaggctagc

SEQ ID NO: 53689 - DNA, 363 bp, Zea mays
  Clone ID: LIB3068-033-Q1-K1-C4
cccacgcgtccgcccacgcgtccgcccactcgtccgtccacgcgtccgcgcacgcttgggcaatctgaccaccactggacagtgcactgtactctacagcaacgacagaaaagtgagcagcacacagcagcagctgctgccatgcacgcttggagatctctcctaccgagcttcgtgctcgccgtgctggccgctcaagccttgctagctgtggtccaatccaagaccggccccgtggagcatgcgagccaagcatgtgacgacgtgaacaagccctactgcgtgcccgtgatagacccgcgctcgctcccagcgaccggcggctggcacggcatcactcccgtgacgccattgcacggaagc

SEQ ID NO: 53690 - DNA, 448 bp, Zea mays
  Clone ID: LIB3068-033-Q1-K1-C5
gtcacatgaaggtccagacgcgagagacatgcgacacgatctcttaggaatggataaaggatatacgattgatcatgaagtagaatgtgggaaactaattactctcttcagtgctccggactacccacagtttcaggcttcagaggagcgatacaacaatcgtggagcatatattgtccttagtccacctgattttgctacccctgttttccatagcttcggagctgtaaagcctcgacctgcggcccatccgttctatgattttgaacaagtgatcgactcagatgaagaattggatttaatcgccatggacagcggcacgtcgagcctgtcatgacgactcgccatgtaccttttgcacttagggttgtatttattattatcgctccaattgttgccatggaagcgtggcatcaaggttttttgctgtcgttgttgtaagctaatg

SEQ ID NO: 53691 - DNA, 81 bp, Zea mays
  Clone ID: LIB3068-033-Q1-K1-C7
tcgcccacacacacgtctacacgctcaggtgtttctacacaaactcaaaaacaaggctaacggaccgactatctacaacaa

SEQ ID NO: 53692 - DNA, 454 bp, Zea mays
  Clone ID: LIB3068-033-Q1-K1-C8
cccgcgcgtccgcccacgcgtccgcccactcgtccgcccacgcgtccgcggaggcgtgtgcaagcacaccaccactccacagtgcacttcactctacagcaacgacagaaaagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaagcaggtgacgacgtgaagaagccggactgcgtgccggggatagacccgcgctcgttcccggggaccggcggcggccacggcatcacgcccgtgacgccatcgcacggaggctccagctccccgacgccgtcccacggcggctgcggcgggtacgttccaacgccgtcgcatggcgggacgctgcctttcccgttccacggcg

SEQ ID NO: 53693 - DNA, 230 bp, Zea mays
  Clone ID: LIB3068-033-Q1-K1-C9
gacccacgcgaacgaccgcacgtccgaaaaaaaaaaaaaaaaatataaacaaaaaaaaaaaaaaaaagcgaaaaagaaaaaaaacaaaaaaagacaaacacaaacaaaaaaaaaacaaaaacaaaaaaacaaaaaaaaaaacaaaaaaaaacaaaacctgcctaccacccaaaataacccaaaccccactccacagccaccaaacttaagaaccctttaaaatacccccc

SEQ ID NO: 53694 - DNA, 85 bp, Zea mays
  Clone ID: LIB3068-033-Q1-K1-D1
accacgcgtccgaaaaaaaaaaaaaaaaatacaaaataaaagaaaaacaaaaaacaaaaagagaaagggcaaaaataaggaagac

SEQ ID NO: 53695 - DNA, 456 bp, Zea mays
  Clone ID: LIB3068-033-Q1-K1-D11
cggacgcgtgggcggacgcgtggggttcagattcgtttgaggcaaacaggaggaggttgggtttcatggctcggtcttcagttttaccagtgcatgactttttcctgctagtaacattttgttcgtaataagcaatattacttctattgtcctgccttttcacaaacaaatgatactgtgttctacctcatggtttcttcaccgtcatgttttctgttgtcaggtccttgagctagtggagtcaccaattgttcctgtgactgtcatgttttctgtgtttgttcgactattgcagatctgcagtagcttgtagctccatttggttgtttcatatcacatgactctgttgacacttgccacttgctagttgcgtgcaaccgtggttctattctgtctggcataatgctttttatctcattgtaaagagaggggtcaacgggcactggagcaaagatt

SEQ ID NO: 53696 - DNA, 238 bp, Zea mays
  Clone ID: LIB3068-033-Q1-K1-D12
gacgcacgcgttcgcccacgcgttctcggacgcgtgggtacggacgcatgagaaagaaagataaaataaaaaaaaaggaaagaaaaaaaaaaacaaaaaaaaaaaaaagataataaaaaaaagagcagaacaagcaatatgacctaatattgatatggcttgtcacaaacaaattatactgcgtattacgatatgtgaatgtaaagcaatatgtttactgttaaaagatcctaattat

SEQ ID NO: 53697 - DNA, 380 bp, Zea mays
  Clone ID: LIB3068-033-Q1-K1-D3
atgtagcacgcgcgccctcgtgaacgcagcttcgacgcggtctgcctcgacgacttgcgcggccgggctgagacaatcacgcgcgcccttgtggccctaacgcactaacgtaggtagccgctgacggtgtgctgaagcctctgttactacctcgaatgctcaattagaggcgttcactaataaaccgactcactgaaccttcgctccactggcttttaaaccaagtgcgatgaccacttgtgcgaatcatccgttgctgtcctactatgctgaattactatcgcgcgccggtcataactaccgtaaaactaacatgtctaacgacggcataaacgcagcttacgttacctattgctccgttaacacatctacacttactg

SEQ ID NO: 53698 - DNA, 279 bp, Zea mays
  Clone ID: LIB3068-033-Q1-K1-D4
attgcgcatgcgaaccttcgtgaacgcagttacgatttagcccgccatatccattatgaggagcgggcgaacataatcgcacatgccgttgtgatgacaactccctaacccagatctgctctgacgttgtgcaacagttcctagtactgcctcgaatatttaattcaagacattcacttatagtcagacttactataacttctctccactggctgctaacactaatacaacgtctaactgtgtgaatcaacggctcctgtcctgctatgctgaattact

SEQ ID NO: 53699 - DNA, 439 bp, Zea mays
  Clone ID: LIB3068-033-Q1-K1-D5
cccacgcgtccgcccacgcgtccgcaccgataaagcctttgcgtacattggagaacacgggaagctaataaagaccctctccgtcgccttcgccgggaacagtgacatggccctccagtatgtattcgaggggtgcaccaagctgcagaagcttgaggtcagagatagccctttcagtgacaggggtttgctctcaggactggactacttgtacaacatgaggttcttgtggatgaactcgtgcaggctgacgatgaggggctgtagaggtgtagctcagcagatgcagaatctggtggtcgaagtaatcaaggaccactccgaagatgaaggggaggctgagaccgttgacaagctgtacttgtatcggtcactggcagggccaaggaatgatgctccgccgttcgtcaccctcttgtagtgctgctgccgccaccgg

SEQ ID NO: 53700 - DNA, 458 bp, Zea mays
  Clone ID: LIB3068-033-Q1-K1-D6
gtagttatctgtaatgtctataagtaccgtaacggtagtcgttagaactctcgcttttgtgttatgtccaattctgtcgccctataaacgaggcaaagtgtgcattgattaatataaacggaggcaatgtagaaacaatagtagcacctaatataaacagaggcatttttacaactttgttctgaacgtgaacgtcttgaatccggcacaggttttaggcattcctttgcgtgctacactggcatgcaacagcaacatgctgtacaggtggtgcactccattagttcttatggcaacgacaatcaatttttttttaaatgacaattattcttggatagtagatatcttgtatacatttgtttagtttgttgccttttcttttctcctaaacattttaattaatcactaattacttagttattgcaagcacttcaaaaatgaagggccaaaatttattt

SEQ ID NO: 53701 - DNA, 311 bp, Zea mays
  Clone ID: LIB3068-033-Q1-K1-D7
cccgcgcgttcgaaaacgaccaccgaactttaagcactgaactgtccaagcgggggactgtcagatagcaaggagcgtgtcgcgctgctcctggcggaactctctgatgctagtctgctgtcactagccccggtcggcgccgctacgacatgcgcacctacgcaactgaccccgtacgcacccgccatcgttctgaacactgcgctcaccgcacaacactacgccattctcaatgaacacccgcagacctgctattaccagtacaagatgaaccccatcatgcaacgctacatctactgccccaacggcta

SEQ ID NO: 53702 - DNA, 456 bp, Zea mays
  unsure at all n locations
  Clone ID: LIB3068-033-Q1-K1-E1
cgccgccgtccaaccctactaggggcaagaagcgcgccgccgccgccgaggaggaggaggcagacagccgcgacgcggaggcagcacccccggcggccaaggcgcccgtggtcggatggccaccggtgaggtcgtaccggaagagctgcttccagcaggcaaagcagcaggccgtcagcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggngtaccgggagctccgggaggccctggaggccatgttcgtcttctttcgcagcgctaacgccaacaacaacctgtccgagttcgccgtcacctaccaggacaagg

SEQ ID NO: 53703 - DNA, 269 bp, Zea mays
  Clone ID: LIB3068-033-Q1-K1-E12
cagagtagaagttttctctcagaacctctagtatctgttttcaagtttagctctgaatggatgataagcatgtcgttcagtttgttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatatgtgtaacataaataaaaacaaatgaaacaaaaataaaaaaaaatcaagactgggggttctctttagggtacccaact

SEQ ID NO: 53704 - DNA, 409 bp, Zea mays
  unsure at all n locations
  Clone ID: LIB3068-033-Q1-K1-E2
ggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctgnggatactgccgggtgaaggaacagaaacagacggacccaccctactatggacgaggacccatacagctaactcataagtacaacta

SEQ ID NO: 53705 - DNA, 197 bp, Zea mays
  Clone ID: LIB3068-032-Q1-K1-H6
aaaacacataacaccaaaaacaaaacatttacatttaaaaaaacacggtcccccacccagggccagggttatttctaacgggggcatgcgcctacaattactctactatactaccatctacaattcaatcacttcaccgttatcacaacatatcttaccaccttaaaaataatgtatccatataacttaatcccata

SEQ ID NO: 53706 - DNA, 314 bp, Zea mays
  Clone ID: LIB3068-032-Q1-K1-H9
cagaagcgaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccatatctcgcgccagtggaagtcggaggtggagtcgccggactaccaccgccagcgccggacgtaggggcttgcgcgcccggtgctcgcgcttgtccatgcgcagcctacagcgccgtcggatgacgactactacatcggcctcgtatacgagcgctcgacggcggccaac

SEQ ID NO: 53707 - DNA, 456 bp, Zea mays
  unsure at all n locations
  Clone ID: LIB3068-033-Q1-K1-A1
cggacgcgtgggctttttttttgacacgaggaactcatcatgaatccactaattgctgcggcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttntttagtacattggcatttgcttatgtaattctaagtatatcaatactttactttactcctatttattatattatttctttgttatattattccggaaattttgtatttatcgggacagacaata

SEQ ID NO: 53708 - DNA, 540 bp, Zea mays
  unsure at all n locations
  Clone ID: LIB3068-033-Q1-K1-A10
tcgcacgcgcgtccgtctgggaagggagccttcgagtgcggctccgctcgcggacgcgtacggcgcgggctgggcgtgagtccaataggcactgggctccgttggtggcgccgaaccgcctctaacttgtgggtacgtgggccgggccgtgcgaggccagaggcntgccggttggctagactttggnnattctgnnactgtagaggcgttacaaagtcatannatccggcaccacagagtagcttttcgcgcccacttggcatttttcaactcaagtcgccgatgacccatatgtgtgtgagatcaatcggtatccttctcgtactttaggttgaagttacctaaatcgcggtcgctggtcaattcagtangnnggtaaaacctaactnnctgtctcaacgacgagtctttaatcctcagcttcaactgttccctaaattggtgggtgaaaccaanntccaacacttttggtgannattctgcttttcacaatgatacgtgaagaagccccgtacatcgaagggaaatcaaaaaagcaac

SEQ ID NO: 53709 - DNA, 399 bp, Zea mays
  Clone ID: LIB3068-033-Q1-K1-A12
aaagaaaaaaaaaaaaaaaaaaaaaaaaaaaaaaaaaaaaaaaaaaaaaaaaaaaaaaaaggagaaaaaaaaaaaaacaaaaaagaaaaaaaaaaaaaaaaaaaaaaaaaaaaaaaaaaaaaaaaaaacaaaaaaaaaaaaaaaaaaagcggcgccccacaacagagacccaggcaacccacccccggcacacaaaccaaaacccccaccaacgcacccccaaaaaaaaaaccacgaccccaacaaaaaaacccgaggaccgagaaaaaaccaaagcaacccccaaaaaaaacgcaagaacggaacccccccagccccagcgcagaaaacacaacaaaagcccaaaacacgcaccgcgcaacaaaaacacaaaccacagaaggaaaaaggggcccaccc

SEQ ID NO: 53710 - DNA, 395 bp, Zea mays
  Clone ID: LIB3068-033-Q1-K1-A2
cccacgcgtccgcccacgcgtccgcccacgcgtccgatcgtttggaaatggtttatctacggcttgtgttgtcaacattggggctcaagttacacaagtagtttgtgttgaggatggagtagctttgccccacacagctctggcgcttccatatggtggagatgacatctccagatgcttgctttgggttcaacgtcgccatggcacgtggccaaacttccaaactgatccaatgagcaatcctatagatatgctaatgctcaacaaaatcaaagagtcatatagccaaataaagactgggagcattgatgcagctgtccttgttcattcatatgataatgaaaggtctggtggacatcagaagacaagactatcagctattaatgttcctccta

SEQ ID NO: 53711 - DNA, 103 bp, Zea mays
  Clone ID: LIB3068-033-Q1-K1-A3
aattctcggaattgaccgactgcgacccacgcgtgcgtccagccacgcgtccgcccacgcgtccgcccacgcgtccgcccacgcgtccggttctagatcgcga

SEQ ID NO: 53712 - DNA, 90 bp, Zea mays
  Clone ID: LIB3068-033-Q1-K1-A4
cgacccacgcatccgcccacgcgtccgcccactcgtccgcccactcttccgttcactcgtacacccactctttcggatctttgataactt

SEQ ID NO: 53713 - DNA, 397 bp, Zea mays
  unsure at all n locations
  Clone ID: LIB3068-033-Q1-K1-A7
gcgtcgccacgcgtcgacagcgcactctacattgcttctgagttgccgcgctacacgccactactaaaggccagccgactatggcggatcagcctctctacctacgcctgtactgagtgcgccgtgagcttgcatcccacggcgatctaccgctggcggggctgcctcagcgctgagctggcacggcgctgtctctcccctgcctaagctgccgttcctccgccgactgctgcggctcctcgccgcgtcgggcgtgtacaccgtcgacaagcagagcacggaggaggagcggtaccgcatcagccncgtgtcctacctgctggtggacggcatccctcacgaggaccacatgaaccacaccgatctggtgctcacctgcacctcgacgcgctacatc

SEQ ID NO: 53714 - DNA, 437 bp, Zea mays
  unsure at all n locations
  Clone ID: LIB3068-033-Q1-K1-B1
cccacgcgtccggcgagaggaagggaggaggtgagccaccggaagcggagacgtgagtaggcgaccaaccccgtcggtccggcgactccggctgcggcgcggcgtgctagatcgctaccgaccatggtggtggaggagatcgccgagggggtgaaaaacctcaccgttaccggagatgcggcggcttcaggcggagaggggcagaggaggggcggcggcggcagcagcaaccgcatccaggtgtccaacaccaagaagcccctcttcttctacgtcaacctcgccaagaggtatatgcaacagcacgacgatgtagagctatccgctcttgggatggccatagcaacagttgtgaccgtggcaganattctgaagaacaatggatttgccgttgaaaagaaaattaggacctctactggtgaaataaacgacgaatc

SEQ ID NO: 53715 - DNA, 443 bp, Zea mays
  Clone ID: LIB3068-033-Q1-K1-B10
cccacgcgtccggctatatctatccaatttattcactgatatgaggagcacctggggctggtatagacaatgtacctgattagctacatgacaaatattcctctgatcagcctatttatcaaaagatagcgaacggtctgcgtactttgatacttggtcttattctgtgtgcttaccacagccgaacattttccatgttaaatggatatggagctcccctgcacatctatcactcatctataacatcatgatgacactggacccgagactattctgcgagaggcaagctaatggcatcgctatccatcatcgatcttcataccctcttatatcagtgaagtccggcggataaatgatggcttccacgggttacttccatttaccttcaacgagacactgactgggaccactgcaactccgtcctacttcaataacaagaacaa

SEQ ID NO: 53716 - DNA, 218 bp, Zea mays
  Clone ID: LIB3068-033-Q1-K1-B2
gatcagcctttctaccccctgcgcctacgttgaacaggtacctttaggtacccacacaatgcctaaactaatttttgatattgataagagtgcttattataaagcaattcttgcaatttttttaagaattgatttttgcatttttaggtgtcaaaataaagaaaacccatcctagtggatccgtgtggtaaggaaaaatgggtaatctattccttaac

SEQ ID NO: 53717 - DNA, 459 bp, Zea mays
  Clone ID: LIB3068-033-Q1-K1-B3
gcaaccggtccaacactttcacgctcagcttcagcaatggctgcctccaccatggcgaggtcctccacggcgatggccggcacccccatcaaggtgggttccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactactgctgggacaccgccgggctgtccgtcgaccccgagacattcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggac

SEQ ID NO: 53718 - DNA, 339 bp, Zea mays
  Clone ID: LIB3068-033-Q1-K1-B6
cggactcgtgggcggactcttttgaaaatttaaaatataaaaaatataaaaatgaaaaaagctaacattctaaaaaataaaaaaataaataatcaaacattatttatattcccttcttactttctcttcctttctacgttttcatttttcttttcttttccttactttttcttcactttccttttttttcccctattttctcttctattacccatcttttaccccatcttatttgctttacaccacatcctcctttctttaattccctttctatccatcagttttttaccattttcctttatcaccatttccccttcctgaatcgtcttttctaccctt

SEQ ID NO: 53719 - DNA, 401 bp, Zea mays
  Clone ID: LIB3068-033-Q1-K1-B7
cccacgcgtccgcccacgcgtccgatcttctccaaccgcggcaagctctacgagttctgcgagcggacagagcattaccaaaacacttgataggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctggggtcacttggtgtcaaagagcttgagcagcttgagaagcaacttgattcatccttaaggcacataagatccacatggacacaacatatgcttgatcagctcactgatcttcagaggagggagcaaatgctgtgtgaagcaaataagttgcctagaa

SEQ ID NO: 53720 - DNA, 355 bp, Zea mays
  Clone ID: LIB3068-033-Q1-K1-B8
cccacgcgtccgcccactcgttttatcttttccaacctcggcaagctatactgcttattgatccgttttagcattaccaaaacacttgataggtatgaaaaaaacagatattgacgaccacatactactgcacagatcaaggagaactagttaatccacaccagtcttaatgaatactttaagctgaaatcaaagcttacaaaattacatacgactcatatgaatatgcttgatgaaaatctatattcactttctgtaaaataacttaagcaccttgagaagcagcataattcatccttaatgcacataatatccacatagtcacaacatatccttgatcagctaactgatcttc

SEQ ID NO: 53721 - DNA, 457 bp, Zea mays
  Clone ID: LIB3068-033-Q1-K1-C11
cgccgccgtccaaccctactaggggcaagaagcgcgccgccgccgccgaggaggaggagggggacaaccgcgacgcggaggcagcacccccggcggccaaggcgcccgtggtcggatggccaccggtgaggtcgtaccggaagagctgcttccagcaggcaaagcagcaggccgtcagcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggggtaccgggagctccgggaggccctggaggccatgttcgtctcctccggcagcgctaacgccaacaacaacctgtccgagttcgccgtcacctaccaggacaagga

SEQ ID NO: 53722 - DNA, 414 bp, Zea mays
  Clone ID: LIB3068-032-Q1-K1-E2
ggggccacgcgttcggggacgccttggtgcgcaaccttatcttcaaccagaagcgccactgtcgcttgccaccgagcccttcgtcgttcctggccggcattgggcacctgcaccttttgaagaaaccggttcaccgaacgctgtctgctcttgcggcgcaacacgggcctgttcttctctttcgattcggcttccgccgcgttgtccacattgccgaccctgccgtcgccgcggagtgtttgagcacccacgacgttacctttgccaaccgcccgcggctttccttcgcccgctatctcttcaacgactacaccacgttgggctcgtcaagctaccggcccaactggcgcaacacttgccgcatatccaccgtcgacatcttttcctctcatagcgtgctctgctccgcggatg

SEQ ID NO: 53723 - DNA, 128 bp, Zea mays
  Clone ID: LIB3068-032-Q1-K1-E3
cttttattttgtttaccaaacttttttatttttattgaaactggatcaacacatattttttctttttactacaaaaattaaaagtaaatcttcctttttaaatttgtcccacccgacacacttttttt

SEQ ID NO: 53724 - DNA, 400 bp, Zea mays
  unsure at all n locations
  Clone ID: LIB3068-032-Q1-K1-E4
catgattctcactggggcctccttggtgtgtcttcgcacctgcattatcctccatcttccttgggaaaaggctttcgcttacgctgtgctatctccaggtctctactgtcatgttcaccatccttgtcttctctctcataatcccttctatccctttccaccttccgttctttttctttatcaagacgtcttctctggcgatcatgctccacatcaggacggtcaacactaaagtcacggtcagcatgtgatagacaagctctctccctcttctcattgtgaatggtcctatttgcaggtggcaaatagctcctgtcctcccgcttaaccaaaccaccccttgaagatgccactgcttgtggggccactgaagtatcatgcangaaatgctggaattctt

SEQ ID NO: 53725 - DNA, 414 bp, Zea mays
  Clone ID: LIB3068-032-Q1-K1-E5
ctggcaagagcaacatccaattgaactatgtacttggaaaagagaaaaaacaaatgtcgggtttagtcatcggtgttggcagcatgaaaagcggggagcgtgcattgttgcatgttggttgggagctaggctatggcaaagaaggaagtttttcattcccaaatgtccctccaatggcagaccttgtttatgaagttgaactcattggatttgatgatgttaaagagggtaaatcccgaagtgacatgacagttgaagagaggattgcagctgcagacaggagaaagattgagggcaatgcatatttcaaagaaaagaagctggaggaggccatgcagcaatatgaaatggcgattgcatacatgggagatgatttcatgtttcaattatttggaaagtacagagacatggcct

SEQ ID NO: 53726 - DNA, 338 bp, Zea mays
  Clone ID: LIB3068-032-Q1-K1-E6
acgcccacgcgtccgcccacgcgtccaggtttgggttatccttgaggatgatgcctaactggaaatgcaggccttcttgacccttgcacatgatgagggcaattcaccgtctgcagattttgtgttaccgaaagctgaatgctttaacaacgaacaagcgatctcttatgctctctgcttttctctgcatccctgctatcttaggagattacccttgcgtaagcacgagatccataagcacctacgacgtgacttttaccaacagatcacgaattgtttcagggcgttcattatcacactactccattacaatatccttatcaatctactcaccacac

SEQ ID NO: 53727 - DNA, 77 bp, Zea mays
  Clone ID: LIB3068-032-Q1-K1-F11
aaaactaaaaaaaaaaaataatgaattcacaaaaataaaattcaaaaaaataaaacagggggagttaaaactaaaaa

SEQ ID NO: 53728 - DNA, 143 bp, Zea mays
  Clone ID: LIB3068-032-Q1-K1-F12
aaaaaaaaaaaaaaaaaataaaaataataaaaaaaaaaaaaaaaaaaaaaaaaaaaaaagaaaaaaaaaaaaaaaaaaaaaaaaaaaaaaaaaaaaaaaataaaaaaaaaaaaaaaaaaaaaaaaaaataaataataaaaaaa

SEQ ID NO: 53729 - DNA, 280 bp, Zea mays
  unsure at all n locations
  Clone ID: LIB3068-032-Q1-K1-F3
ccgaagtcaagtccaccccgttgcagccctacatcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctnctacctgggccagccgctgccgttctccatctcgacgctcatctggatcgaggtgctcgtgatcggctacatcgagttccagcgcaacgccgagct

SEQ ID NO: 53730 - DNA, 172 bp, Zea mays
  Clone ID: LIB3068-032-Q1-K1-F5
gccacgcgtccgctttcttcttcttcttcttctttacacaagcgtgctccttcttctcgtgtgcgtagtatctagctcacaacaggggaagaccagaagaaacaaggccgccgccgccgctgcagcaacaacatacaccttttgccctggccccattggcatccttgaccac

SEQ ID NO: 53731 - DNA, 351 bp, Zea mays
  Clone ID: LIB3068-032-Q1-K1-F7
ctgaagattcggcgatggcgtcgactatccaatccgtgaaggtgcgccagagctttggcagcctcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaatgctgtgaacaatgtgaattctgttattggacctgctctgattggcaagggctcttcagcacagactgataattgataccttatgggttaacaactttgatgggactcaaatatattggggattgtgcaagcaaaaactt

SEQ ID NO: 53732 - DNA, 360 bp, Zea mays
  Clone ID: LIB3068-032-Q1-K1-F9
agaagaaaggcatagcagcgggcagcggcatgggcaccagccccgtcatccctgcgacgatgctcttcgtcgctcttcttgtcgctgtctgcttcggcgccaccgccgccaggtccagccacgcccgccacaccgacgccgactacgcgattcgtctccccagcagctttggcgctggtggtcgaccgtggaattgctgcgactccgctatcaaggactccttcctgccggcgtggcgctgcaacgacgtggtggacaagtgctccgtcgactgccatgactgctaggcgtttactgccggcgacggcttcgtctgcggtgactttattctaagcctgaccgagcccccggtcggcacac

SEQ ID NO: 53733 - DNA, 224 bp, Zea mays
  Clone ID: LIB3068-032-Q1-K1-G1
cccacgcgtccggagaaggtgacagggccatttctagatgctttaggagaagactacttagtttggttcgagtgaacggcattcttgcctctgcagagctgcatgaaccattcatgccgtccaaatgctaaagcatttaagagagactaggacaaggatggccatgcagtgataattgcccttaagcccatcagcaaggacgaagagattaccatcgcctacat

SEQ ID NO: 53734 - DNA, 77 bp, Zea mays
  Clone ID: LIB3068-032-Q1-K1-G10
aaaaaaaaaaataaaaaataaaaatgataaaaaaaaaaaaaaaaaaaaaaaaaaaagaggggataaaaaggaaagaa

SEQ ID NO: 53735 - DNA, 348 bp, Zea mays
  Clone ID: LIB3068-032-Q1-K1-G11
cggacgcgtgggcttccgccagactccgcgttcctcctgagcagctgccgccggcccgagagtggagggggaggcaggcgcccaggctgtcaatggggacggggagcgcgacggcggcgcaggccctggcgctcgccgccttgctgctcgcctgctctggcgtcgcagtcgtcacggcgcaggacattgagcggatccaaggaagtgccggcgacgtgctggatgacgaccccgttgggcggctcaaggtgtacgtgtacgagctgcctgttaagttcgtcatgaacgtggtggcgaaggactcgcggtgcctgatccacatgttcgccacggagatcttcatgcacc

SEQ ID NO: 53736 - DNA, 326 bp, Zea mays
  Clone ID: LIB3068-032-Q1-K1-G12
atctcgttctcgccactattattctgcacagcaacgcatcaagccttctagaaccatgtcgccgtcgccacaccacaacccgtcgaagcgaagcaagcaatggccggagtcggatcgaaggccctcgccgttgccgccgttctggcggacgtctccctctcggtggccgtcgcggccgaggcgccggcgcccagccccgtctacgatgtcgtcgcgttgtctgttgtcttctcctgggtcctcggcgccttcgtcgccgtcttcctcttcgtcgacgttcgccactgatgccttgtggcctcgtgcctgcaggctacctagcagta

SEQ ID NO: 53737 - DNA, 172 bp, Zea mays
  Clone ID: LIB3068-032-Q1-K1-G3
gattgagatatatacacgcgcatccaaacaatttctatgcccttaggaaatgggttgtttgactgccttgtgtaaacttcgctggagacctgtggtttggaactatgctcacggctacgatgggatcagattattttgagtattgatgacacgagtatatgtcgattgtttt

SEQ ID NO: 53738 - DNA, 338 bp, Zea mays
  unsure at all n locations
  Clone ID: LIB3068-032-Q1-K1-E10
aggtgggttggcttctcctccccctccggttcgggttcgggttcgtgaggttctgcggggttcggtttcgtgggtgagcggatcgagatggcggcgtctgatgttgagtaccgctgcttcgtcggcggcctcgcctgggccacggacgaccactccctccacaacgccttcagcacctacggcgaggttctcgagtccaagatcatcctctatcgtgtgactcataggttccgcggcttcggcttcgtcaccttctccacggaggaggctatgcgtaactccatcganggcatgaacggcaaggagctggacggccgtaacatcaccgtcaacgaggc

SEQ ID NO: 53739 - DNA, 187 bp, Zea mays
  Clone ID: LIB3068-032-Q1-K1-G6
acggtctgggccgaaccaagggctgccgttccgtttcaaatacctgcgacccttctccagggaaccgtggaactaccacaccggccaggtccccaactactacggctgacacacctataggctctacatattcccctagacatttaccaacaacctctatctgaaagatatccactcatacttggcc

SEQ ID NO: 53740 - DNA, 211 bp, Zea mays
  Clone ID: LIB3068-032-Q1-K1-G9
cccactcgtccgcttgtgcgcgttgttatatgttgtttatgtgaggctgcatgcgcttggtatttgttgtttatgtgaggctgcatgctaatgattaactctggtctttatgtccatgtgagaaggctaataaattatctctttattttggttcgtgaaaaaggatgtttgaccctcgagacgagtaactacatatggtctgatacttact

SEQ ID NO: 53741 - DNA, 388 bp, Zea mays
  unsure at all n locations
  Clone ID: LIB3068-032-Q1-K1-H1
agctcctgttcaagttctattgacagaagagattagtggctcacttagaaagctaaaggggtgtggtaatcttgcaagggatcgctacaagagcattgagaaacgtggaatacttgcaccaagcaagagaataagcaaacgtcggtagagaaggcaagttccaatctgagggatgatatggtgaagctggattgaagaggatttactagatttgagaagaccctttggatgttcactgtcggaatgttcccctctttcagtgtcttgcgaaagtacctaacgattggttctgtccgtgtggggcttcgttgtgacgctagtttcataagatcntggatgcactcatataccctggctggtcttgatgcatgaaggcgtatcgcttggt

SEQ ID NO: 53742 - DNA, 346 bp, Zea mays
  Clone ID: LIB3068-032-Q1-K1-H11
cccacgcgtccgcccactcgtccgcccacgcgtccgcccacgcgtccggagcgatgggggtcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagacccctgccgtcgtggcgaccgaggaagcgccggtggtggataccccggctccgcccgtcgtcgtgccctgggagggtgcccccttcgccgaggccaaagtggaggagccagcttgcccggcggagaccgagccagc

SEQ ID NO: 53743 - DNA, 399 bp, Zea mays
  Clone ID: LIB3068-032-Q1-K1-H4
gagaaatccaggcaggtttcatgactggcagtgcaaaggcgaaggaaggtgacgttttctttgtgccggctcacaccaagggctggaaacgagccgagctcagtttggcttggtgcggtagcttggatcggctcggcttgtctactcaacaagctacaaaaggaggctcggcttgttatcagctcaccttgtctactgaacaagctataaaaggaggctcggctcgttattagctcacgaggaggctcggctcgttattagctcacgagccaccttgtctactgaacaagctataaaaggaggctcggctcgttattagctcacgagccaaacaaactcgcgagctgcaatttgataaataatattatattatataatgaattaatagtttatcgatgt

SEQ ID NO: 53744 - DNA, 279 bp, Zea mays
  Clone ID: LIB3068-037-Q1-K1-A8
acggatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagattgaaattttctcactc

SEQ ID NO: 53745 - DNA, 421 bp, Zea mays
  unsure at all n locations
  Clone ID: LIB3068-037-Q1-K1-A9
cagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgncgggctcgcctggtacccgggcgtcgcgtccggcgcggatgcccgtgtgcaccaggccgacaaggtgaacgagaagaccgtgcagtgcacgggacccgnncggcagcttccgtgccctctggtgtcgncgacggaccccgtggacttcaagccggaaagcaaggtga

SEQ ID NO: 53746 - DNA, 422 bp, Zea mays
  Clone ID: LIB3068-037-Q1-K1-B3
cccacgcgtccgcccacgcgtccggacgatagagaaggagctcaaccggcgggcggcggagacggcgagcaagcagcagctggagggcatcaggaaggtggccaagctccaagctgagtgcaggaggctgcaggccgcggcacaacggagggcgtcctccgtgaacgtcgagctccggcgttctccgagctcggcctgcgtcgagtcgctcacggattgccagtcggactgctccgactcatgggcctcggccctcgtcacggagctcgaccagttcaagaaggacaagagcggcgcgagcaccaggacagcgagcctcgtggccgcggacatcgacgtgatggacgacttcctcgagatggagaagctcgccttcgcgaacggctcgtcgaaaggcgacgccgtcgaggacgcgagcgggc

SEQ ID NO: 53747 - DNA, 399 bp, Zea mays
  Clone ID: LIB3068-037-Q1-K1-B4
cgcgtaccgcgatgaacccaggtcttcgacctacttcactgggattgaggagagacctgtcgccagggtcagggccgatgggtgccccctgagcctccaggtgttgcgatgccagaagcagctgctgctatacgtcaaccaaaggtcccttcaaagcagccctccagcgatgcctcttggtcagctggagagatgcatgtgaatggtgcttcaagtgcatcatcggatgctgtgactgaggtgcctgttaatagtgctaccacatgtgatgctggacacagcgagatcgaagaacaaccagtggccgtctaagtgaaaaaccgagaccagcctagaactgggaatcaatctaagagagatttgcggtttctggtacatactgaggtttgttatacattt

SEQ ID NO: 53748 - DNA, 55 bp, Zea mays
  Clone ID: LIB3068-037-Q1-K1-B5
cccacgcgtaacacgtacgcacgttttaacacgtgcttcaacaggtttattgtga

SEQ ID NO: 53749 - DNA, 388 bp, Zea mays
  Clone ID: LIB3068-037-Q1-K1-B6
gatgaacctaggtctttgacctacaacactgggattgaggagagaccgccgccgcctcagcgccgctgggtgccccctcagcctccaggtgttgcgatgccagaagcagctgctgctatacgtcaaccaaaggtcccttcaaagcagcccttcagcgatgcctctcgggcagctggagagatgcaggtgaatggtgcttcaagtgcatcaccggatgctgtgactgaggttcctggtaatagtgctaccacaagtgatgctggacacagcgagatcgaagaacaaccagtggccgtctaagtgaaaaaccgagacccagccagaactgggaagccatctaagagagatttgggggttcttgtacatactgggggttgtcatacatttc

SEQ ID NO: 53750 - DNA, 432 bp, Zea mays
  Clone ID: LIB3068-037-Q1-K1-B7
gagagagagagagcacgggatgggttgaggaacgagatggagggagaaagtgggcagcctgctggatcttggcatctcgccgccgccgctcacttccgctccacctgtttggtgcagtgtgggctagttatctactagtagtaccttcggccttcgggccagttcaagacttgccactggtgcagattccgttgatcccacatctgaaaagcaggggagtcgacgaccctcatggttttgaggataatatattgcatctctgcactgttctaagcgtgaggaagtaaagcattatttattggttggagtagtttctgttgctatccggcaccaatggcgactttggttcgtcatgattcaaggcagtactcttggtggtgggttagccatatcagccccaagaactcgaaatggctccaggaaaatctcagc

SEQ ID NO: 53751 - DNA, 470 bp, Zea mays
  Clone ID: LIB3068-037-Q1-K1-B8
gggagggatagtgcaaagctggataagaccaaggcctccataaacaagctgcaatcactgattgttgttacctctcaggctgccacaactacatcatcagccatcgttagagtccgtgacaatgagcttgcaccacagcttgttcagctctgttttgcgctattgggcatgtggaggtcaatgaaccatttccatgagatacagaatgagattgttcagcaagtccgtggtctggtggacagctccatggccgagtcaacatctgacctccacaggcttgcaactcgtgaccttgaagctgctgttgcggcgtggcactccaacttcgaccgcctcatcaagtatcagcgcgaatacatccgctctctgtatggctggctgaagctcacactctgccaggtggatagctgtgtgccacagggagcccatgcctcgatgatctcgcgcgaactcaccagcttctgtgacga

SEQ ID NO: 53752 - DNA, 348 bp, Zea mays
  Clone ID: LIB3068-037-Q1-K1-C12
cttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctccttgttttttgtgtactccctggactacgcgagaacaaagttggctaatgacgcgaaggctgccaaaggaggaggtgaaaggcaagtcaatgggcttgtcgatgtctaccgcaagacactcaagtctgatggtattgctgg

SEQ ID NO: 53753 - DNA, 466 bp, Zea mays
  unsure at all n locations
  Clone ID: LIB3068-037-Q1-K1-C2
cccacgcgtccgaaaaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcagcagcagaggctccggcagcagcagcagcaggcgctcctgatgcagcaagcgctgcagcagcagcagcagcagcagcagtaccagtccggcgtcctcgccgccgcggcggcggcggccatgacccagatggaacctggttccaatggcaaccttncacctgggtttgatccttccacttgtcgcagtgtgtatgttggaaatgtgaaccctaatgtcacggagagccttttgattgaagttttccag

SEQ ID NO: 53754 - DNA, 441 bp, Zea mays
  Clone ID: LIB3068-037-Q1-K1-C4
atcaacacctgccgactgctgcaggcaagtaaaggtactcctctcctcccctctgctgcagtcctctgcccgctgcagatcatggaggaggaagcatggcaggagtgtctgcatgggtcctgagagtcgcgtgagcagcgaagcagttcacggatggttggatggagggcaatgaccagctgctgagctgctgctgctcctcctggtcgaccatcagtttgtatttgtccatgcctcgtgtagccggcccgcttcttgccctggcttgtccagttccggaaggcgggcaagcccggtgaggcgtggacagagaccggcaagtcagagatcggcaatagtgagctccagcaggagcctacttgtactccttatttacccgttttaaggttcccttcttcgtgctggtcctcgtcttccttcgtttcttcttgtctgttccct

SEQ ID NO: 53755 - DNA, 169 bp, Zea mays
  Clone ID: LIB3068-037-Q1-K1-C6
acgcccacgcgtccggtgcagtggattctcatgttccgtccaggccttctacaagcacgggcacggcgcgcaatttgtttagaaaccctccatccttctttcattcttaccacaattctctcatcgatacctgttccgactttttaatctcacttattccaacttgctt

SEQ ID NO: 53756 - DNA, 466 bp, Zea mays
  Clone ID: LIB3068-037-Q1-K1-C7
gtcttgttggtcgaaaggattatgaaagatgtgctcatgatatctatttctttcttcagtgcccggtttgtttgaagcagttagcgttcgaactccttggagctgcttgttctttcttcatttccggagttggatggcactgtgaggaagtggcacgaagataaagagcaattctgcgcccagtaatgtttatcaaacgtttgaatttgtcacggggcggtgtttgtttccaacacatatcgtctttccagagtggtgtggcctgtgaattctgcgaaaataaggtggtggcttcagaggagtgcccgtggatatctcagtttgaagtggggtggtggctttgtgcagtgtgaatatggttagatagtgcgaggatatggtccctttttccaccgggccatggcagaacggtttttgtgcccgatagagttcattttcccccctccagatttggtatacgtaatgc

SEQ ID NO: 53757 - DNA, 469 bp, Zea mays
  Clone ID: LIB3068-037-Q1-K1-C8
cccacgcgtccgaagaagagaggtgttcgtgcgctcatcaggggtttaaatggaatctatgctatctgtcgtgagagttatgttcaaatcgccgagctaaaaaggaaaaatgtcgagtacaatgagaactttaggagatttatgttagagtcggacaactttaggcgttatgttggtcgtgtacctctgcgtcctgctccaccatacaatcctccgccgcctatgcccgacactctggatcagtgggttcagcagacatatggtgttcctttcgacgaagatatctctgatgatgaggaagaaatctctgatgatgaagatgagtccttctggtgaacatggtcattatggtggcttcttcttcttcttggttcttgttgctaaaagggagagaagttcgtgacatttgatctagtcttttgttgctggcagttgtgagagtgagaacctaaactatgtgggatgtaat

SEQ ID NO: 53758 - DNA, 284 bp, Zea mays
  Clone ID: LIB3068-037-Q1-K1-D1
cccacgcgtccgcccacgcgtccgctcacatgtcgggagcgataccactaccaataagcagcctatcgtttaatgttgcgatggcaccagtcgatataagctctaagtataccatgaaggcctaccgaggcgacagccgctcctactacgagtggagacccgtcgagatgtccatgcatgggcgctgcctaatcggagaagccgagctctctgtcgaccgcggaagcctcgcgcttggaaactactgctactcagccaaggtcgcctacgtagtctaaggcacg

SEQ ID NO: 53759 - DNA, 387 bp, Zea mays
  unsure at all n locations
  Clone ID: LIB3068-037-Q1-K1-A5
cccaggccttgaaggttgccaaggctgtgaagtctgggtcagtaaaaaagaccaagaagatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactctggtcttcattgtcgacctcaaggcagacaagaagaagatcaaggctgctgtcaagaagatgtatgacattcaggccaagaaggtcaacaccctgatcagacctgatgganagaagaaggcttacgtgaagcttacgcctgactatgatgctcctgatg

SEQ ID NO: 53760 - DNA, 216 bp, Zea mays
  Clone ID: LIB3068-037-Q1-K1-D10
ataaaaacatcccatatagcgatgaacgtttctgttacttgaggaggggtgacaacatgctggcgaaggtcgatacttccctactcaggctttgaactgtgcatttaaggactgctttaagacgttgatcaacttcgccaatgatagggatcgctatagcaagtgggaagctggtgacctggcctttacaggtgctgctcatgcttactctatggt

SEQ ID NO: 53761 - DNA, 131 bp, Zea mays
  Clone ID: LIB3068-037-Q1-K1-D11
aaaaaaaaaaaaaaaaaaaaaaaaaaaaataaaaaaaaaaaaaaaaaaaaaaaaaaaaaggaataaagaaaaaaaaaaaaaaaaaaaaaaaaaaaaaaaaaaaaaaaaaaaataaaaaaaaataaaaaaaa

SEQ ID NO: 53762 - DNA, 457 bp, Zea mays
  Clone ID: LIB3068-036-Q1-K1-F6
cccacgcgtccgcggacgcgtgggtgcttctacgagaggatatagagaggaagaacagctcgtgggagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgccttctactcgggcaacaacaagttcaggtgcaccgacaccttcctcggcatgtgcggccccaagtgctagatcagagaagaagaacgcgcgctgctgctagctgctatagcttcgttcttacgccgacggccggtgcatggttcacg

SEQ ID NO: 53763 - DNA, 474 bp, Zea mays
  unsure at all n locations
  Clone ID: LIB3068-036-Q1-K1-F8
cggacgcgtgggatggcatgtacttagggcgctagctctcctccgctagacacgtagggctctggtacaccccccattgtacacctggatcctctccttacgcctataaaaggaaggatcagggccctcttagagagggttggccgcgcggggacggggacgagacaggcgctcgcttgaagccgctcgctccctctcccgcgtggacgcttgtaaccccctactgcaagcgcacccgacctgggcgcgggacgaacacgaaggccgcgggatttccacctctctcacgcctgtctccgaccacctcactttcccccttcgcgctcggcctcgcgtcgacccatctgggctagggcacgcggcgacattcactcgtcggcttaaggaccccccggtctcgaaacaccgacaccagtggacttgttaaagactctatatgcccttgngtttgaatcatacccaagtaaaaagcct

SEQ ID NO: 53764 - DNA, 223 bp, Zea mays
  Clone ID: LIB3068-036-Q1-K1-F9
tcgtccactcgtccgcagaaagtgtgatttctttaaaattatttgtaagagatagagaatagggttgaggaacctttcctccaacctaagttatctccttttttgttttttttttccaaatcttgcttatgtgcatgtgattgtgtacggccatggttttgaaagttgttatcggatatggttatcctcggtgtgtggggtcttcataaattgcatcaagaat

SEQ ID NO: 53765 - DNA, 479 bp, Zea mays
  Clone ID: LIB3068-036-Q1-K1-G10
gcgctcgaagaagggcgtgatgcggcggctgatgcggtggagccggccgcggtgggccggggcggaggaggcggagtgcgcggtgtgcctggacgagttccgcgcgggcgacgtgctggcgcacctgcgctgcggccaccgcttccactgggcctgcgcgctgccctggctcgagggcacctcacggtgccccttctgccgcgccgccgtggacgccggcgccgccgccgacggcgcctagaagcggccgaggctctggtcttgctggggcttgcccgtgggacggcgcggggcgccttgtcgctgtcggcccacgccagccacgccacccccatggcgttgccacgctaggcagtggctagtgggggtggtcatggtgagtggtgaccggcctgcttgtgtggcgcggagcggaggaggacagcgagacgcgcacgacgaacccgtgagtgccttggcagttcttgcacgctttgcgc

SEQ ID NO: 53766 - DNA, 477 bp, Zea mays
  Clone ID: LIB3068-036-Q1-K1-G12
cggacgcgtgggcggacgcgtggggtttaggcacttatagtgcaagggcttccacggtgccccctgcagcaattgttgcaacaaaagctatgttgtctgacccaagggcagagcctcggtatgcagagagagtgccatatgttgtaatccatggggaaccaggagctcgtcttgccgacatggttattgatccttatggtctgctagaagttggctccccttatagattaaatgaacaatattacataaccaagcagattattcctgcattgcagcgtgtttttggacttcttggtgctgacctgaacaagtggtttaatgagatgcctcgccccatacgatcaactcttgcgaaacgccaatttgctgctgctcatggttcattctctcgtgatggcagtttcatccgattaggattgaataataaaacctcagccaaaggaggcagaatagatacatactacatgtcaagccact

SEQ ID NO: 53767 - DNA, 341 bp, Zea mays
  Clone ID: LIB3068-036-Q1-K1-G2
gcttgatgaatctgtgtctgctgcaattactgagaatgatattgttgctgctgctgtgttgtctggaaacagaaattttgaaggacgtgtgcatcctttaaccagagcaaattaccttgcttcccctcctttagttgtggcttatgcattggctggcacagttaatattgattttgagaaagaacctattggcatctcgaaagatggaaaagaggtttacttccgggatgtttggccatccacagaagagatagccgaggttgtcaagtcaagtgtgctccctgacatgttcaagagcacatatgagtcaatcaccaaaggaaatcctatgtggaatgagc

SEQ ID NO: 53768 - DNA, 246 bp, Zea mays
  Clone ID: LIB3068-036-Q1-K1-G6
gacgtcttcatcctttaaccatagcaaattaccttgcttcctctcctttaattgttgcttatgcattggctttcacacttaatattgattcttaaaaaaaacctattgtcatctttaaagattgaaaaaatgtttacttcctatatgttttgccatccacattaaacatatcctaagttgtcaagtcaagttttctcccttacatgttcaatatcacttttaattcaatcaccaaaatgaaattct

SEQ ID NO: 53769 - DNA, 343 bp, Zea mays
  Clone ID: LIB3068-036-Q1-K1-G9
gtgacgcgtccgacgtcctccgtctcgttgggcgcgttcgtgctcgcgacgcgcgtgatcacgcgcttgatcacgctcttctagaagctgatgcacgagcagacgatccgggagacgatccgctacccggtcaagttctacacgaagtagtacaactgggacgtgatctgcaacatgttgggcatcttcttcatcctctactgcatccagtacggcgtcgtgatccacgccttgatgcacaagttgaagccgaacgtgcaggagtacttgcaggagtactagttgctgttcgacttcctgtagagcctgcacaagagcctgttcatcttctacgacctgttcg

SEQ ID NO: 53770 - DNA, 131 bp, Zea mays
  Clone ID: LIB3068-036-Q1-K1-H1
cggacgcgtgggctagggtatccagtgggaagacgtgtagcctctagttgtacatgcatgtatgatgctgtgtagcaccgcatcatgcacaccacaccaatgcaaatgagttataaatgtttttaagctcc

SEQ ID NO: 53771 - DNA, 293 bp, Zea mays
  Clone ID: LIB3068-036-Q1-K1-H12
ctaagcccatggtagtggagaccttttctgaatatcctcctcttggtcgctttgctgtccgtgacgatgaggcaaacggtggctgtcggagtcatcaagagtgtggagaagaaggatccaactggagccaaggtgaccaaggctgccgcaaagaagaaatgatgtgtctggctggttctgtgtttgcttgagggaaacctagtggaaacataaaatatctcgtcttgttcacgtcattgtctgaactatgctcgcaacgtttgcctggtcgatttagaatggttattttcgtt

SEQ ID NO: 53772 - DNA, 412 bp, Zea mays
  Clone ID: LIB3068-036-Q1-K1-H5
cccacgcgtccgtccacacgtacgtccatgcatttgaacagctgcccatccaattctgggttgctgtccatccaacaagcgaattatggaccatgcatagatgttgtagctcgtcttattatgcatggctgactagatgcacgacaactacatcatggtttaccataccaaggtcatggagcatgtcctttgactcttagacggctagtgctccgaatcacctaggccaactgacagatgtcttttctctggaccataacgacttcgtcgagatcgagatcgatgacacgctggagatgctcaagcatctatgtcggtgaggtcagacatatcagcggcgaactgatccactttacgacaatcacgatgcccataatgacccatatcacgctcactgacctcaagtatttat

SEQ ID NO: 53773 - DNA, 461 bp, Zea mays
  unsure at all n locations
  Clone ID: LIB3068-036-Q1-K1-H7
gaggttataaacaataagggctatgatggagctaaggctgatctgtggtcatgtggagtgattctgtttgtcctcatggcggggtacctcccatttgaagattcgaacctgatgtcgctctacaagaagatcttcaaagcggatttcagttgcccgtcctggttctccacaagcgcaaagaagctcatcaagaagatacttgaacctaatgctaacaatagaataactattgcagagctcattaacaacgagtggttcaagaaggggtatcagcctcccagatttgaaacagcagatgttaatctggatgacgtgaactccatcttcgatgaatccggggagccagcacagcttgttgttgaaaggagagaagaaagaccatcagtgatgaacgctntcgagttaatctctacgtctcaaggcctcaatctcgggacgctcttcgagaagcaaacgggttc

SEQ ID NO: 53774 - DNA, 450 bp, Zea mays
  Clone ID: LIB3068-036-Q1-K1-H9
gcccaaagtgcacattgtatagcacaggggaaaattggcagtggttttgatgttagtgctgctgtgtatgggagtcaacgctatgtaaggttttctccagaaatactctcgtctcaggctacaggtgggactttcctcccagatgtagtatcagatattgttacacaaaggtgggatcatgagaataaacagttctcattacctcctctgatgacccttctccttggggaacctggaaccggaggatcatctactccatcaatggttggatctgtgaaacggtggcagaagtctgaccctgagaaatgcaaagatacatggagtaaactggcctttgccaattcagcgctggagaaccaactgcgaatcttaaaaggactttctgaaaatcaccgagaggcatatgagtcggtagtgctatcctgtagccatctcacttatgaaaaagtg

SEQ ID NO: 53775 - DNA, 295 bp, Zea mays
  Clone ID: LIB3068-037-Q1-K1-A1
cccacgcgtccgaaaaaaaaaaaaaaaaaattttaaataaaaaaaaaaaaaaaaaaaaaaaggaaaaaatattaaaaaaaaaaaaaaaaaatacatataaaattaaaaatacatacataaatattaaatttcttttatatatagttatttaaatttattctactcttatttttattaacatttttttttttaaaccattcctaatctaaactttattaattttctttaaaatcatttttttcttattttctatatttttacattagtatattcttttctattttcttatcaaatt

SEQ ID NO: 53776 - DNA, 52 bp, Zea mays
  Clone ID: LIB3068-037-Q1-K1-A10
gcgcagacacctgcgacgactctctcggactcatcggacaaccgctgcatct

SEQ ID NO: 53777 - DNA, 378 bp, Zea mays
  Clone ID: LIB3068-037-Q1-K1-A11
gagagtgtgtgtgagagagaggatgggtggcagcggcagggctgctctgctgctggccgtggtggtggtggccgtgagcctggccgtggagatccaggccgacgccgggtacggttactgcggcgggtacaccccgacgccgacgccggccaccccgaccccgaagcccgagaagccccccaccaaggggccgaagccggacaagccgtccaaggagcacaagccgtccaaggagcacgggcccaagccggagaagccgtccaaggagcacaagccgacgcctgccacgtacaccccgagccccaaacccacgccgtcgacgtacactcccaccccgacgccctccaagccgacgccacccacatacacttccggccc

SEQ ID NO: 53778 - DNA, 245 bp, Zea mays
  Clone ID: LIB3068-036-Q1-K1-F5
ccccctccaagccggctctgaaatttgaggcccaaagccccgttggcccccatcgccacgccgccggccacgccccagacgtaccccgccgccgtcgtcgtcttccgctcccttcgcgcgcagccctcgttccgccgtccgggtccgagcgcgctcgcttcttcttcccacgtcggacaggttaagtgtggcttcatcgcgtgagtagttgcagttagcgtggcttttcttcgtgcttgctcctg

SEQ ID NO: 53779 - DNA, 409 bp, Zea mays
  unsure at all n locations
  Clone ID: LIB3068-037-Q1-K1-A3
cccacgcgtccgcccacgcgtccgaagagatgtatgtgacaagttggtggagtctctgtgcagcaagcgcaaggaccaccctgcatatagttttttgtcagcaactgaatcatcttcattgaaaaatgacaatgttgggaatgaactcgacctaagaatagctagcgccctacagagtacaggacaccattatgaaggtggattttggagtgatggccataagtctgacatatctggcaagagacatgttgccatagtcaccactgccagtcttccctggatgactggaacggctgtgaatcctttgtttcgagctgcatacttggctaaatcntgcaaggcagatgtaactttgtagtgccctggctttgtaagtcggatcaggaacttgtgtacccaacagcatgac

SEQ ID NO: 53780 - DNA, 205 bp, Zea mays
  unsure at all n locations
  Clone ID: LIB3068-037-Q1-K1-A4
aattacccgggtccggacccacgccgtctctngatcacctnncttcgcctaagctagggcctgccactggccanngcaggtgccaccntngccatctctggctctggcgtctcgcaagggcacacgacccggcccgtcctggcacacagtntnggccatggcntgaccanntagccanncgatggggcgctgctnnngaagcccg

SEQ ID NO: 53781 - DNA, 351 bp, Zea mays
  unsure at all n locations
  Clone ID: LIB3068-036-Q1-K1-C3
accacgcgtccggagtggaatatggcaaccaatgagtcggtgtcgtgtctcagcaactatacaaggcacttagcgagccttagatgggcaatgtggatgactgtatgggttggaccatgcaactcaatcagtatcggatcacagatatngccttgacaaatcccggattattacagctactgcgtgccatagtttttttttatggcagatccatcttgagcattatagactgtcccggtactacttgtagactaagacaaaagtgatcttactgatcttttgattaaaatctataactattaaataaaatgttgtttgcaccttaattaagtaaattttttacatttaata

SEQ ID NO: 53782 - DNA, 470 bp, Zea mays
  Clone ID: LIB3068-036-Q1-K1-C5
cggacgcgtggggtccaggtctcgctcaccctggccgcgtcgctcgcctacgtctgcgtccgcgcgctccttcaccgcgcggggggcctccgccgtctgctccacctcgacagcctacgccgcgactccgaggacgtgcatgcgggctacgccgcgcagctcgcgcgctccttccgcgtcctcgcctgcttcgtgctcccctgcgccctcgccgaggccgcgtacaaggcctactggtaccgcgccgccgcggcctgcgccgtcgaggtcgcctcctgggtgtaccgcgtcgcgctcttcttcatggtctgcgtcctcttccgggtcatctgctacctgcagatcctgcggatggtcgggttcgcgcgcgagttcggcaggttcgccgacgtcgccaccgtgctgcagcaccaccgtcggatcatggagcagctcacgaagatcagtcaccggtaccgcaagttcatagt

SEQ ID NO: 53783 - DNA, 206 bp, Zea mays
  Clone ID: LIB3068-036-Q1-K1-C7
agcatgttgaattaaattgattaatgtgatactctattactcgtaccatttatcataaggttctgtatgcgaaaaaaaaaaaaaaaagaaaaaaaaaaaaaaaaaaaaaaaaaaaaaaaaaaaaaaaaaaaaaaaaaaaaaaaaaaaaaaaaaaaaaataaaaaaaaaaatattaaaaaacaaacaagaatttatattcattcaaa

SEQ ID NO: 53784 - DNA, 180 bp, Zea mays
  unsure at all n locations
  Clone ID: LIB3068-036-Q1-K1-C8
cggacgcgtgggcggacgcgtgggtgcacagataacttatacgctttatctatgcatggcnaactgggagcactcgagacagcagcagcggctttagttgagatgcatagataaagcgtataagttatctgtggtctagcgcgtacgtggaagcttgtggaggagcttggtgttgactac

SEQ ID NO: 53785 - DNA, 195 bp, Zea mays
  unsure at all n locations
  Clone ID: LIB3068-036-Q1-K1-D1
ctcttcattcaacgtggtcgcgtggcatgggaattatgtcccttacaaggtgtgtngtatgccattgtacacctgtctgccattgagatgtgtgtcgctgttcacttcaccccncttctctttcagtatgatctgagtaagttctgtccattcaacaccgtcctcttggatcatggcgacccgtcagtgaacaca

SEQ ID NO: 53786 - DNA, 434 bp, Zea mays
  Clone ID: LIB3068-036-Q1-K1-D10
cccactcgtccgcctccactctctaaaaagtagaccagccaggggagagaagtgagggatcgaaggaagcccccaccatggcggccaacggcaagagcagcttgtcgaacggcgcctccaccgggggaaagcccatcaaatgcaaagcggcggtggcgtgggggcccggcgagccgcttgtgatggaggaggtggaggtggcgccgtcggtgcgcctggaggtgctcgtgaagctgctcttcacctacatctgccacaccgatctcagtttcttgaagggagagaacgagctgcaccgcaagttcccacgcatactgagccatgaggcatccagagtggtggagagcgtgggtgacggagtggaggatcttgccgcctgcgaccatgtgatccccatcttcaacggcgagtgctgggcgtgcgcttactgcgag

SEQ ID NO: 53787 - DNA, 211 bp, Zea mays
  Clone ID: LIB3068-036-Q1-K1-D11
tccttaattcccaggtctacccactcttcctcccactcttcctcccactcttcctttaaaaaaaaaaaccaaaacaaaatacataaaagaaacaaatacaaaaacaaaaataagcccctacaatttttcaacaaacccacaatatcccatcataacaacataccaaacttcttatctctttccaccctcttacccaacctccaccttttcc

SEQ ID NO: 53788 - DNA, 152 bp, Zea mays
  Clone ID: LIB3068-036-Q1-K1-D3
cccacgcgtcctaaaaaaaaaaaaaaaaataattttaaaaaataaaataatatataaaaaaataaaagaaatatttaaaaattcaaacaataaaaacaataatacaaattactaaactaataaaatttatataatattatacaaatcttaat

SEQ ID NO: 53789 - DNA, 467 bp, Zea mays
  unsure at all n locations
  Clone ID: LIB3068-036-Q1-K1-D4
gaccccgccgacgtacactccaagccccaagccttccacacacccgacgcccaagccgaccccacgtacgtacaccccttccccaaagcctccgacgcccaagccgaccccaccgacgtacaccccttccccaaagcctccgacacccaagccgaccccaccgacgtacactcccacaccgaagccgccggccaccaagccgcccacctacactccgacgccgccggtgtctcacaccctcagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctnctctttgtgtgctggcatccgtccccgttagacgatcgangagagaa

SEQ ID NO: 53790 - DNA, 339 bp, Zea mays
  Clone ID: LIB3068-036-Q1-K1-D5
tccttaattcccggatccacccactcatccgtccacacgtccgtaacacaacactatattactcattcataaacatatactcattactaagacatctgttaacttcatcatgacaaaaagcatttgctcatcccactatcattttcatatacaattacactccctaactacacaattatactctattatcaagaataacataccataactaagctatcatattctacataaatcgtgctatcctttcactataattatataccttacaccttcaatataataactacttaaatctttcttcatttactacataacaccatatctagattaaacctatat

SEQ ID NO: 53791 - DNA, 469 bp, Zea mays
  Clone ID: LIB3068-036-Q1-K1-D7
tccacgcgtccggtcccgatgacgccttcgtcgtggtcgtcgtcctcaaccagccgctgccccgcgtcgctcccctcctctggtccagagcgtctgtgcgggtgtgcgcggacagtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgctgacgagtcacatgaccagtacacgaccgatttacacaaatgcatagctattatagctgataattattctgccactaacaaatctaaccagctcagcatcttggttcttgtagcacttgggtgaaggtatgatcacgagatgggatacatcaatgggctccatctgtgtccaagcataaatatcttcctcctatc

SEQ ID NO: 53792 - DNA, 326 bp, Zea mays
  unsure at all n locations
  Clone ID: LIB3068-036-Q1-K1-E2
caacaaccccccaccgtgagggacgcgaccaaacacacgcccctcttcgcacctcccaccaaccgcgacgagcggcgatgaccggcacggtgtccaagctggcggcgccccgtccggcggcaccgccgctccggccggcgtccctccgcaccgccgccctcgccttcgccccttccccgcgccgagtccgcgtttccgtcgccgggcgagccaggagccccatcattgcgatggcttcggccaaggaaggaagcggtgcaccgaccaagaggactgcgcttcatgatctctacgagctccagggcctgtccncggtgtacgacaac

SEQ ID NO: 53793 - DNA, 466 bp, Zea mays
  Clone ID: LIB3068-036-Q1-K1-E3
ctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttaggaaggaattgttgacaccgtggatggcggcaaccttaattgatttctacataaatgtctttgtgatat

SEQ ID NO: 53794 - DNA, 251 bp, Zea mays
  Clone ID: LIB3068-036-Q1-K1-E5
atttattcttttatttattctttttatttttttatttttattttaattattaatttttaggttctagtatattttaattcttgtttagctcatcttacaacatcaatcaaatcactaacaaatcaaccacacaacccaaactcccaaaccaacaaattcctaaaccttaatcaaacacaacaaaataaaacatttatccaataacaaataaacaaaaaacctaaaaaaaacctaataaccaacaaaattac

SEQ ID NO: 53795 - DNA, 410 bp, Zea mays
  Clone ID: LIB3068-036-Q1-K1-E6
cccacgcgtccgcccacgcgtccggtgacaaggaccgaacacccaaaaaggcacaagtaatgggcgcatttggagcggagggttttggaagtcaaccgaaagaggataaaagtagtaaagcctggatctaagacatcattcccgagtactgaagtacgaggaacctacgctccaccgttccatgtcgagctgtatcgcaatgaccagcaccgcttcaagattgttgtcgacggtgatactgaagttgacttaatggtgcaaacacggcacatgcgagaccgcatcatcctcacgatcagaggcctcgcccagaagttcaacagcacctccctcaacacacttctcaagatcgagtcatgatagacctgacagtgtaaaaaccaactataacgggaagctgtaccccttgt

SEQ ID NO: 53796 - DNA, 202 bp, Zea mays
  Clone ID: LIB3068-036-Q1-K1-E8
tccacgcactcgtgaactcatctctttaacatttccacaatctatggaacaacataggattagtgggcttcatcttcaaacgacgataattgctgttatggctatcagtctgcacaaccattacctagttcatagaaaaaagattctgccaaaccaacatacagcaagacccattctacatcttgaatgcaacacttattta

SEQ ID NO: 53797 - DNA, 473 bp, Zea mays
  Clone ID: LIB3068-036-Q1-K1-C2
gccctggaaatggagagcaactgtgtggcttaattaggctgacttggttgtataggaattttcagcaactacctgaacatccaaccatcaattaagattgcatatagcacccgagcttaccttctataccttgttggttccaccttgtttcctgacaccatgaggggatttgtatccccaagatatctaccactgttggcagattttgggaagatccgtgagtatgcttggggggctgcagcccttgctcatttgtataggggattgtctgttgcagtaacacctaatgccacaacacagtttctcggcagtgcaactttgctcatggcctggatttatgagtatcttcctattactcaaccacaacagaagaaccagagcacattgctgccccgggctagccggtggaactttggaggagcaacacgtggacagagaaaaaaggtcatggactggagaaaagtttttgagca

SEQ ID NO: 53798 - DNA, 470 bp, Zea mays
  Clone ID: LIB3068-036-Q1-K1-F10
gcgagctgagcaaggcggaggcggcgatggagcggctgcagcggatctttggcgcctccggcatggggcagccgccgacggactcgccgcttctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgcttgtgtgatagaccccatccagagt

SEQ ID NO: 53799 - DNA, 419 bp, Zea mays
  Clone ID: LIB3068-036-Q1-K1-F2
cccacgcgtccgcggacgcgtgggctgatctctttaacatgttgtcaatggatggaacaacagagaaagagtcagcttcatcttcaaacgacgataatggctgggatggcttccagtctgcacaaccagtacctagttcagagaaaaaagattctgccaaaccagcagaaagcaagacccagtctacatctggaatggaagacttatttaaagactcaccagctgtgccattatcctcagctccagctgtttcccaagtaaacgctaagaatgatatcatgagtttgtttgagaagtccaatatggtatcacctttcgctgcccatcaacagcagctggcgctcatgtctcagcagcaagctcttctaatggctgctctcaaagctggaaatgcaccacaaatgatgattccagggact

SEQ ID NO: 53800 - DNA, 454 bp, Zea mays
  Clone ID: LIB3068-035-Q1-K1-H2
cccacgcgtccgcccacgcgtccgcccacgcgtccggcagaaccttgaagttaaaaagataaatgatgagagaaaggctgcattggctgcccagtttgcagcagaagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaaggaggcagctctgctagaagcagagaggactgtgcaaattgctatggcaaaagctgctatggttgacgatttgcaaaacaagaaccaagagttgatcaagcaaattgagatctgccatgaagaaaataaaatcttagataagctgcatcgccaaaagattgcagaagttgaaaagcttagccaaactgtg

SEQ ID NO: 53801 - DNA, 441 bp, Zea mays
  unsure at all n locations
  Clone ID: LIB3068-035-Q1-K1-H3
gccaccggctaccaagcctcccacgcccaagccgaccccgccaacgtacaccccttcgccgaagcctccgagacccaagccgaccccgccgacgtacaccccttctcccaagcctccgacgcccaagccgaccccgccgacgtacactccaagccccaagcctcccacacacccgacgcccaagccgaccccaccgacgtacaccccttccccaaagcctccgacgcccaagccgaccccaccgacgtacaccccttccccaaagcctccgacacccaagccgaccccaccgacgtacactcccacaccgaagccgccggccaccaagccgtccacctacacttcgacgccgncggtgtcttacaaccccagcccggcggcaccatactactagaaagcgatgcctaccataccacacttgtgtcagtctctggagcattt

SEQ ID NO: 53802 - DNA, 390 bp, Zea mays
  Clone ID: LIB3068-035-Q1-K1-H6
accttccccaatcttccgcagaatcttgaaataaaaagtgaatgattagaggaaggcttcattggctgcccaggttgcagcataagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaatgaggcagctctgctagaagcagataggactgtgcaaattgctatggcaaaagctgctatggttgacgatttgcaaaacaagaaccaagagttgatcaagcaaattgagatctgccctgaagaatataaaatcttagattagctgca

SEQ ID NO: 53803 - DNA, 447 bp, Zea mays
  Clone ID: LIB3068-035-Q1-K1-H7
cccacgcgtccggttggcttctcctccccctccggttcgggttcgggttcgtgaggttcgccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggc

SEQ ID NO: 53804 - DNA, 447 bp, Zea mays
  unsure at all n locations
  Clone ID: LIB3068-035-Q1-K1-H8
gagatccggagcagccgcagtcccaccgactacgccgccggtcgccctacatctcctcggcggtgcctctcgtttctcttttcaataatcaagatgagccgcggtggtagtgccagcggtggtcaaagttctctgggctatctctttggaagcggcgagccccccaaaccagcactggcaccagctgcaagtgctccacctgttgagaaaccatctgctgcacagactgatgcggccaagcacgttgctgctgcggttaccagccaaaccaataactaccacagggctgatggtcagaacactgtcaacttacttactgaccgctcttcaaccaatgtccacgctgctcctggcggtggctcttccctgngctacctgttcggtggcaactgatgcccgtgctgatgcgctcaccaaagttatcctcccctgcctgctgcgtgctat

SEQ ID NO: 53805 - DNA, 375 bp, Zea mays
  Clone ID: LIB3068-035-Q1-K1-H9
gcggggacgcatgggagcacgatggccctcgcgctcgccaggaccccactcgcgcatctcgcccttgcccctgcctcgatcttcggctcccaatcctcgctgctgctgctcccgcgccgcgcgtcgcccgcccccgtctccctctctcaccgccgcatcatcgcggccgtcgcgaccaaggaacccgagctcggcggcggcggatcgggggccggcgacggtgccggagggagcggctgcggcagcgacccgaggggaggagggcaggaaggagactgtgaggaagagaagatggggcagggcctgtccatgtcgcataaactcaccctcgcctacgccgcgctcgtcagaacttgtggtgaaatgggatatatg

SEQ ID NO: 53806 - DNA, 232 bp, Zea mays
  Clone ID: LIB3068-036-Q1-K1-A2
cccacgcgtccgcttgctggccgtgatctgactgactgcctaatgaagatcctcacggaaaggggggattcctggaccacgacggcagaacgggaaatcgtgagagacataaaggagaagctggcctttgtggccctagactacgagcaggagctggagaccgctaagagcagctccttcgtcgagaagagctaccagcttgcctattggcatgtcatcacgatcggcgcgg

SEQ ID NO: 53807 - DNA, 203 bp, Zea mays
  Clone ID: LIB3068-036-Q1-K1-A3
ccacgcgtccacataagctctaatactgatctcactgatccactatgactatgccaaatgcaaactctccgagggtctctgttgcccagcttgttatctttctgctatcactcctcagcactgtcgcctgccctgacgacgcacaaaactgcagctgccaaccaaacgtatgctgcaacaagtttggctactgaggcacgacc

SEQ ID NO: 53808 - DNA, 459 bp, Zea mays
  Clone ID: LIB3068-036-Q1-K1-A5
gccaaacagggcgactcacaactgttacaacgccaaaactgccatgtttctcacgaggcagacagggatcctactaaaggcattttttgtcacaaaaacatgctacgttcaaggaatgcactcctgctgagctagcggcctatgccttcaaaccagcaactgaaaccggaatatcatatgacaactaagcatcatgcatgctgctcagcaccatacctagacagacgctgcacgtttagcccaatctgcaaatcagaacctacagattctgcctgaattatgaacttctttccctactgcacttctcgatatggtgctcatcatgtgagtgaatcagatcttacttattgtcgattcgctagaagtgtgactggtaattggagtctataaacccgtgttaggcttcttacatacaactgttactacacccaagttagtagaacccttggactacttgcc

SEQ ID NO: 53809 - DNA, 244 bp, Zea mays
  Clone ID: LIB3068-036-Q1-K1-A7
ccacgcacgcgtccgaccacacgtccacagaagctcaaatactgatctcaccagaccatcacaacatgccaaacgcaagcgcaccgagggtctcggcggaccagctttttactttctggctatcactcctctgcgctgtcgccggcccggccgccgcgcagaactgcagctgccagccaaacgtatgctgcagcaagtttggctactgcggcacgaccgaccagtactgcagcgacgggtgcca

SEQ ID NO: 53810 - DNA, 187 bp, Zea mays
  unsure at all n locations
  Clone ID: LIB3068-036-Q1-K1-B1
cccacgcgtccgtccacgcgtccgcagaagctcaaatactgatctcactgatccagtatggctatggcaaangcaagcgcgccgagggtctcggcggcccagctggtgactctcgggctatcactcctctgcgctgtcgccggcccggccgncgcgcagaactgcggctgccagccaaacgtatgct

SEQ ID NO: 53811 - DNA, 156 bp, Zea mays
  Clone ID: LIB3068-036-Q1-K1-B2
tccacgccacgcgtgtcgaccactcgtctccccacgcgttctcagaatctcataatactgatctcactgatccagtatgtctagggctaatggagacactccaagggtctctgcggcccatctgccaactctcgggctatcactcctctgcgctgt

SEQ ID NO: 53812 - DNA, 348 bp, Zea mays
  Clone ID: LIB3068-036-Q1-K1-B5
gcggagcgggaggccttcacagaccgtatcactcttctaccattatcttatgttaactgtgcgagtggtcacactcctgacgggacccgaaagatcatctactatctctgagcctatcaaatccatacgatactctcgtgcaggctcgaagccatacttacgtgcaaatcgctcatctgtcttgtatataggttcgatacactaatccaaccatctagtacttggttcactcctaactttccctcacgatagctgtagcccacactagttctatcggctaaagccaatgattatatgcatccttttctcaacgctctttacctatcttcatactttacctagctatta

SEQ ID NO: 53813 - DNA, 271 bp, Zea mays
  unsure at all n locations
  Clone ID: LIB3068-036-Q1-K1-B7
cgtctaatggaggcatagaatgcaaatgttttatttgccaaacgtgaactaagtgattanaacactttctcatatgagaaactcacgaagtctttttatcagttactactttttgtatactcgtttgcttaatctctcgatattcattctccaatgattccatatcatttaattactacttgagttacttcattatacttttcctttccttttattggtaattattcatctttattttaacttattttgtattatttatcttctaattctt

SEQ ID NO: 53814 - DNA, 308 bp, Zea mays
  Clone ID: LIB3068-036-Q1-K1-B8
cccacgcgtccgaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaataaaaaaaaaaaaaaaaaaaaaaaaaaaagggcgccctttataaagaaccaaagttaaattacccttacttccaacataaaacctcttataaagacaaccttaaatcaaattaattgcccattgtttaaaaacctcaaaactggaaaaaccttgacatttccaaatttaataaccttaaaaaaaatcccctttt

SEQ ID NO: 53815 - DNA, 449 bp, Zea mays
  Clone ID: LIB3068-036-Q1-K1-B9
cccacgcgtccgggaagatcccaatgctatcttcagctcgaactacatgcttctggggaagatagtggtcaaccaagctgatgatgttgcatgaatcatctcatcgaaggctggcctcaagtatctgggtcctgatgttgatgctatgaaagctgtggccgatgcctactccaaaaggtctctgaagtacttcgaaactgctctccgtgattacaaagctcagctggaagaagatcctattgtccacaggcacctttcctcgctgtatgacactctcttggagcagaacctctgcaggctgattgagccctactcaagggtggagattgctcacatagcagagatgattgatctgccaatgaaccatgttgagaagaagctgtcccagatgatcctcgacaagaaattcgcatggacacttgatcaaggcgctggctgtctcatcatct

SEQ ID NO: 53816 - DNA, 333 bp, Zea mays
  Clone ID: LIB3068-035-Q1-K1-H12
attcaatgataaggaactgtatgttggaagagcacagaagaagtctgaaagagagatggagttgaaggagaaatttgaaaagaatgttcaagaggtagctgagaagttccaaaacacaaacttgtatttgaagaacttagaggagaacattgatgatgagaaattgcgtgaactctttgctgagtatggcaatattacttcctgcaaggttatgcgggattcgaatggtgtcagcagaggttctggatttgttgctttcaaatctgctgaagatgctaaccgagctcttacggagaagaatggcaaaatggttggaaagcagcccctttatgt

SEQ ID NO: 53817 - DNA, 456 bp, Zea mays
  Clone ID: LIB3068-036-Q1-K1-C11
gttacttctggtgtcgagaaaggttaccttcgcgagcttgctttggctcgaatggaggatctgggcttaaaatgccgggacgtcagaacccgtgaggcagggattcaggatatccatcacaagatccggccagatgaagtagagcttgtcagacgtgactatgctgcaaatgagggttgggaaacattcctctcttatgaggatacacgacaggatatcctgatcgggctgttgcgcttgcgtaaatgtggccgtaatgttacatgccctgaacttgtaaggaggtgttcaattgtgcgtgagcttcatgtctatggaactgcagtccctgtgcatggccgtgatgtggacaaactgcatcaccagggatacggaactctattaatggaagaagcaaaaaggattgctcgaaaggagcaccgatcgaaaaattatctgtcattttcgggttggtac

SEQ ID NO: 53818 - DNA, 367 bp, Zea mays
  Clone ID: LIB3068-035-Q1-K1-F12
cccacgcgtccgcccacgcttccgatcaaatacatagtgaggtccttagtgctttgttcgacctttgcaaaattaataaaagaagacaagaacaagcagccgaaaatggaatcatccctcacttgatgaaatttgtcatgtcagactcacctctgcggcagtatgccctgcctttgctgtgtgatatggctcatgcttctcgcaactctagagagcagttgagggttcatggaggactagatgtgtacttaaatctgctggaggatgatgcatgggcatgcacggcattagattctattgctgtttgtttggctcatgataatgatcacagaaaagtggaacaagcactgttgaaaaaagaggccat

SEQ ID NO: 53819 - DNA, 346 bp, Zea mays
  Clone ID: LIB3068-035-Q1-K1-F2
gatatatacaaaatcggaagaggtcaaatgagggcttttggaaaacctattgctgtagaatacacatcatatgccggtgaaaccccatctttatctatgtctgtacaccacaactcgaaacaatatgctatcacaacactaccaactacttttgatcacggctttcctgctctgtcagaccctattacacatactgcgaactctattcataatggtactgggaacaaccatacacatgagaatcattggttgtctcaggatgagcctcactctgcagttcagttcacaggcatttaggcatctgttgatcaatatctatctgtggcatcactggaccaacctatgt

SEQ ID NO: 53820 - DNA, 448 bp, Zea mays
  Clone ID: LIB3068-035-Q1-K1-F3
ctctcctctcctcggcggatccggcaccgacccaccgcccctctgctcgctccttccgccggaatcgctgctcctctctgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatggagaaaatctggcaccacaccttctacaatgaactgcgtgttgctcctgaagagcacc

SEQ ID NO: 53821 - DNA, 451 bp, Zea mays
  unsure at all n locations
  Clone ID: LIB3068-035-Q1-K1-F4
cccacgcgtccgcccacgcgtccgcccacgcgtccggaaactgctgaagacgctgaagtggatcaaaagaacttggaaaataaagatgatgtaccgaacactgaaaaaggttcctcaatgggggtggattctgacttcacttctgaatgtaaaaccaaaactgtcaataatatgaaccattctgggattactttaaaagaaaagagcagcgatcctcctgtcagtaacaagaaacaggattctgcagttgagcctgcctccaccgcaccaaagagaagaaaggttttgaagacacgcatagatgagaggggaagggaagttactgaggctgtttgggagggtgaaggttctgcagatgacaaggcagagaagaatgtcagcacaactgctgcgagcggngcgactatcccaagcaaaccgaaaccagcaacaagcaccgacaaaatcaaag

SEQ ID NO: 53822 - DNA, 191 bp, Zea mays
  Clone ID: LIB3068-035-Q1-K1-F5
cgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 53823 - DNA, 438 bp, Zea mays
  Clone ID: LIB3068-035-Q1-K1-F7
cggacgcgtgggcggacgcgtgggcgaactcgaagcttgcgttcttgtagtataggtcggcagcaagcggtggtagagcgagaggtctagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgacacctgcaagaactgcgtccccgtgtccacggacaagggggccatcaagtacaggtgccgagacttgctccccgaaaactgctgctgcaagatccactatagactcatccaattccaccatggccgcgcgccacagcggcacagccgatggatccttccatgttcctacgtccgt

SEQ ID NO: 53824 - DNA, 419 bp, Zea mays
  Clone ID: LIB3068-035-Q1-K1-F8
cgttccattctttcttaaactttttactacgctttattgggttatattaaggtggaatttttttatgatgtaccctacactgaatatggtttctaaatggaggtggataatgacttcacttatgaatgtataaccaatactgtcaatattatgaaccattctgggattactttaacagaaaagagcatttattctgctgtcagtaacaataaacaggattctgcagctgaccctgccttcaccgcaccaaagagaagaaaggttttgaagacacgcatagatcacagcggaagggaagttactgacgctgtctgagacggtgaaggttctgcacatgacaaggcagagaagaatgtcagcacaactgctgcgagcggtgcgactatcccaagcaaaccgtagccattaccaagcaccga

SEQ ID NO: 53825 - DNA, 444 bp, Zea mays
  Clone ID: LIB3068-035-Q1-K1-G11
attcccgttcgacgcacgcatgcggcacgcatccgcccacgcgtccgcccactcttccgggatatcatcaaaacctgcatgaagcaccattagtagaaattgtagcccatgttgcaaaagcttaatgttaccatgaaggctgatgacaaggagttgattggcaaagctttgatgaagcgtgttatgcaaacgtggctaccagccagcactgcacttcttgagatgatgatattccaccttccttccccggcaaaggctcaaaagtatcgtgtggagaacttgtatgagggaccccttgatgatgtttatgcaactgctatcagaaactgtgatccgtatggccctcttatgctgtaatgttcaaaaatgattccaacatctgacaagggcatgttcttttgtcctttggtcgtgtcttctcatggaaggttgctactggtatta

SEQ ID NO: 53826 - DNA, 302 bp, Zea mays
  Clone ID: LIB3068-035-Q1-K1-G12
cccactcgtccgaaaaaaaaaaaaaaagattaaaaaaaaaaaaaaaaaaaaaaaaaaaaagaaaaaataaaaaaaaaaaaaaaaaaaaaaaaaaaaaaaaaaaaaaaaaaaaaaaaaaaaaaaaaaaaaaaaaaaaggacagacctaatctaaaaaaatccaaattttacttcccctttcttgcaaccaattactttttcttttggttcccctaatttaatttaactggcctgtatttaaaaactttttaactggaaaaaccttaactttcccaaactaataaaactttaagcaaatcccct

SEQ ID NO: 53827 - DNA, 262 bp, Zea mays
  Clone ID: LIB3068-035-Q1-K1-G2
cggacgcgtgggcggacgcgtgggcggacgcgtgggatagagtactacagtacagtatatatatatatatgctgtactgcaggccacacatacatatataatagagtactacagtacatgatatagatgtatacatcgagttctaaatgctccacgaagcgggccgatattattgaccattcaagcgaaacatttacatagcagacgaccgattctactgcgagaaccatgaaacagaattttggagcgaatcctgtctcca

SEQ ID NO: 53828 - DNA, 460 bp, Zea mays
  unsure at all n locations
  Clone ID: LIB3068-035-Q1-K1-G4
cggacgcgtgggaaagagcggtctggtttcgagggggcctggactacaaaccctttggtctttgacaactcttacttcaaggaacttctgagtggtgataaggagggccttcttcagctcccaagtgacaaagccctgctgagtgaccctgttttccgccctcttgtcgagaaatatgctgcggatgagaaggctttctttgatgactacaaagaggcccacctcaagctctccgaactggggtttgctgatgcttaaatagaccctatcctggagtgatacattctgctgcatgtggtcttttgcatctggagtcaatgtgaacaagcagattgtcgtattgtctttctcgtaataaatttgtcaatgttgagcccttaggcttgaattgtgggaccctttgntcgttttcctagactctgatgctgtatgcaactgaaacgagtaaatctatgatctt

SEQ ID NO: 53829 - DNA, 430 bp, Zea mays
  unsure at all n locations
  Clone ID: LIB3068-035-Q1-K1-G6
ggcgtggccgaggtgttctgcctcgtcgcgctcctggagttcctgtaccaggaggcgcccgacgcgatgcgcagcgtcgggtccgcgtacgccgccgtcgccggcgggctcggctgctttgtggcgtcggcgatcaacaccgcggtggacgccgcgacgcgggacgatgaggaggggcggccgtcgtggctggcgcagaacatcaacgtgggcaggttcgactacctgtactggctgctcgccgtgctcagcacagtcaacctgctcgttttcgtcttctttgccaagcggtacaagtacagggtcagggtcgacgtgccgaccacagttgctgttgataagcagtagctagccgctagcgccattacaaggatttgagtttggatgtgctgtaactattgattactgggaataccatanaacatagatc

SEQ ID NO: 53830 - DNA, 383 bp, Zea mays
  Clone ID: LIB3068-035-Q1-K1-G7
caaatgctactcattatagggatttcgacaaaacgaatttattcatcactaaagccgaagtcagtaggagtactattagcgtgctgattcagacctcgagctcgaggacgtagttattctataaaaaaaacgatgtgtaatataacaattgtactaaatatagtaaagaaatcaaaataatctttagatcaatctaagatttcgattcccagtaaaaaaaaaagaaatataatagaaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatac

SEQ ID NO: 53831 - DNA, 339 bp, Zea mays
  Clone ID: LIB3068-035-Q1-K1-G8
ccggaccaacccttccaacaatcgaatcgaatttcggagcccaccaacttctaaaccccttgcgggtcaatacaggggagattcaaggaacctcttaaggggcattaacaaggccttcttctaaatgccacaagacaaaaccctgtttagagaccctgttttactgcctcctgtggcgaaaaattatgcgaatgagaaagctttcttttatgactacaaaaaagaccacctcaaactcttccaactgtggtgtgctgatgcttaaatatacactatactggagtgatacaaactgatatatgtaagcttttgcatctcgagtcaatgtgaacaaacaca

SEQ ID NO: 53832 - DNA, 359 bp, Zea mays
  Clone ID: LIB3068-035-Q1-K1-H10
cggacgcgtgggcggacgcgtgggttgccgtctcccttttgcgtgagcaaagaaagagggcgagaagagcagtcgccatgtctggcatcatccacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagacgaaggagaagaagaagcacggcgagggccacgaccacgaccacgac

SEQ ID NO: 53833 - DNA, 375 bp, Zea mays
  Clone ID: LIB3068-035-Q1-K1-H11
gacccacgcgtccgcccacgcgtccgcgcacgcgtccgagataatcgaaatcgaaaagagctgtctctggggtatactttccccgttctattgctaccgcgggtcttatgcaatcgatcggatcatatagatatcccttcaacacaacataggtcatcgaaaggatctcggacgactgaccaaagcacgaaagccagttagaaaatggattcctatttgaagagtgcctaaccgcatggataagctcacattaacccgtcaattttggatccaattcaggatttttcttgggaagtttccgcaagaaattggaataatatcgattcatacagaggagaaagctctgtatcgatgcaaacgctgtacctagaggat

SEQ ID NO: 53834 - DNA, 465 bp, Zea mays
  Clone ID: LIB3068-035-Q1-K1-F11
ttcccgtttcgacggactcatgcggggacgcatggggttcatgaaaggtgtggaacaggggccgtagattgacgacgagcaatggaacaagaggttgcgctacattaggtatggtgttgacggtggagctacccttgtgacgggtggtgataggttgggtgacaagggtttctacatccagccaacgattttctcagatgtccaggacggcatgaagattgctcaggaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcagggccgggaccgtctgggtgaactgcgttcgacgtcttcgatgcttcgattccgtttggtgggtacaagatgagcggcatcgggagggaga

SEQ ID NO: 53835 - DNA, 157 bp, Zea mays
  Clone ID: LIB3068-035-Q1-K1-D10
gcacattgcaagtaatgaattataatggtttatcactgacagattcgcacagatctttgagagcatgtactctcgacacaaagcgcatctcaagatcattacagagcttaaagcgtccgatactctcgttgctacactgcaaacaagtgtgcatcac

SEQ ID NO: 53836 - DNA, 308 bp, Zea mays
  Clone ID: LIB3068-035-Q1-K1-D11
gcgggaaaacaggagccgtttatattacacggtttaaccgggtttatattaaactacatcagggattgtctagagtatttaaaaatgagcgctactacggaccaaatatattacgccatacaacctcctgacaattacatgggcatctaatcatctacatgggtagaactagagcgttaagaactagaagtcactgtttcgagtgaaaatgtactttgtgaagatgtaacttttttcaggaattgcaccattgccgtcatcaatcccaagagtgcttcattcttttgtacaaatgcttcaatcatata

SEQ ID NO: 53837 - DNA, 433 bp, Zea mays
  Clone ID: LIB3068-035-Q1-K1-D2
gccacacgtgcgcccacgcgtccgcggatatacaaattgcgcgagtactagggaaggcaggaacaatagcaggggctggctacttgagattagcaggaagacctgccgtgcttactttaaatactctatcttattcagagaacttcttgtacatgctggactctatgggtgacagaacatataaaccaaatcctcgacttgctcgagctctagatattctttctattctgcatgctgaacatgaaatgaactgctgcactgctgctgttaggcaccttgcttcaagcggtgtggatgtatttactgatctttctggtggtgttggagctctatatgagcctctgcatggcggcgcatacgaggcagtacttaaaatgttaaatgacattggaagcatggaaaatattccagatttcattgtaggagtgaagaa

SEQ ID NO: 53838 - DNA, 132 bp, Zea mays
  Clone ID: LIB3068-035-Q1-K1-D4
ccggtggcactccataccatacgtattccatttttttatctcactttctacaatttacttctggggaactactggggcagcattaaccaaacatgtgaccattcattaaactactcacagtacgtcctccat

SEQ ID NO: 53839 - DNA, 351 bp, Zea mays
  Clone ID: LIB3068-035-Q1-K1-D5
cccacgcgtccgcccacgcgtccgcccactcgtccgcccacgcgtccggccacgcgtccggcaacgcaaatctctgttatgctgccaccggccggcaaagtagtggtacactaatataatgctctccggtttgattggtggctcttgtggtgtgtgggagccacgtaatctttgcttggaagggaattgcgttgtacaatgatgaaatgggccgggtaatgcatgggactctggtcaagtatttcgagttaaaaaaaaaaaacatccaaatttaaactaatgaagaaataaataaaaggctaattccgtaaagttcttatcaataggtttacattctgaattgagttaatg

SEQ ID NO: 53840 - DNA, 250 bp, Zea mays
  Clone ID: LIB3068-035-Q1-K1-D6
gtcacggggactcctgccgctacgcgcacaccgaggaggagctccgcccacggcccgacggcacctgggaccccacctccgaccgcgccaaggagctgcgcaaggtcgccgcggaggcccaggaggaggccgaggaggaggtcacggtggatgagcagtcactcgacaagtgcctcgtcgggctccccaggggctggacggctgataggctcaagtccttgctccaggatcagggaatctcgtatgcaac

SEQ ID NO: 53841 - DNA, 262 bp, Zea mays
  Clone ID: LIB3068-035-Q1-K1-D7
gtcacagtgactactgcctctacacgcgctctgaggatgagctgcggggacaaccagacgtcacctgggaccgcacctccgaccgcgcacaaggagctgcgcaatgtcgccgagcaagctgaccaggagaccaagaaggagctcacggcggattagcagatacctagacatgtgcctcgtacatctcaccatatactgtacgtatgataggctcaagatctagctccatgatcagcgaatcacatctgcaacaaatacaaaa

SEQ ID NO: 53842 - DNA, 440 bp, Zea mays
  Clone ID: LIB3068-035-Q1-K1-E10
cccacgcgtccgctgcaccacacgcaggttcgcacgaactactcgctgagcatgccgctgtacgactacgtatacagcaccatggacaagtcgtgcgaccagctgttcgagacctcgctcaggggagcggaggagacgcctggcctcgtccacctcacgcacatgacggacctgcagtcggtctaccacctgcggatcggcttcgactgcgaggcgtccagaccgtctgccaccagcgccatgtggtggtacatgtgggtgctgaggaccgtggcgtggctgtccatggcgctcgcgtgggcctacgggtccttcgcgttcgtcgtcgagaggatcaaactctggaagctgatgatgcaaacgtgggcactaccaagatacaacttccagtacggtctgagctgggagagagaatcgatcaacggcctcatcgaaagggc

SEQ ID NO: 53843 - DNA, 433 bp, Zea mays
  Clone ID: LIB3068-035-Q1-K1-E11
gagagagaggatgggtggcagcggcagggctgctctgctgctggccctggtggtggtgggcgtgagccgggccgtggagatccaggccgacgccgggtacggttacggcggcgggtacaccccgacgccgacgccggccaccccgaccccgaagcccgagaagccccccaccaaggggccgaagccggacaagccgcccaaggagcacaagccgtccaaggagcacgggcccaagccggagaagccgcccaaggagcacaagccgacgccgcccacgtacaccccgagccccaaacctacgccgacgacgtacactcccactccgacgccccccaagccgacgccatccacatacactgccgaccctacgccccacaaaactcacaccaaaacccactgccactcctgcgacgtacacttcaagccccaaacc

SEQ ID NO: 53844 - DNA, 454 bp, Zea mays
  Clone ID: LIB3068-035-Q1-K1-E3
cccacgcgtccgcccacgcgtccgctcggattgaagagaagctggttcaacaagctgagggaaatcaggagttggattcaataccaaaacgttccagggagcatgctgatcaagaacttgaagtagagagaactgcacaggctgggttggaacaagagtgtgactctgtgccaattgattctgaggaacacggttgcctgacttcatatgctcatactgatgatgagcaagatgaggtgaagcagaaagtcacttctgaaacagcagatgttctacattatgcagcagacacttttaatgttaacacaaactcatggaaagaagatattgaagaggatccaactgaagctgctctaacagccatacatcaaatttgttacgaacctttgacgagcatagtcaagttctctctagatcacagtgtctccgaagaagacagagagcctgatacgcc

SEQ ID NO: 53845 - DNA, 449 bp, Zea mays
  Clone ID: LIB3068-035-Q1-K1-E5
gcgcacgcttccccaagccttcgctcggattgaagagaagctggttcaacaagctgagggaaatcatgacgtggattcaataccaaaacgttccacggagcatgctgatcaagaacttgaagtatagagaactgcacaggctgggttggaacaagagtgtgactctgtgccaattgattctgaggaacacggttgcctgacttcatatgctcatactgatgatgagcaagatgaggtgaagcagaaagtcacttctgaaacagcagatgttctacattatgcagcagacacttttaatgttaacacaaactcatggaaagaagatattgaagaggatccaactgaagctgctctaacagccatacatcaaatttgttacgaacctttgacgagcataatcaagttctctctagatcacagtgtcttcgaagaagacagagagcctgata

SEQ ID NO: 53846 - DNA, 381 bp, Zea mays
  Clone ID: LIB3068-035-Q1-K1-E6
aaacaaaaactgctctccttctagaccttatacaaaaaattaaaacgagccaaacatggagaaatttaaaaactcctgactttctaaagcatccaaatttccctccccataccttccaatttataactcttttatagtgcaacctaaactaaattcacttgcccacattttacaactttctgaccggtaaaacccttacattacccaactcaatggccttgcctgacaatccccattttctaacttgcgcaaatgccaacacgccctaactcatcatattttccaacaattccccttccttaatgcccaatgatacacctccttttaccggtcattaaacaccttatgatcttggtgatacatctcaaaatttacctttac

SEQ ID NO: 53847 - DNA, 447 bp, Zea mays
  Clone ID: LIB3068-035-Q1-K1-E7
ctccgacgtacaccccgacccccaagccttcgacacctaagccgaccccgccgacgtacgctccaagccccaaaccttcgacgcccaagccgaccccaccgacgtacactccttgcgccaagcctccgacacctaagccgaccccgcctacgtacactccaagccctaagccaccggctaccaagcctcccacgcccaagccgaccccgtcaacgtacaccccttcgccaaagcctccgacacccaagccgaccccgtcgacgtacaccccttctcccaagcctccgacgcccaagccgaccccgccgacgtacactccaagccccaagcctcccacacacccgacgcccaagccgaccccaccgacgtacacccctttctcaaagcctgcgacgcccaagccgaccccatcgacgtacaccccttacccaaagcctgcgacaccca

SEQ ID NO: 53848 - DNA, 411 bp, Zea mays
  Clone ID: LIB3068-035-Q1-K1-E8
gtgagtgcttaaactgcttgcaggtttggctagtagacagcatcgacggggaggaacaggagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacggctgatgagcgcctggcgcatcggcgggatacttcacgccctggaagggtggaccgtgcacgagtgtggggacgccatggtgcatgctgagaaagcatggtcagctgctattaagcacggattcgttcctttgacgaaagcctgaaagcctgtacgcaactctagacgccattcgacgatggctggaaaactacgtttca

SEQ ID NO: 53849 - DNA, 273 bp, Zea mays
  Clone ID: LIB3068-035-Q1-K1-E9
gcggccacgcgtccggcccgccactctggctcgccgccgtgttcctgaacacccgttccgatcgttgcccaggaggtctacttgggcatcaataagaaactctttcccctcaaactgattgtggttccatcctcttctgtctggaaaatgttgtcaccaaactaccctatttcctgttccagtttggcatggaagtataagttgtgtacttctattctcaagttgttgtctttgtattatgaaatgtttccaataatcagcagtttttgatgt

SEQ ID NO: 53850 - DNA, 432 bp, Zea mays
  Clone ID: LIB3068-035-Q1-K1-F1
cggacgcgtgggcggacgcgtggggtcgctgggggcgaggatcctgcgggcgggcggcgtggggaaggtgttccggcgctggttctcctcccccgtcggcgggggcggcgagcggctgctcagggcgtcgcagtgctacctgtcgaccacggccggcccgatcgccggcatgctgttcgtgtccaccgagagggtcgcgttccggagcgaccgctcgctggcgctgccgctgacgtctccggccgccggcggcaccacgacggtgctgcgggtgccgtacaaggtgtccatcccgctgcgcagggtcgcggcggccaggccgggcgagaacagggaccgtccggaccacaagtacgtgcaggtcgtcacgcgcgacggcttcgacttctggttcatgggcttcgtcaggtaccaggcgtccctgcaggagct

SEQ ID NO: 53851 - DNA, 441 bp, Zea mays
  Clone ID: LIB3068-035-Q1-K1-F10
tcgaggagagagagagagaggggaagagagagatagagagagagagatagatggggtaactcgggaactgttcttatgcatgcagcagccataagcattgctactagggtttcatgcggggcgaagcagttggtctctgccgcctgaacgccgccggaatctgcgaggcctccccgagctgcgtccgtcgtcagataaggcagacgccggcacggcaatgccggttcctcttgctccgtacccagctcctccggcgccattcacgccgcccaatggggcccagagccagctcgtctgcaccgggtgccggaacctactcatgtacccagctggtgcgacgtctgtctgctgcgccgtctgcagcaccgttattagacgtgccggcttcatgaactgagatggcgcagctagtgtgcggaagatgccacacgcttcttatgt

SEQ ID NO: 53852 - DNA, 323 bp, Zea mays
  Clone ID: LIB3068-035-Q1-K1-C9
cagccacttacacgtgacacacaagtgcttgaaaacacggcacaccaagtggagcattgattttattactacttcctgcaaactaaaagcacattcaaccagaaatatactgggcctgtctggtccatcaacagtgctggcccagaccggcctattacactacaggacaccacatgcatgcggtccattccactgaccaagcatgttgatgccataaaatcggcgcatgtgatcgcctctgagaaagctgcaacggcgccacgtttgtccggctaaaagttcacatgcctttcaaatgtgaacccaataataatgccgagcgg

SEQ ID NO: 53853 - DNA, 318 bp, Zea mays
  Clone ID: LIB3068-039-Q1-K1-H4
ccgtctccgacctacgcgtccgaacaaaccaaacaaaaaaaaaaacaaaaaaaaaaacaaaaaataaaaaaaaataaaaaaaggagaaaataaaagaaaaaataaaaataaaatatatacaaatacaacctaaaattaaaaacccttcaatataacttccttgctccattcttaaattccctaacttctatcaatttccccattttatacatcaaccttctttaaaaaaaccttcctattccctaacccttttactttcataaaacttcccctttcccctcctttttatctttaaataaattccccttttaacaaatt

SEQ ID NO: 53854 - DNA, 420 bp, Zea mays
  Clone ID: LIB3068-039-Q1-K1-H6
accacgacgacggcgacggtggcggccataggcggcactactactaacagcaacgacaggcagcagaagcatggtcagagagcagctgcgcccggcgtgaacgccgaccagaagaccttcctgccgggctacgtcggcggcgtcggagggttcgctggcgccggcgccggcctcgggggcatcggaggcgttgcgggaggcattggcggtatgactggcggtggtgtcggcggtgtcgtcggtggtggactcggagggtttggaccgcttggtggtgctggaagcggatcaggccttggtggcgggtcaggtctcggcggccttggtggtctcggcggtggcggcggccttggccttggtggcggctcaggatcgggtctgggccgcagcggcggccttggcggtggcagtgggctcggt

SEQ ID NO: 53855 - DNA, 350 bp, Zea mays
  unsure at all n locations
  Clone ID: LIB3068-039-Q1-K1-H7
gcgatcccactcccgatcagcagctgatcgctcactcttgcagctcgatcattctttaggtgctctagctggagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgncgctgagcccgaggcggcccccgtggcggccgaaggagaaacccccaa

SEQ ID NO: 53856 - DNA, 343 bp, Zea mays
  Clone ID: LIB3068-039-Q1-K1-H8
ctcacgcgaccatgatgcagaccatgatagatggataactactcttaagagtcctctaggcgtatatcaattcggatatatacaaatacatacagaaatgcaagcatagaggataggctcatggcttggctcattgctttggaaatagacatggtacatgccataatacataacaaggaacaggagagccaactgaatagccagatgcatgtaaggatccataagagatcatagaagagatcatcttaatagcaagcttatctactagaatttctagattcattagatgatcgattacataagataatacgtactattctaagttctatacaatagcctgaag

SEQ ID NO: 53857 - DNA, 198 bp, Zea mays
  Clone ID: LIB3068-039-Q1-K1-H9
aaaacacaataaacctcacataaaaacaaatcaaacaaacaaacaaaaaaaagccaaacatgcaaacactaaaaaacaacataattaacactcctattacaccacctaacaatcatatcactaaacctcacccaacatcataactaacatacaaaacccacctacttaccctacttaaaccatacttaattacatccc

SEQ ID NO: 53858 - DNA, 281 bp, Zea mays
  Clone ID: LIB3068-040-Q1-K1-A5
cccacgcgtccggcgaaaaaccttctttttcaaacaaaacctcgataaaagcggagaccatctaacgagaccggcaggccttcttaacagaaccctcaaacccaacaaacttcggacctaacaatgtcatacaccccaaacacccccgcaacaccaacacctgaagccaaaacgaagagccgaaccccactagatacccacacaatacctaaaaccacggtaaacgtagcggctacatcattacccaccgaagctcccactcaacctacacccatcacaac

SEQ ID NO: 53859 - DNA, 193 bp, Zea mays
  Clone ID: LIB3068-040-Q1-K1-B1
aaaaaaaaaaaaggattttaatttttaggaaattaaaaaaaaaaaaccaaaaagggaaaaaagaaaaagggccaaagccccctaaaaaaattaattttttaacccccccccccaacaacaaaacaactaaaaaaacaaacaaaaaaccaaaaaaactaaacaaaaaaaaatacatacaaaaaaccaacacacc

SEQ ID NO: 53860 - DNA, 206 bp, Zea mays
  Clone ID: LIB3068-040-Q1-K1-B12
ccctatccgccagtgtcatgcattcgtgctgaagctcaactgctgatccgtcttccaagctctggtatcatccctgagcactgatttaagatgtatctccagtactacatcaacgagaagggggacaaggtctacaccaccaagaaagagtcacctcttggggtgccaacgcaatctgctcacccagctcggttctcacctgatga

SEQ ID NO: 53861 - DNA, 226 bp, Zea mays
  Clone ID: LIB3068-040-Q1-K1-C10
aaaaatcaccgggactgtttcggaaccctagccctacccctaccgccattcatgcattctctgagctcaactctatctcttcaagctctgtatcatccctatcctgattaagattatctccatactacatcaacagaagggggacaaggtctacaccaccaaaagagtacctcttgggtccaacgcatctgctcacccactcgttctacctgatgacaagtactct

SEQ ID NO: 53862 - DNA, 272 bp, Zea mays
  Clone ID: LIB3068-040-Q1-K1-D4
aaaataaaaaaaaaaaaaagaaaaataaaaaaaatataaaaaataataaaaaaaaaataaaaaataaaaaaataaaaagaaaataaataaaaaaaatattaaataaatagaaaaaaaatataataaatataaaaaaataaaaataaaaataaaaaaaatataaatataaaaataaaaaaaaaaaaaaaaaaaaaaataaaaataaaaaaaaataaaaaataaaaaaaaaaaataaaaaataaaaataaataaaaaaaaaaaaaaaaaaaaaa

SEQ ID NO: 53863 - DNA, 346 bp, Zea mays
  unsure at all n locations
  Clone ID: LIB3068-040-Q1-K1-F1
aattcccattcgaccgcactcaaactcccactcttcctaaacttcctaacttctcttctctttatcgtantaaattttacaatctggggaaatctataacagaggctcatactccttaaccatcataagctcgatcatcaacaaaatataactactttgtacaccatcatgactctataagtatacatgatataagatcaatatatacttcttttatgataacatatcatgttccttctctatttgttatcactgataattctctcaattcatcaaaccatatatctcctttatctattatcaaactatccataaacaattctgcaaattttcaacaaattaatac

SEQ ID NO: 53864 - DNA, 411 bp, Zea mays
  Clone ID: LIB3068-040-Q1-K1-G5
cgggtcgactttttcgtcctcccactcgtccggcgaccgtctccgcgtttctactcacccttggccgtctacgaggatctgcaccacgtcaggatgacgactctgatgaacctcaagatcatgacttcaacgtgcaagaggatcgtgaaggagctgctctcgtacgataaggatgtgtacaaggacgctttcaagaccgacgacatgaaggacaacggctctgatccctacgacctcaaacatcacgagaatgttttgcctgagtcaaggatgattgtcccagactgtcacaaacgacttgaaactgcactttcttactcgaaagcaacactggcttaactgaaggagtcaaatgatcaaggtacctatattgtacaaactgatagtacaatcgcacaagtttgaatcatt

SEQ ID NO: 53865 - DNA, 277 bp, Zea mays
  Clone ID: LIB3068-040-Q1-K1-H2
aaaaaaaaaaaaaaaaataaaaaaaaaaaaaaaaaaaaaacaaaaaaaaaaataaaaaaaataaaaacaaaaaaaataaaaaaaaaaaaaaaaaaaaaaaaaaaaaaataaaaaaaaaaaaaaaaaaaaaaatataaacaaaaaataaaaaaaataaaacaaaaaaaaaaaaacaataaaaaaaaaaaaaaataaaaaaaaaaaaaaaaaaaaaaaaaaaaaaaaaacaaaataataataaaaaaaaaaaaaataaaacaaaacaaaaaaaaacaaa

SEQ ID NO: 53866 - DNA, 270 bp, Zea mays
  Clone ID: LIB3068-040-Q1-K1-H5
aaaaaaaaactagaaataaacaaaaaagacaaacaaaaaaaagaaaaagtttaaaagcaaaaaaggcccgccaaaaaaaaaaacaaacaataaaaacaaacaacaaaaaaaataaaccctataaaaaaaacaacaaacaaaataatcaaaaacaaaaacaaaaacacccaaaacaaaaaaaaccaaaaataaaacacaaaaccccaaaaaaaaaacaacaacaaaaaaaaaaacccaaaaaacccaaaaaaaaaaataacaaaacaaaaa

SEQ ID NO: 53867 - DNA, 351 bp, Zea mays
  Clone ID: LIB3068-041-Q1-K1-A1
caacaagctgccccgcagcaacgaacacgaaccttggcagaacgaagctgaagtagttcgttgtgaacccagtatggcaaacgcgccgaggatcctggccctcggcctgctagcgctcctgtgcgctgccgccggcccggccgccgcgcagaactgcggctgccagcctaacttctgctgcagcaagttcggctactgcggcacgaccgacgcctactgcggcgacgggtgccagtcgggcccgtgccgctcgggcggcggcggcggcggaggcggaggcggaggcggaagcagtggcggtgcgaacgtggctaacgtggtcagcgacgcgttcttcaacggcatcaagaa

SEQ ID NO: 53868 - DNA, 326 bp, Zea mays
  Clone ID: LIB3068-039-Q1-K1-H2
cccacgcgttcgcccacgcgtccgagatcgcgagcggccgttctttttttttttttttttgtttttttgtggcaaagaaataacaagcatatttataagaatatccattttggcactggaatttggccctacttcagtttactaaattatgatctgccacttcatgtcactcctgtcctgtgtacattcatcaagaacaagatgcagaagaacgaaccttaatctatctatgtatgtaaagcctaaactcccacccaaattaacaatggatcgatcaattggagtccaaggcaatcaatggtaacagcaacagttctatatatact

SEQ ID NO: 53869 - DNA, 445 bp, Zea mays
  Clone ID: LIB3068-041-Q1-K1-A11
atcgggcggaagggcgagctcatcaagcgccttgtcgaggggaccaaggccagagtccggatcctcgagggccccgtcggcgccaccgagcgtatcgttttggtttctggaaaagaagatccaggcttggagctatctccagccatggatgctctcatgagagtttttaagcgtgtcattgggataacagatggagctgcggagggcactcaggctgctgctactcctggtgtatgtgctgcccgattgttggttcctggagctcaggcaattaacctaattgggaagcaaggtgccactatcaaagcaatccaggagagcacgggtgctacaatacgggtaatatcagtagatgaacatgagagaccattttatgtaactgacgatgaaaggatagttgagatacagggcgatacagagaaagttctaaaagcactgcaagcag

SEQ ID NO: 53870 - DNA, 425 bp, Zea mays
  Clone ID: LIB3068-041-Q1-K1-A12
gcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcttgcgtccgccggtgcgcggagaagttcctgaagcactccatgagggtcggcatgaggttcgccgagcttaaccagggcgtggccacgccggactaagaaacatgctgctgctggctgtggccgccaggtttctggctttgctggcacagatttgtagccgacaaaaggatttcagcactttcgctgcctgagatatatgcgtcttaaagccgaacgctgggtgtcagattgaataaaaactgccttgag

SEQ ID NO: 53871 - DNA, 357 bp, Zea mays
  Clone ID: LIB3068-041-Q1-K1-A7
gcgctgaagaaggacgtgttcgtggcgttccccaacgtgctgggcttcgtcttcggcgtcgcacagatggcgctgtacatggcgtacagcaggaacaggaagcccgcggcggcgctggtgatactaccggagcagtccaaggaggaggcggccgagggcaaggccagctgcggcggcgccgaggtgcaccccatcgacatcgcggaggtccacgacctgcaggccgtggtcgtcgacgtagacgtggagcctgtcacctacgccgctgcgtccggtatggtcgacggcagtgtcggcaggcctagggcgccggagcagctggtgatcaagcccgacatggtcaccgtcattgcggcg

SEQ ID NO: 53872 - DNA, 309 bp, Zea mays
  Clone ID: LIB3068-039-Q1-K1-E2
ctcatcctcccacacctgctgcggctcttagtacgattttgcgtcaaccgaattcggtcctccggggtttcattggccagcgggggcgcacccgacacctctcgatgtgcggtgctcttccggccgctggaccctacctccggctgaaccgattccaaggttggctggcccttaagcagaaaagataactcttcccgaggcccccgccggcgtctacggacttcctaacgtcgccgtctgccgtcacgtccctgctcgggaaatcttaaccccattccctttcaggtgacgcgcgttattccgctatct

SEQ ID NO: 53873 - DNA, 356 bp, Zea mays
  Clone ID: LIB3068-039-Q1-K1-E7
agaagctgagaggtgatgcgtgggctggggggggggggttggtggccctgcatgcccctgtttcagcttcggtctcggtgcttttgcttgctctcacagattgagatgctggaggagcacatcttgccctcgttgaatgggctctgttgttgaaggactgatagtgttggtaaaaaaatgggattgtgcagtgagcgggtgattggcaaggggaaagattgggatggtccagtaagtgaacaggcgacagggatgtggccttaagccccgttgcccatgggatggttgccgggttgagctgaggtggcatgatgacgatgctggttcttgctttgcctagtgcaatcgtggcacca

SEQ ID NO: 53874 - DNA, 354 bp, Zea mays
  Clone ID: LIB3068-039-Q1-K1-E8
ggctcacgcaccagtaccgctcgcgctggtacccggagcacttcttggaggcgacgacggcgcacgcggagcatggacccgcgaggtccgctgaggcggccccctgctacgaccggttccccttggacgacatcgacgatgcgtgcgagctgcggtggtgatcgtcgtaggaggcggcaaaccccgcggcgtcgactacgaagtagcgcgaggcggcgctgcgcacggcaacgacggccgcggagaagagcacgagcccgacgaccgacgcttggatcaccgccgaaaggtccagtcccaagcccgcgcccgcgcccgcgccaccgtcttcggtgccgacccccagcatctaat

SEQ ID NO: 53875 - DNA, 250 bp, Zea mays
  Clone ID: LIB3068-039-Q1-K1-F10
aaaaaaaaaaaaaaaaaaaaaaaaaaaaaaaaaaaaaaaaaaaaaaaaaaaaaaaaaaaaagaaaaaaaagggaaaaaaaaaaaaaaaaaaaaaaaaaaaaaaaaaaaatacaataaaaaaaaaaaaaaaataggttgagtgacaaggggtccaaacattcaaccaacgattttctaagatgtacaggacggtatgaagattgctaaaagaagagatattcgcccctgtgcaaacgatcctcatggtaaa

SEQ ID NO: 53876 - DNA, 332 bp, Zea mays
  Clone ID: LIB3068-039-Q1-K1-F11
cccacacgtacgcccacgcgtccacaggttttaatgcataggaaatgttggggttatgagagctgtactgaaatgctgccacaagggctggcgaacctacgtcatcgtcagcctcgccgactctggccaggatatcgccacacgaccattccagctcgtgactgggcgtgtctggaagggaaccgctttcgatggcttcaacagccggacccaggtcccatggcttgttgacaagtacatgaaaaatgaaattaaggtggacgagtacattacgcacaacatgaacctggctgacatcaacgacgccttccacctgctgcacgaaggtggct

SEQ ID NO: 53877 - DNA, 447 bp, Zea mays
  Clone ID: LIB3068-039-Q1-K1-F12
gccacgcgtccgcccacgcgtccgcccacgcgtccggcaaatcatcaaaacctgcatgagggaccaaaaggagaaattgtggcccatgttgcaaaagcttaatgttaccatgaaggctgatgagaaggagttgattggcaaagctttgatgaagcgtgttatgcaaacgtggctaccagccagcactgcacttcttgagatgatgatattccaccttccttccccggcaaaggctcaaaagtatcgtgtggagaacttgtatgagggaccccttgatgatgtttatgcaactgctatcagaaactgtgatccggagggccctcttatgctgtatgtttcaaagatgattccagcatctgacaagggcaggttctttgcgctttggtcgtgtcttctcagggaaggttgctactggtatgaaagttcggatcatgggtcccaactatg

SEQ ID NO: 53878 - DNA, 256 bp, Zea mays
  Clone ID: LIB3068-039-Q1-K1-F2
cccacgcgtccgatcattcccttcttgcataacgtgaccattcccaaggattgcaacagggaccagaagtgctacatctatctctctggacaggtgatggacaagcttgccaagatcgacccttactttgccaagctcggtgacgccatggtcacctggatcgacgcctgtgatgagctgaacccggatggacccgcggctgggaaagacacggacaagtagatgggagtccctgacgatgcattcacttacctgc

SEQ ID NO: 53879 - DNA, 317 bp, Zea mays
  Clone ID: LIB3068-039-Q1-K1-F4
tcgacgcacgcaatctggaagaaggctttagctatctgcctgtgtatgggatacaaccgaactgggtcgtctggggggccaacgaccgttcagcatacttccgttagtagcatcatcaccacatccatgttccacaacatactgagccaccgcagatacagcatttgcccatgcaccttttacacctaccacaccttaatcgaagccttcagcaagttacccagctactgcaccacctgcgaccatccaaaccgcctgcacaagctcgacagcttcttctgccagacgtaccactaaaccaccggatcatttaccac

SEQ ID NO: 53880 - DNA, 413 bp, Zea mays
  Clone ID: LIB3068-039-Q1-K1-F6
ccacgcgtgcggtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataa

SEQ ID NO: 53881 - DNA, 263 bp, Zea mays
  Clone ID: LIB3068-039-Q1-K1-F7
cccacgcgtccggacccacgcgttcgaccacgcgtccgctcactcgttcgcccacgcgtgcgaaaaaaaagagaaaaaaaaaaaaaaaaaaaaaaaaaaaaaaaaaaaaaaaaaaaataaaaaatataaaaaaaaaataattaacaaaagcaaacatatgataatattaaattctcattttaaacctataaatcataattcgtggcagacaatatataacctcaattactgttaaaacaaataacgatcacaaacttaatcaa

SEQ ID NO: 53882 - DNA, 417 bp, Zea mays
  Clone ID: LIB3068-039-Q1-K1-F8
gaggaaggaatctcctaccaggcggcagccaacacccagcattcgtgctcccgtagccggggtcgtccccagccccacggccgctgcgtcgccttcccctctcggtcgaaaccacaacggcctcttccggcataacaatatgcaccgaatattcagctcatccgctctcctataaaaacgaagcgcaaatccaaaaaaaaaaaaaccccgcccgcacgacgcattgtccgttccgtttggacccatgatatatctcgctgggatcttgaccgtgcgcgagacgaatctcctcgtgcggtaaccgataccccccaagtcaaaaatcagcccataaaatttttatgggcggaggatcacccgtcgccgcagttcacgacgcgagcgacgacggcgccagggtcgtggtgctagtcgcgg

SEQ ID NO: 53883 - DNA, 285 bp, Zea mays
  Clone ID: LIB3068-039-Q1-K1-G10
gcggcactcatcctaaatacaacgatcacacccctggcggttgatgacatgctgaccagcgacttattagataaaccctctcccacctagcaatacctatctcataccatcaacgctctttaccccaacttcctgtgctgaactcagatcaagtggtgcatccacacctccctctactgcagcaccgcactccataaccagatcatattccactttagtttcaccccaaaccctccaaacaatcgcgtcgagaactccattatcccacaatctctatataaccat

SEQ ID NO: 53884 - DNA, 357 bp, Zea mays
  Clone ID: LIB3068-039-Q1-K1-G12
gagacgcggagcagccgcagggccaccgacctcgccgccggtcgacctgcatatcctgggcgctgcctgtggttgatctttggaataatcaacatgatcctggtgggcagtgccggtgcgggtcaaagctctgtgggccatctttaccgaagcagcgagcccgccaaaccaaccatggcaccagctgtaagtgctcgacgtgctgagaaaccatatggtgccaagactgacgcgggcaagcacgacgctgctggaggtaccaaccaaagcaatagctaccacaaggctgatgggcagaacactggcaagttgcatacagaccgtcctgtatacaacgtgcacgctggtgctggcggt

SEQ ID NO: 53885 - DNA, 257 bp, Zea mays
  Clone ID: LIB3068-039-Q1-K1-G2
atctcctaccatcctacagctttcacccagcatttgtgctcccgtatccttggtcatccccagacccacttccgcttcgtatcctttccctctctgtctaaaccacaacagcctcttccagcataacaatattcacctaatattcagctcatccgctctcctataaaaacgaaacgcaaatccaaaaaaaaaaaaaccccttcctcacgacacattgtccgctcccttttgacccatgatatatctctcttggatct

SEQ ID NO: 53886 - DNA, 245 bp, Zea mays
  Clone ID: LIB3068-039-Q1-K1-G6
ccggcccttccgtccacgcgtgcttccgctcttgtcctcattattgctatcgccgagcgggtcttcttgggtgaccacgcctccgcgcatcatcgcgtctccagcatcatcaccccgcccatgttccatagcattctcatccaccgccacaactgcggtttccattgctccttctacacctaccacgcattcatacaagacatcagcaacttcccaaacttctttaccaccgtctactagcacac

SEQ ID NO: 53887 - DNA, 318 bp, Zea mays
  Clone ID: LIB3068-039-Q1-K1-G9
attcccttctcgacgcactcaatcgcccactccttctctctatccttccacactttatatctcctctactacaaagcatctttgggcacctttctaatcttttaacatatttgccatcccatccaaactcctcatcttacaatttcttcctcacatatcattcctgctataccctgccttccaacctatattatagacttatccccactttcaacctactgactatgttaaataacgtcaaaaccacttctatctcacttacacctctattctcccacttatcctacaactttctaatcattttacacaatcttacta

SEQ ID NO: 53888 - DNA, 439 bp, Zea mays
  unsure at all n locations
  Clone ID: LIB3068-039-Q1-K1-E12
cggacgcgtggggttcaggaaaggtgttgaacagggcccgcagattgacgacgagcaatgcaacaagatgttgcgctacattaggtatggtgttgacggtggagctacccttgtgacgggtggtgataggttgggtgacaagggtttctacatccagccaacgattttctcagatgtccaggacggcatgaagattgctcaggaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcagggccgggaccgtctgggtgaactgcnttcgacgtcttcgatgctgcgattccgtttggtgggtacaagatgagcggcatcgggaggga

SEQ ID NO: 53889 - DNA, 336 bp, Zea mays
  Clone ID: LIB3068-039-Q1-K1-H10
cgcgcctggattcacgcgtcgaggcacgcgtccgcggacgcgtgggcggactcctgggttgccgtctcccttttgcgtgagcagaggaaagagggggagaagagcagtcgccatgtctgtcatcatccacaagatcgaggagaagctccacatggggggcgaccacaagacggaggatgagcaccacaagaaggccgacgagcaccacaagaaggaggaggtggagcaccacatgaaggacggcgtagagcatatggaaggcatcgtggagaagatcaaggacaagatcaccggcgagcacggcgacaagtccggcgaccacattgcaaagaagga

SEQ ID NO: 53890 - DNA, 264 bp, Zea mays
  Clone ID: LIB3068-039-Q1-K1-H11
cgacgcctcggcagacgcctcggttggcttctcccttttgcgtcagcagagaaacagagcgagattagcaatcgccatgtctggcatcatccacaagatcgaggagaagctccacatgccgggcgaccacaagaaggaagatgagcaccacaagaatgccgacgatcaccacacgaaagaggagggggagcaccacacgaaggaccgctcctagcataaagaatgcatcatagacaagatcaaggacaagatcaccggcgagca

SEQ ID NO: 53891 - DNA, 393 bp, Zea mays
  Clone ID: LIB3068-039-Q1-K1-H12
attcaatgataaggaactgtatgttggaagagcacagaagaagtctgaaagagagatgggggtgaaggagaaatttgaaaagaatgttcaagaggtagctgagaagttccaaaacacaaacttgtatttgaagaacttagaggagaacattgatgatgagaaattgcgtgaactctttgctgagtatggcaatattacttcctgcaaggttatgcgggattcgaatggtgtcagcagaggttctggatttgttgctttcaaatctgctgaagatgctaaccgagctcttacggagattaatggcaaaatggttggaagcaagcccctttatgtaactcttgcgcatcgtaaaaaaaacacgaaggcaaagcttctacgcccaatttttacaaa

SEQ ID NO: 53892 - DNA, 440 bp, Zea mays
  unsure at all n locations
  Clone ID: LIB3068-039-Q1-K1-B9
cggacgcgtgggcggacgcgtgggcagttccagacgtttatgtattgaaggcggaagcagtggtggtcttctggttgctgcttccattaatcagaggcctgatctctttggatgtgctctcgctcatgttggcgtcatggacatgctccgttttcacaagtttacaattggtcatgcatggactacagactatggttgttcagataaggaagaagagttccagtggctcattaaatattctccccttcataatgtacggagaccttgggagcaaagctctggtaataactgccagtatccagcaaccatgttgttgacagctgatcatgacgatcgtgttgtgccattgcattcactgaagttattagccnactttgcagcatgtcctgtgtaccagcactgaggacagtccgcagacgaatccaataattggtcgcatt

SEQ ID NO: 53893 - DNA, 317 bp, Zea mays
  Clone ID: LIB3068-039-Q1-K1-C1
accactcgtcgcgtaatgtctaactggggttttgtacaatcgttcggcgatccgcactgggattgtttctctggtggggggctgatgggaagtaaatactgcaccggtgacatatctgaagcccaaagctatgctgccgacattgattccatcagggaggcgcatgcccgcattgcgccgtacgttcacaggacgcccgttatgtcgtcgacgtccattgatgccatggtggggaagaaactcttttttaagtgccagtgctttcagaaagcgggcgcattcaagatccgaagtgcttcgaattcgatattcgcact

SEQ ID NO: 53894 - DNA, 375 bp, Zea mays
  Clone ID: LIB3068-039-Q1-K1-C10
tcccgttcgacgacgcgtccggggacgcgtcggccactcatcctcacaggatgctacatcttttataacacgcagacatagagctatagggggttgtgcagcacgagataatgatgactacccctagacgagctgcctaaggtgctgaacgaacgaaacttacaacatgctaaccttcttggtctacctaataaccaccatgctgctaatggcactaacgctcatcatataactctcgagtcaggattaaattgtgtatgccacccacactggtacatccagagcacttatgccacaaatcgccaatgcctttacgaaagcctgcactgcctatgcagcaacattgcgagacacgcttacatatcacatgccaac

SEQ ID NO: 53895 - DNA, 452 bp, Zea mays
  Clone ID: LIB3068-039-Q1-K1-C12
tcccgttcgacgcacgcgtccgcgaaatgacttgaatattgaaaaaacagataaaccggcctcgagtttaactgcaacaggaatgggctcgagtatccaagttgaaccctctacggatgagttagatgaggccatacaacctcctgacgatgacatgggcatctcatcatctgcgtgggtagaagtagagcgtcaagaactagaagtcactgtttcgagtgaaaatgtatttgttgaggatgtaacttctccaggaattgcaccattgccgtcatcaagcccaagagtgcgtcattcgttgtcacaaatgctgcaagcagatcgcaatgaaccagaaattatcgagtggggaaatgctgaaaacccacccgcaatagtttttcataaggattctgcaccaatgattcaagaggcttctaaagtctgctcgaaaaacaagggagacaacaatg

SEQ ID NO: 53896 - DNA, 131 bp, Zea mays
  Clone ID: LIB3068-039-Q1-K1-C2
aactgggttttctacaatcctcctgggatccatactggcattctttctatgctgttggactgattgtaactaaataccgaaccactgacatatcaaaatcccaatactatgctgcctacattaattccatc

SEQ ID NO: 53897 - DNA, 266 bp, Zea mays
  Clone ID: LIB3068-039-Q1-K1-C3
cggacgcgtgggcttttatgtgctaaaagatagtccaggattcttgaattacatgagcagtgtcagatccatatagcaaggattaacacagggtcccaagacaatagttggacggaccagtgggcaagtctacctggtcacagattacaatatggtcatggctgaccttatgagctcaaaactgtaaaaacatcaacagcaccagtgcttggtaaagttggctccagcttcttgaccgagtcacggattctgccggcgatctaatg

SEQ ID NO: 53898 - DNA, 347 bp, Zea mays
  Clone ID: LIB3068-039-Q1-K1-C4
cccacgcgtccggcttctgtgacttgcttagagcttgctgatatctgtggagaagtcgggcttcctcccggtgtcttaaacattgtgacaggattaggtcctgatgctggtgctcctttgtcagcacacccagatgttgacaaggtcgcttttactgggagttttgaaactggtaagaagattatggcggctgcagctcctatggttaagcctgttacactggaacttggtggaaaaagtcctatagtagtatttgatgatgttgacattgacaaagctgttgagtggactctgtttgggtgcttttggaccaatggtcagatttgcagcgcaacatctcgtcttct

SEQ ID NO: 53899 - DNA, 196 bp, Zea mays
  unsure at all n locations
  Clone ID: LIB3068-039-Q1-K1-C6
aaccgnccacgcgtccggcttcttttacttggttttagcttgctgatatctgggaagaaatcgtgcttccttccaaagtcttaaacattgttacacgattaggtcctgatgctggtgctcctttgtcagcacacccagatgttgacaaagtcgcttttactgggaattttgaaactggtaagaacattatagctgc

SEQ ID NO: 53900 - DNA, 244 bp, Zea mays
  Clone ID: LIB3068-039-Q1-K1-C8
tcgaagaaaacatacaaaaaaacataaaaaaacttaaaaataaattaaactaaaaaaaaaaaagggaaaaaataagggaacctgcctccgttttaaagattcctaccttactatcccttacttccgccactacagatttaacacacggagacgttaataaagttacttgccctccgatttataacattactactgtgaaaacccttgctactcctaatttaatctactatcagaaaatctccct

SEQ ID NO: 53901 - DNA, 284 bp, Zea mays
  Clone ID: LIB3068-039-Q1-K1-D1
cccacgcgtgcgcttttatgtactaggggatagcccactggtatctggggagatgtcgagcgtcctatcaatgtcgtaaggattgtcacaggattacgacctaatgctggtactcctcagtcagcacacccacatgatgacataggtcgctgttactgatagctttgaaactggtaagaagattatggcagctgcagctcctatgggtaagccagatacactggaacttggtggaaaaagttctatattcgtatttgatgatgttgacattgacaaatctgttt

SEQ ID NO: 53902 - DNA, 444 bp, Zea mays
  Clone ID: LIB3068-039-Q1-K1-D12
gcgagcgagatcagttaggcgtcgaagcaggaggagccgcagccacacgccatcagggaccagctgcatttggtctcctgctgcctcaccaacccgccccatggctgctggcgcaacgtctacgacaccatatcctaggcccagaggctctacctcaacggatggtccgtgttccacaccatccacctggtgcgtgatggccaccaggacatggcactcggcgacctgctcaggaggaagtcgcaggacggcgtgcaggtgttgttgctcgtggggacgatcccacgtcctggagcactttagcatcaagatggtaccaggcatatggttcaccgggtggctccaaatgaaaggttacatgggcacaagggatgaaggtgactcagagatttttttagcgctcttcggtcctaatacggctttgcccacgatctgctaggaaaa

SEQ ID NO: 53903 - DNA, 160 bp, Zea mays
  Clone ID: LIB3068-039-Q1-K1-D3
cccacgcgtccggggattttcattctcctaagcaaaattagttcatttgcttttgtgaggataggttggaaaaatggtgttttcaaactagcccttagataaaaaaaaaaaaaaaaaaaaaaaaaaaaaaaagaaaaaaaatataaaagatacaagaaaa

SEQ ID NO: 53904 - DNA, 315 bp, Zea mays
  Clone ID: LIB3068-039-Q1-K1-D4
catgattttacgcgtcgctagtttagactttaatcgctgaattaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgattttttccctcggtcgcgcccgggtcatgtattgtagtactcctcagtgtctttttatttattgctgaatagtgcaaaattatgctatccagcgac

SEQ ID NO: 53905 - DNA, 301 bp, Zea mays
  Clone ID: LIB3068-039-Q1-K1-D5
atgtaagttgggctagcctcttcctaggattccataccttgtgcctttatgttcataacgacgttatgctggcttttggtactccagaaaagcaaatcttgattgaacctatatttgcccaatggatacaatctgctcatggtaagacgacatatgggttcgatatactcttatcttcaacgaatggccccgctttcaatgcatgtcgaaacatatggttgcccggatggttgaatgctgttaatgagaatagtaattcgcttttcttaacaataggacctgggtatttcttggttcatta

SEQ ID NO: 53906 - DNA, 350 bp, Zea mays
  unsure at all n locations
  Clone ID: LIB3068-039-Q1-K1-D6
cggacgcgtgggtaaaaaggcgagcctatttggtgcatcattttacgtttcgctagtttgtacgtgaatcggtgaataaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgattttttccctcggtcgcgcccgggtcatgtattgtagtactcctcagtgtctttntatttattgctgaatagtgcanaattatgctatccagcgac

SEQ ID NO: 53907 - DNA, 420 bp, Zea mays
  Clone ID: LIB3068-039-Q1-K1-B4
agtctttggcgcgtagtggcgaactggagaggtgtacaatcgtccggggatccggactgggattggttctctgctggtggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaagtatcaaagggcgttgtgacacatagcagtggggaccatgccgcttctgtggctttggctgcaaagcttcgtggcatacctgcgcacatt

SEQ ID NO: 53908 - DNA, 353 bp, Zea mays
  Clone ID: LIB3068-039-Q1-K1-D7
cggacgcgtgggtaaaaaggcgagcctgtttggtgcatgattttacgtttcgctagttggtacgtgaatcgctgaataaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgattatttccctcggtcgcgcccgggtcatgtattgtagtactcctcagtgtctttttatttattgctgaatagtgcaaaattatgctatccagcgacaaa

SEQ ID NO: 53909 - DNA, 262 bp, Zea mays
  Clone ID: LIB3068-039-Q1-K1-D8
ccaacctaaaaacgtaacccgatttttaccatgattttacacatccctaaattgtacgctaatcgtatgaattaaaacccacagaaagccaccaaaaaacacacaatatccacttcctattcactccctcaaccccccctcaaactaaaccccatctccctttcaaacccactcgaatgtcaatgtaaacttatcaataggaccctacactccacttcatacatgcccaccactccaacttaccatccaaaccttctcctca

SEQ ID NO: 53910 - DNA, 193 bp, Zea mays
  Clone ID: LIB3068-039-Q1-K1-D9
attccctgtcgacccactcttcctaaaaaaaaaaaaaaaaaaaaataaaaaaaattaaaaaaaaaaaaaaaaaaaaaaaaaaaaatgaaaaatataaaaaaaaaaaaaataaccaaaaataataaaataaaaactataaaaaaaaaaaataattatactattttatactatccaatcttactttctctttcat

SEQ ID NO: 53911 - DNA, 441 bp, Zea mays
  unsure at all n locations
  Clone ID: LIB3068-039-Q1-K1-E11
cccacgcgtccgcccacgcgtccgctggccggttcgttcccctacgcccggttctctctcgtcgcgcaacatcagagcacaagcgaggaacccagtccagtcccgggaatggagtgcgtattgggcgtggttggccgcgacttcgcgctggtggcggccgacacttccgccgtgcagagtattctcgtccacaagaccgacgaggacaaggtgatggtgctcgactcgcaaaagctgatgggcgcttcaggggagcctggtgatcgggtgcaatttacggagtttatacagaagaacctncacctgtaccagttccggaacaccatcccgctctcaaccgccgccgccgccaacttcacacgcggcgnaactcgccacagcccttcgcaagaatccatatatggtcaatattattcttggtggttatgataaggatgttgg

SEQ ID NO: 53912 - DNA, 239 bp, Zea mays
  Clone ID: LIB3068-038-Q1-K1-H6
aaaaaaactaaataccataaaataaagctaaaaaaaaaaaaaactaaacaacaaggactagacataatcaaaaaaaagagtaaccaatactataacacccaaaatacaccaaactaaatagacttgaccctttgatcaacccaaccttcattctcctctactccaacttctaaaccacctataccaacacgtacaccaataactctgatctcctcatacttactccactgccaataaac

SEQ ID NO: 53913 - DNA, 140 bp, Zea mays
  Clone ID: LIB3068-038-Q1-K1-H7
tcatactgatcttcctactaggactttaaaaaatgtatacaactctaatttacttacatataagattggtgttacattaaaaaaaaggtattaataataaaaaaaaaattatacataaatataaaataattttaatacat

SEQ ID NO: 53914 - DNA, 274 bp, Zea mays
  Clone ID: LIB3068-038-Q1-K1-H9
ccttcgtctgcttcccagagtcccagtcttggcgatctcccagatctcacggatattgctggccatccttctgctggccgccgtcttcgcccgcgtcccagctgcgcttgccgaccgcgacgacctggtggcccttacccaatccacgttccaaaaggaggtcagaaaggaccgcggcgccctcgtcgagttctacgccccctggtgtggtcactgcaagaagcttgctcctgagtatgaaagacttggtgcaagttttaagaaagctaaatct

SEQ ID NO: 53915 - DNA, 371 bp, Zea mays
  Clone ID: LIB3068-039-Q1-K1-A1
gtccgcatcttctactttggccaatagccttcgacagtttgaaactgtgtgtgagaatgtggtctaggccttacgaccacaccaaaatggtactgccagtgccatcaaagaggaattggtagatgcagccaccaaagcagcagcagcagcagctcctcaacaagattcaagccatgatgcaccgcatgggcagtcttcgacagccaaggcggacatggaaatcgatggttgatttgtaggttccagagtggcaagaaagggaatcccctctaatcattatgtatactgtggtcagaatgtccgctatatattgtaacatcaaagaaagcaccttcaggcctgatggtgttactgctaatgcgtttggttac

SEQ ID NO: 53916 - DNA, 365 bp, Zea mays
  Clone ID: LIB3068-039-Q1-K1-A10
cggtggcagaagtggtggcagaggtgtctcagcacgtggagctgatgtcggctaccagagggttgaccatgctggatatgctggtggtcgtggtggccgcacagtagccgctggtgcacctgcaaaatgagggacaacatagctgttgcacgtctcctgtgtcgttcggtggccctcagattgttttgaagttggcatagagatccatcaattggtcgagtgcggggttaccagaaaaggctggatacaaatttttggagttcctgttcatcactatttttgcaggcaacaaaagctaaaaaagtgattactaattgagtaattgtagaatagacacctattcagatgtagttttagttttggtc

SEQ ID NO: 53917 - DNA, 440 bp, Zea mays
  Clone ID: LIB3068-039-Q1-K1-A11
gccattcacttcgcctattacaacggggttgcagccagcttcaataacaggagctgctggggctaaaggaccctttgttcctccagaaaacctactaagagcaaagcctgagattgggtggaaaggttcagcagctacgagtgcatttcgtcctgctgaaccaaggaagattttggagattcctgctgctgcacgcgacattccagtatctcatgctgctgggaagcagtctcgtcccacgcttggttttgatttgaatgttgcagatgaccaagctctcgaggaagatatcccacagagttctgcacagactacctgttctgaatctggaaatacgagaagtcgagatggctcttcacgaagcgcttggcattgaacttgatctgaacagagctgatgaagttgcagataatggccaatttgcaccaagtgcttcgcac

SEQ ID NO: 53918 - DNA, 299 bp, Zea mays
  Clone ID: LIB3068-039-Q1-K1-A2
aaataaaaaaaaaaaacctaaacataggtataaccaaacatgatcaacggaacataacggggccaactcacaaacaaggcctatcaaaacataataacccaacccatgttccagaacatgctgagccaccgacgccacagtccatgccagagcgccttctacacctacgactccttaatcgaagccgccagcaagttccccggctttggcaccaccggcgacgagcagacacgcaggcgccagctcgccgccttcttcggccagacgtcccacgaaaccaccggtagatgggcgactgc

SEQ ID NO: 53919 - DNA, 209 bp, Zea mays
  Clone ID: LIB3068-039-Q1-K1-A3
gggacacgttggttgaatatcggagggaccctgtggaaactgcacttgtgatgaaagagggagcaagacacactctgaaatgatttcacgacgaagcccggcattctataattagcatccttgaaaggatgatggctatcattatcgatggaagattcctgatgtacgcaatcgaccgaactatattggacagactatgtgcactgagg

SEQ ID NO: 53920 - DNA, 342 bp, Zea mays
  Clone ID: LIB3068-039-Q1-K1-A4
cggacgcgtgggctgaagaccggagtgaccctgtggaaattgcacgtgtgattaaagagggagtaaaacagaatctgaaaagatttcacgaggaagcccggcattctttaattagcacccctgaaaggaagttggctctcattattgatggtagatgcctaatgtacgcactggacccaactcttcgtgttgatcttcttggattgagtctaacttgccactctgatatatgctgccgagtctctccgctgcataaggcacacgttacaagcttagttaggaagggtgctgagaaaataactctcagcattggtgacggtgctcatgatgtgagtatgactc

SEQ ID NO: 53921 - DNA, 409 bp, Zea mays
  unsure at all n locations
  Clone ID: LIB3068-039-Q1-K1-A5
gtccgcatcttctactttggccaatagccttcgacagtttgaaactgtgtgtgagaatgtcgtcgaggccttacgaccacaccaaaatggtactgccagtgccatcaaagaggaattggtagatgcagccaccaaagcagcagcagcagcagctcctcaacaagattcaggccatgatgcaccgcatgggcagtcttcgacagccaaggcggacatggaaatcgatggttgatttgtaggttccagagtggcaagaaagggaatcccctctaatcattatgtatactgtggtcagaatgtccgctatatattgtaacatcaaagaaagcaccttcaggcctganggtgttactgctaatgcgtttggtttacttgtncttgtaatatgcatacacatttagaactcatg

SEQ ID NO: 53922 - DNA, 322 bp, Zea mays
  Clone ID: LIB3068-039-Q1-K1-A6
cccacgcgttcggggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgacgccgtcagcaagttccccggcttcggcaccaccggcgacgagcagacgcgcacgcgggagctcgccggcttcttcggccagacgttccacgaaaccaccggtggatgggcgactgctacggattggaccgt

SEQ ID NO: 53923 - DNA, 375 bp, Zea mays
  Clone ID: LIB3068-039-Q1-K1-A7
gccacacgatcctagattaaccgatggtcctgctcatgactagaaccaagctgatcgtgggggctggatgcgcccacaaacactaaggcgacctagacagcatgacgatgaccatgttccagaaactgctaaggcacctgaaccacatcataagcctaagcaactatctacacctacgacgccataatggacatcggaaggacactgacgacgatcagcaccaccatggactagcagacgctcaagcactagctttgcagataatacgtgctgacttacaagcaaacgctcagaggatgtgcaactgatatgcgaagaccagctactagagatactgaccaatgagagacacttgacagacagaaccaacctact

SEQ ID NO: 53924 - DNA, 356 bp, Zea mays
  Clone ID: LIB3068-039-Q1-K1-A8
gcaagataatgctccattatctgatgattttcctgaagacgagaatgaagaggattttggtaacaggatgcgcgcacaaatccttaaaaaacgtagagagcttggtgatgtttgccctcatgaaacctctaaagcagataaacctcatcataaggataaggaattatcagaccgtaggtccaatattgaacataggagggacactgaggacgatgatcaggagcatgagctacaaaaagctaaaaaactatccttgaagaaaaaaggtgctggctcagaagcgagtgctgagaggatgtccaaagcagatgctaatttgcagctactaaatccagctgaacaagagagacatttgc

SEQ ID NO: 53925 - DNA, 331 bp, Zea mays
  Clone ID: LIB3068-039-Q1-K1-B1
tcgcggacgcgtgcgctgaagaccggcgtgaccctgtggaaattgcacgtgggagtaaagatggagtaaaacagactctgaaaagatttcacgaggaagcccggcattctttaattagcacccctgaaaggaagttggctctcattattgatggtagattcctaatgtacgcactggacccaactcttcgagatgaacttcttggattgaggctaaatcgccactctgttatatgctgacgagtttctccgatgtataatgcgcaggtttcaagcttaattaggaagggttgctgaaaaataactttcaacatcggtgacggtgctaatga

SEQ ID NO: 53926 - DNA, 356 bp, Zea mays
  Clone ID: LIB3068-039-Q1-K1-B10
gcggcagcttcgacccgctcggcctcgccgacgaccccgaggccttcgccgagctcaagggcaaggagctcaagaacggccgcctcgccatgttctccatgttcggattcttcgtccaggccatcttcaccgggaagggcccgttcgagaacctcgttgaccacattgccgaccccgtcaacaccaacgctggggcctaccccaccaacttcgtccgcggcaagtgaggaaggcgccgccggagacctttatgtgtgcatatgcatgtgagcgcactctggttttcggtttgcaccatgatgtacactattgcacaatccacagggaataattgtgcacatgtgcaatatttttcc

SEQ ID NO: 53927 - DNA, 441 bp, Zea mays
  unsure at all n locations
  Clone ID: LIB3068-039-Q1-K1-B11
cggacgcgtgggcaagcagcaagctccaggaacatgataatagttggattgaccctgtggatctccttgtcgatacccgcatactttcagcagtatgaacccagctccaacctaatcttgcccagctatcttcttccatatgctgcagcgtcaagtgggccagttcgcacagccagcagcgggctgaactatgcagtgaacgcgctcctatccatcaacgttgtggtggctctccttgtcgcgttgatccttgacaacacagtgccaggcagcagacaagagcgcggtgtgtacatttggacagatcccaaatccctcgaagtggatcctgctacattggaaccctaccgattgccggagaaggttttcctgctggttcaggtgggcaaagtgtgtcggcatctaaaagctcttangagtggcggtgaagattctatttat

SEQ ID NO: 53928 - DNA, 467 bp, Zea mays
  Clone ID: LIB3068-039-Q1-K1-B12
attccgggtcgacgacgcgtccggccacgcgtccgaccacgcgtccgatgaagttctacttcttggatgtactcaacctagcgtggcactttgaaattacagctacaaattttggagctctagggccatccttgatttgctacctgcggcataatgcctttcctcaaagagatctgcatgactattcaggtgatatcagccatgatcctttggttgtcaagttgccgaatattgcgcgttggtatattgcaattgaaactgtcaacaaaacacagactaatgttacagcatcaacacctgttctagacacaacatgtatctcattgaaatggcaattaactggatgcttgaatggaaaaactggaaccaattgctcttgggaagcatatggtctccataagggttcccaagagatgccttctgtcacttagagtctatcatgttgctactgatggaacagcatcact

SEQ ID NO: 53929 - DNA, 425 bp, Zea mays
  Clone ID: LIB3068-038-Q1-K1-H5
gcaatgcctgggtgccatctgtggagctggagtggtgaagggcttccagcaggggctgggcatgggcaacggcggtggcgccaatgttgtcgcccccggatacaccaagggggatggccttggcgctgagatcgttggcaccttcatcctggtctacaccgtcttctcggccaccgatgccaagaggaacgccagggactctcatgtccccatccttgctccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgacctggctgccatctaccaccaggtgatcatcagggcca

SEQ ID NO: 53930 - DNA, 194 bp, Zea mays
  Clone ID: LIB3068-039-Q1-K1-B2
cccacgcgtccgctcacgcgttcgatgactattgtggaaattgcacgtgggattaaaaatgcagcaaaacaagggtctgcgatgattagaagccgaacttacgtactctttaatgcgcccccatagctggaatatggcgtcacactattgaaggtaaatggctaatgtacgcacaacgaccgaactgtggaaaa

SEQ ID NO: 53931 - DNA, 416 bp, Zea mays
  Clone ID: LIB3068-038-Q1-K1-F5
ggagagtacgtggaggagcagccatggcttcatcggtggccgccgcggcgagcacattcgtgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttc

SEQ ID NO: 53932 - DNA, 342 bp, Zea mays
  Clone ID: LIB3068-038-Q1-K1-F7
cccacagcgtccgaaaaaacaaacatggattaataaaaaagacaacaaaaaaaacagattagggaaacaccaaactgtcgggcggcggcgccacataacgaccgcatcgtggcccggttcgggttcggattgggcggcaaggcgaagcctgcttcgaagaaggtggacaacacatcgaccttctatgaccgtccgatgcggttccccgtcgccgtgttgcccgactacctgtacggctcgctcgtcggagactacaagttcgacccgttcggtcttaggaagcccgtggagtacctgaagttcgagttgaactctctgtaacagaacctttccaagaatgat

SEQ ID NO: 53933 - DNA, 387 bp, Zea mays
  Clone ID: LIB3068-038-Q1-K1-F8
cccacgcgtccgcggaggctacccggggcacggcggcggcggcggcggcggctacccggactgccggtggggctgctgcaaccgcgggtaccatggcggctgccggtgctgctcgcaccctgatcagataccagagcccatgtaccgtcctgagctcgtcgaggtccacaactaaatagtaatgagatgcgctgctactatatatacgggtacgtatgcccgatgggaagcagagcacacgcgtagtacgctcgtcgtagtagtcaataaaagtttggttccatcaccacgtcatgaaataaaagtaaggaggttgcaagctttgtgtgcgtgcttggaaacgtcgactgtatctcatgcatcgaataaattaaatagattttgtcc

SEQ ID NO: 53934 - DNA, 436 bp, Zea mays
  Clone ID: LIB3068-038-Q1-K1-G1
cccacgcgtccgcccacgcgtccgtctagatcgcgagggccgcccttttttttttttttgaaagaggacaagaatagtaccagcagcagcaagcttacacaatccaagcacccaacacagagatatcatcgtcgtctccccagtacgtcccgacccggcacctggttcaaccgggttttggactttggagaggtcgactttgacgaaacaaatttgccaggaaaccgtaacagacgcgtcatcacatcagcaagcagtaggtggaggaaggtaacgcttcaggagatggatgtgggtgctacgagccgccttttccctcttctgctcctcctgctgctgctgctggcggcgtggcggcgccggcgtctcctcctctgccgtagccgagctccgagatctcccagctcgtcgctggggctacctcctggtgcacccg

SEQ ID NO: 53935 - DNA, 381 bp, Zea mays
  Clone ID: LIB3068-038-Q1-K1-G10
gttctagatcgccgcccttaccatttttgtttacgttttataatattctgtcacagtcctgggttctgtaccgtaatcttatctgtctctgttgctcaattctattgtgcacacaaacactttgctctattctcttctgcacacacacacacacacctcatagagcgaccagatcaaatcaaactataataacagtagttctagtcttgccattctacatagaaccagcttgctcagacctctcggcgcacacaggcaaccgcaccgacgctgtcgccgcctcttcctctgcaaagcttgaggccttgctgattaagccacggatattgaacatcgactggcccgcgtcaaagtcgacgatcgccgatgcgagaagtttct

SEQ ID NO: 53936 - DNA, 210 bp, Zea mays
  Clone ID: LIB3068-038-Q1-K1-G11
cccacgcgtccgcccacgcgtccgcccacgcgtccgcccacgcgtccgaagtcccaaaggcgcggcgtcgtccgccagcccaccatggccgcgcagtccttcctcctcgccgacactgacgccgtcaggtcccccgcggtcttcgccgatacctattcctccgcacgccctttgcactcggtccacttcgtcgccggcccgtggggcgcc

SEQ ID NO: 53937 - DNA, 358 bp, Zea mays
  Clone ID: LIB3068-038-Q1-K1-G2
cccacgcgtccgcccacgcgtccgcccacgcgtccgcacacgagaaaaagaaaatcacggtgagctcatgggttaccaagtcgctgccttttctcgtggctccggcagtggcctcgcccactgccgccctccagctcacctccatggacagagctctggtttccctgcccgtgtcagcgatgttcgtctacgagaaccccatcgatcgtccggccgagaccattagaagagctctgtcccgtgcgcttgttccctactacccaatggccggccgcctcgccgtcactggggaccagctgaagctcgcgtgcaccggcgaaggcgtagcgttcgtcggtgcgtcggcgagctgcaccct

SEQ ID NO: 53938 - DNA, 434 bp, Zea mays
  Clone ID: LIB3068-038-Q1-K1-G3
cggacgcgtgggcggacgcgtgggcggacgcgtgggcgaagccgaaagccgtagtgaaggcgaagacacccgccaagcccaaggccaagccagctgccaaggcgaagcccaagaccgccggcgctaagccgaagccacttgctaagaaggccggccgccccgccaaggcggcgaagacgtcggccaaggacacgccagggaagaaggcccctgccaagaaggccgctccctcgaagaaggcggcgaccccggtgcggaaagcgccgtcccgtaaggccaagaagtaaagcggccaagaaggggggcgcgatgctgtaaatttgatatcggagaggctcgggtacactggtcattcagtatccgagaccgatagctgaggctagtggcgatggaggactgtgttattactactataaactggtggttgtgtttct

SEQ ID NO: 53939 - DNA, 428 bp, Zea mays
  Clone ID: LIB3068-038-Q1-K1-G4
cggacgcgtgggcggacgcgtggggaaagagaccgagatctcgccgatagctagcatcggggcggccaaggcgctcctcgtggtagcgctcctgctcgccgccaccttcctcgacggctccgctaacgagcaagcccaggcggccaaagaggagaagaaggcggaggtccaagactggcacggcggcggcggctacccggggcacggcggcggcggcagcggaggctacccggggcacggcggcagcggcggcggcggctacccgcactgccggtggagctgctgcaaccgcgggtaccatggccgctgccggtgctgctcgcaccctgatcagataccagaacccatgtaccgacctgagctcgtcgagggccacaactaaatagtaatgagatgcgctgctactatatatacgggtacctatgccc

SEQ ID NO: 53940 - DNA, 431 bp, Zea mays
  Clone ID: LIB3068-038-Q1-K1-G5
cccacgcgtccgcccacgcgtccgcccacgcgtccgcgagaggagactttgctcgctttgggtgggcatccgcgcggagcgtgaccagacggtgtagagactagatagatcggaagggggtctaggcatagagagcgaggaggatgaccggcgttgctgcaggcgccggagggggcaacaaggcggcgggcgccacgctgcggctgcaccactaccttgtgatggccggggtggcggcggcggtcgtactcgcctgcctccggtacgcgccggaccccgcggggtacggcttcctggccgtggcgccgcggacagtggaggccgttgctggtgcccggcgggacaccactcctccaccgcgcccgtcgtcgtcgtcgtcggtggtcatcttcaacttcggtgactccaactccgacacgggcggcatggcg

SEQ ID NO: 53941 - DNA, 279 bp, Zea mays
  Clone ID: LIB3068-038-Q1-K1-G7
cccacacgttcgcccactcatcctccgcactcgtacaccagaagatactttgatcgctacgagcccttatacgcgcagagctacaccatatatcatacatactatatatatccaacatgcctttacacatacatatctataataataacccccattccttaacacgcctaatccactaacaacacatcctcctccacactactgcttcaccactaactagttatctccaaaaaggcctctccactaatactcacatatccttgctacacgccacacccc

SEQ ID NO: 53942 - DNA, 439 bp, Zea mays
  Clone ID: LIB3068-038-Q1-K1-G8
cccacgcgtccggcgaccgccgccggttccctactcacccttggccggcgacgacgagggccaccacggcaggatgacgacgctgaggaacctcaagatcaagacgtcgacgtgcaagaggatcgtgaaggagctgcgctcgtacgagaaggaggtggagaaggaggcggccaagaccgccgacatgaaggagaagggcgctgatccctacgacctcaaacagcaggagaatgttttggctgagtcaaggatgatggtcccagactgccacaaacgacttgaaactgcactggctgacttgaaagcaacactggctgaactgaaggagtcaaatgagcaaggtgccgagattggagaagctgagagtacaatcgcagaagttgaagcagttgtcaagccagcagaagattaaactaaaaaaactcttggtttgctgaac

SEQ ID NO: 53943 - DNA, 298 bp, Zea mays
  unsure at all n locations
  Clone ID: LIB3068-038-Q1-K1-G9
cgtgaggcgtgagtccgtgaccattcccgtcggccgttccaaatgaagcgcanatttacaacgcantcgaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggagaccgactggcggcgtcgggcccgggactggc

SEQ ID NO: 53944 - DNA, 432 bp, Zea mays
  Clone ID: LIB3068-038-Q1-K1-H1
gcttcatagctttctcatccagtatctcatgcataaagaagctcggacgtcatgtccctgatgcagcgaacaccaattcaccagttcagcgagcattgtggctactcttggatctggagaatctcatgcctctttatatattatggatctttctgaagctgttgacttggcaatcggaccatggactacctacagagttcattcacttgatcgaacaatgtggacagctgattgtagttctgatggcacacatgcagctttcggttcggaccttggtgctggtctgatcgatttggaaacaaggggatcatcgtgggtatgtcgttctaaaagcgacattctttccctgaaatttgtgcactcgggaaaagttgtgctatgtgggctacggaatgggagtatagcccctggtgatgtacggcaaaaacagca

SEQ ID NO: 53945 - DNA, 339 bp, Zea mays
  Clone ID: LIB3068-038-Q1-K1-H10
gcgtgctaaatctgctctcgagaaagttctccgttatgaagatctgcatggagcgccaatacttggatttggagacaagcaggattcaccagcagctgtcacggaggaagaattggctagacatctgcatcttaaggagttagacgagaggccatgcatgttccaggctggatctgccttcaatgggacggggatcaaacatggcgttgactggttggtggaaaaaatggagaggaagtaacgcaccgaggcactaaaggcgcgtacagaagcagctgggaagatttaacacctcaattcagggctatcacctgtgattttccaaatgcaaagcatctg

SEQ ID NO: 53946 - DNA, 304 bp, Zea mays
  unsure at all n locations
  Clone ID: LIB3068-038-Q1-K1-H4
gttgattatcgccgcaccaactcgagaacctcacccctgatcgtgtatgttatggggcgggatgggtangcagcctccacacctttttagctgactgatcggagagttactcctaggcaactcttgtttctagatttgcaaatggtgtctgaaactctgcgtttgctgcggcagaacgtgtacttaattgttcgtgataggtctgaataacacatggatggtatcagtctgtagcttattttttttacttgatccgtttcttctgtgggttgtgatttgtgaatgaccaaaagatggatgctgt

SEQ ID NO: 53947 - DNA, 438 bp, Zea mays
  Clone ID: LIB3068-038-Q1-K1-F4
cccacgcgtccgaaacttcctgacttcgctcccttgagcgtagtaaatttgacaagctgtggagagctattccagggtctcatactcctgaaccatcagaagctggatcatcaacaaaagagaactactttggagaccatcatgacgctagaagtatacatgatggaggatcaagagatacttcttttaggagaacaaatcatgggccttctgtatttgttatcagtggtagttctctcagttcagcaaagcagatgtctcctttatctattaacaaagtagccataaacaatgctgcaaatttgcaacaaatgaagactggtgattggcgtgttgaggtgtcagttccaaagcagagtatgatactgctggttgataatgacgagaaggggtccattaaagtctgcagcctaaaagatacaaagagaaatgcatatg

SEQ ID NO: 53948 - DNA, 428 bp, Zea mays
  Clone ID: LIB3068-038-Q1-K1-D5
gagcccccgagctacctcaccggcgagttccccggcgactacggctgggacaccgccgggctgtccgccgaccccgagacattcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggcctt

SEQ ID NO: 53949 - DNA, 292 bp, Zea mays
  Clone ID: LIB3068-038-Q1-K1-D6
attccctgctcgacgcactcatcctaatccccctacctacctcaccttcaggtttcccatctactacttctattacaccgccagtctatcttccaaccccgagacattcaccaataacctctatctttaaattatccactcccacttaaccatactctactctctctcctgcatcttcccctatcttctctcccgcaacttcttctatttctactaaaccttctatttcaatgccttctcccatatcttcatccataccttatctaactacctctacaaccccatccttatc

SEQ ID NO: 53950 - DNA, 366 bp, Zea mays
  Clone ID: LIB3068-038-Q1-K1-D7
gcagcgtcaatcgcggcacttctggagaacaggtggagaatactaaaccaaacaaggatggagatagatcacacgctactgccagcggcgcaggtggtgctcaacatggcgagggcaaatgagatcatttacctccacggcagggacgcctacaccttcggtgctgacctcaaggaccttgtcaccacactcttcctcaagcaagtgctccctctctagacaatactctgatcacacaactagattggctataacgattctcgtgttgtattacgctttgtgtttcattatgcacgctatatatatgatcaatgtacctgtttctatcatattgatggtaatataatattctaaatggatatagtt

SEQ ID NO: 53951 - DNA, 438 bp, Zea mays
  unsure at all n locations
  Clone ID: LIB3068-038-Q1-K1-E10
gtgaggatgacaagttgacggtcgctcgggctagaattattcagcgtttcctgagccagccgttccatgtcgctgaagttttcacaggtgctccagggaagtatgtggagctgaaggaaagtgtgaagagtttccagggtgttttggatggcaagtatgatgacctccctgagcagtcattctacatggttggaggcattgaggaagtcattgctaaggccgagaaaatcgccaaggagtctgcttcataaggcggcttcttgcttgttgaatcctgtacaatcaagttccatttttggatttaagcgattgtttatgcttttcgcagttaggcagcacgagttggaggtccatctnctgctgaaatgctttgttttctctttgttgttcaaacactttacacccaaataagcaactgcagtgacattaattttggct

SEQ ID NO: 53952 - DNA, 461 bp, Zea mays
  Clone ID: LIB3068-038-Q1-K1-E12
gcgcggacgcgtgggcttgttgcaggggaccgatatttgtaaccattcgtcattccaaaaccaggggtcaccgctgttcctagggcgaaagatgacgactgcctcattcttgcaagtgatgggctgtgggatgtagtgtcgaatgaagaggcatgcaaagctgcgcgtcggcagatccagctgtggcacaagatcaacggtgtcacatcatcattgtgtgacgagggtgatgaatccaatgatcctgctgctcaagctgctgctgattatcttatgaggctcgcactgaagaagggtaccgaggacaatatcactgtcattgtggttgacttgaaacctcgaaagaaggccaagagcaactcatatcactgggatggatccatcacggtagagctgaccatgatatgtccaaaggcttctgctggtacgttgtggtcgtccgcaagagacttgaccccaca

SEQ ID NO: 53953 - DNA, 430 bp, Zea mays
  Clone ID: LIB3068-038-Q1-K1-E5
aaaaaaaaaaaaataaaaaaaaaaaaaaataaaaaaaaaaaaataaaaaaaaaacaaaaagagaaaaaataaaaagtaaataaaacaaaaaataacaaaaaaactggttctcccctttaaaggtctcagatttacttccccttacttcctacgcattctcttttttttattgccacataaatctatttacctggcccttttttaacaccttctcatttggaaaaaccctggttttacccaattatattgcttttaaaactattcctttttctcctattaccctaatactgaaaaaccctttcccgatcgatattcccaacattttggccccctaaatgcctaatgtgacgccccttttcacctcatattaatcccatggatccttcactttacacctaaccttaccatttcctttgccttctccttatac

SEQ ID NO: 53954 - DNA, 434 bp, Zea mays
  Clone ID: LIB3068-038-Q1-K1-E6
cccacgcgtccgcccacgcgtccgcgcacgcgtccgcccacgcgtccgcccacgcgtcgggtcttcttcagcaaggagcagggccctcgccaaattaggcacagcaccttcaagcacacacaagttccgatgctttcacaaagtccaagcaccaaggataactagggaatggaatccactttggacccgatcatggacttggaaactttctctatgccaccaagcatctaggctatcatcagtctgagcacattagcctagcacccacttgtgttgaaatctttctctataacccaagttatgatgtattgaaaccttttttcttataggtatgagtgaccaagaggtagcagattatatgaaaagtttggcaattcgggtttctggttttgatgtgccaaggccaataaaaaactttgaggattgtgggtttc

SEQ ID NO: 53955 - DNA, 428 bp, Zea mays
  Clone ID: LIB3068-038-Q1-K1-E7
gcgagctgagcaaggcggaggcggcgatggagcggctgcagcggatctttggcgcctcgggcatggggcagccgccgacggactcgccgcttctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttg

SEQ ID NO: 53956 - DNA, 362 bp, Zea mays
  unsure at all n locations
  Clone ID: LIB3068-038-Q1-K1-E9
cgggtcgaccggcgcgtgcggaccgaataaccacccgtctgccgctgtgcctcacggtttgcaccccgcacgagacccgtcgtggaggggcacgtgctagatgcggggcgcctgcctctcgccgccgatacggtgcctctcgcggtctcgctccccctcgcagacatgcagagccagatagtgtgccacgggtgcaggacccttctgttctacccaagaggtgctccgagcgtgtgttgtgcggtatgccatgtggtcaccaatgtgccgncttcagcaatggagatggctcgacttatatgtggtggctgccagacattattgatgtatgctcgcagtgcaacaactgtaagatgctcatg

SEQ ID NO: 53957 - DNA, 434 bp, Zea mays
  Clone ID: LIB3068-038-Q1-K1-F1
aggattttctcttttttccattcattattatggtatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaa

SEQ ID NO: 53958 - DNA, 424 bp, Zea mays
  Clone ID: LIB3068-038-Q1-K1-F10
gcgaatgttttgtctgctcacaaacagggaggcgttctcctgtttttacgtggatgcggtcgccgagtacaccgagaagcatatggcgtcgctgagcgccgactacgggctggatttgggcaccgtcagaggaaccgtcaacaacgcctgccggattatcgaggtaccgtgacccgtacgtgagcttcaccccagtcgttgaaagatactagtagcagcagcagtagtagttccagtaccatcctgcaacggaaagacgaagggaggcggtcaatgaatggagaagaagaatatatataataaaaaatcatctgatggcgttgttcgttctccgtgtttcaagtgcggagggacttgggctcgctggacaggtacgtgtgggcgttcgtgaacaacatgccgctgtcgccgagctacaagtaca

SEQ ID NO: 53959 - DNA, 314 bp, Zea mays
  Clone ID: LIB3068-038-Q1-K1-F11
tctagatcttctcatcataccgataccgggctcaacttctctctttcccagcctcacaacgggttcctgtttcagtcgatcgcagttagcatggccgcgacacagagctgtcaggctgctgcttgcttaccggccgccgtggcggtcgacgaggagcacggtcaccacagccaccagctgaagggaggagcgcatgaggaggctgagaacgacaataagccggagctccggcgtggcccctggaccgtagacgaggacctcaccctcgtcaactacatcgccgacaacggcgagggtcgctggaacaaacctcg

SEQ ID NO: 53960 - DNA, 421 bp, Zea mays
  Clone ID: LIB3068-038-Q1-K1-F12
tccacacgttctacactcgtgcgaccaggcttacgtttattcgtccgcccacgcgtccgggggggcgggcttctgctgatcgtacggatcaggttcgggatccagaggttctacgctgctcggtgttgtgggtgagccgatccagacggcgacgtccaatgtcgagtaccgctgcttctgaagcgacctgcgctggaccacggtcgaacactcaatacacaacaccttcagcacctaccgtgaagcgctcacgtggacgataatcctggatacgtacagacgcagacagacccgagggttcggttgaactaaccttgtccacgcaggagggctaacgcagacggcctcgatgtcatcaactgcaatggatcaagtacgtcgcagcatgaccgacaacgaggcccattcccgccgacgacca

SEQ ID NO: 53961 - DNA, 302 bp, Zea mays
  Clone ID: LIB3068-038-Q1-K1-F2
ctcagacctccatccctcaagaaacgagaccttacatatgataccactccttaacataaaacaaacgcttaatcaacaaaaacaacactaatcacaacaccctgatcatcccctaaattacacatctacatcaaaaaaatgcaccttaattacgacaatataacaactgtaacttgatcccgttccatataacattacacctcaaccattaatgcataaccataacattcattataacaaagatcatcaacctatttcctttacaaatcctacagtacatcacctcataagaccaatcccta

SEQ ID NO: 53962 - DNA, 317 bp, Zea mays
  Clone ID: LIB3068-038-Q1-K1-F3
ttttctcttttttccattcatgattattctatttattctgacctccatacctcgagcgagagtttacacataagaggccactctttaacatgaaaaaaaggaataatcagctctgacacaaaataaaacgaacccttttgtaactcctcattcattagcaaaaactcaaaaaagtcaatatcaatgacgagaaataaataattgcaacgtcgtccctagcatctaacattctacccccaatggttgtccatacaatctcgattcataatggaaaagaacatatacctatttacattaccaatcctatggtatatctc

SEQ ID NO: 53963 - DNA, 437 bp, Zea mays
  unsure at all n locations
  Clone ID: LIB3068-038-Q1-K1-D4
cccacgcgtccgcccacgcgtccgcccacgcgtgcgagcgaatccaaggaagaagaagaggatgaggatccatggagaagtgcangtcggtgccgcacgagcactcgtcggcgtactacggctgcggaggcgggtacgactacgaggacgtcggcggcgggcccgggcaggccggcaagtcgtacagcttcaacgggccgagcggccgggacgacccggaggcgaagcggcggcgccgcgtggcggcgtacaacgtgttcgccacgcagggccggatcaagaccaccgtccgcagcagcgtcaagtggctcaagtccaagttctccgacgtccgctacggtggcctctgaactgatctgatgagcctactgcatgcaacccatcctactnctacgaccgcacacatatatgtgtatgcacgaaccatgatgctcata

SEQ ID NO: 53964 - DNA, 428 bp, Zea mays
  Clone ID: LIB3068-038-Q1-K1-B7
cccacgcgtccgcccacgcgtccgcccacgcgtccgcgccgctgttccccgcagcgctatggacccaatctcgtccgacccggcgcgtcgtcccctccagatctccgtcgccctctccaggtagcagaaactgttctgcttcagtctgacaaagtggagggcttaggagtttctgcttcttttatgtctgaacaatctttgctttatttgggattgttgggagagtactctcgtgcaacgaggaaaaggcacaaggttccgttccactgcatgcgtcaagagcctgtctggttttcttgttctgatttgtcatttgctggtgctcaaagccggcttggtttcctcgaaggatcagcatctactcttgattgtggactttgtcgcatctgatatcaacttcataaatctttatccaagatggcgctgca

SEQ ID NO: 53965 - DNA, 435 bp, Zea mays
  Clone ID: LIB3068-038-Q1-K1-B8
cccacgcgtccggcaactgcaaagcagcaagctctactcttcttctgtactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaacaagtccggagacgacggctacgacagcgggtacaacagatcgggcaccacc

SEQ ID NO: 53966 - DNA, 426 bp, Zea mays
  Clone ID: LIB3068-038-Q1-K1-B9
ctccgaccaccttccccgtttcaattcgggtcactccctgcagtctccactcgccgctcccgcgaccccagagctctctctcgctctccctccctcttcctagctccccctttccggcatggcctcctgctagctcccgtcggaacgcctcccagatcccagacgcagcgcgctaccccacgcgagcgaaggccggcgcgcgacatgggagggtgccacgcgaagccgctcacgcaggacgcggacggctcgccgccgcacgcggcgccggcgaccccgcccccgggcaacgctacccccggccccgggaagaagcactgggcggtgtccccgttcttcgcgttctccacgccgagcccgagccccgcgcaccacctcttcggcggctccgcggcgtcgccgcgcaagtcccccgctcccccgggc

SEQ ID NO: 53967 - DNA, 427 bp, Zea mays
  Clone ID: LIB3068-038-Q1-K1-C1
gagcaatggcggagccgagccagcagcagctgctgcggtcgttcgtggaggtgccggcgggctccgacttccccatccagaacctgcccttcggggtcttccgccggcggggggtgcaggcgcaggcgccgcgccccgcggtggccatcggggacttcgcgctcgacctcgccgctgtcgccgacgcggggctcttcgacgggcccgcgctctccggctccccgtgcttccaccaggagacgctcaacatgttcctggggatgggccggccggcgtggagggaggcgcgcgtcacgctacagaaaatcctatcagccgacgagcccgtcttgcgtgacaacgaagcgctgaggaacaagtgtctggtaccaatgagtgatatagagatggttctaccaatcacggttggaggttacacggacttctt

SEQ ID NO: 53968 - DNA, 422 bp, Zea mays
  Clone ID: LIB3068-038-Q1-K1-C10
cccacgcgtccgcggacgcgtgggatcgcgagttgcgtcgacggtagaggaaaaatcagccggggactctcttccgtaagccctagcccctagcccctagccgccagtgtcatgcattcgtgctgaggctcaactgctgatccgtcttccaagctctggtatcatccctgagcactgatttaagatgtatctccagtactacatcaacgagaagggggacaaggtctacaccaccaagaaggagtcacctcttggggtgccaacgcagtctgctcacccagctcggttctcacctgatgaccagtactctcgccaacgataccctgttgaagaagagaattggacttctgccaacgcaaaatcaagaaccgaatacctgaacttcaaagcaactggcccacctggcaaggtccttttggggc

SEQ ID NO: 53969 - DNA, 436 bp, Zea mays
  Clone ID: LIB3068-038-Q1-K1-C4
cccacgcgtccgcccacgcgtccgtgaacattcaaatgagctggcaattttgagagatcgaattgcgatgttccatggaagagaatgataatgctaggagttatgtttctgaaagcaccgccactccttccctttatggcacaaatcaatcttatacagccccagaccattctcagaatgtttaccaggtacctcagccatacaatgtaccaagtaatacatattcagaagcttacccacaacaacctactggcgcctatggatacaacaacacatatcaacctcaacaaccaacccatatgtttgttccacctagcgcccctgccagctctcagcaacagccaggtccttcacctgtaccagtgcctcagcaaacagtgaaagcatttactcctgcgaacccagttggtctaaaaaatccgggacaatatcagca

SEQ ID NO: 53970 - DNA, 313 bp, Zea mays
  Clone ID: LIB3068-038-Q1-K1-C5
gcagaagcgcccctcggccctcgctcgccacaacaagctcaagccagccttctctgtctcgctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggtgtctccgcccgtgccgtccccgaccatgcctcctccggcgcccgcgcccgtccccaaggccccggccccggcgcccgaggcccccaccccggcacccacggtcg

SEQ ID NO: 53971 - DNA, 433 bp, Zea mays
  Clone ID: LIB3068-038-Q1-K1-C6
cccacgcgtccgaccatgagcagctctctgtgcctgaaatcaccaatgctgtatttgaggcctcaagcatgatggccaagtgtgacccaaggcacggaaagtacatggcttgctgcttgatgtaccgcggtgatgttgttcctaaggatgtcaacgctgcagttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgcgcattcgttcactggtatgtcggtgagggtatggaagagggtgagttctcagaagcccg

SEQ ID NO: 53972 - DNA, 235 bp, Zea mays
  Clone ID: LIB3068-038-Q1-K1-C7
ccagcgtccgaaaaaaaaaaaatagaataaaaaaaaaaaaaaaagggctatcgtctgggggatcctatcttaggtccacgctcatgcacacttgtatgctgattatataatgtctcctatagttacacctactgtccatcgatttacacctcgttttactgcgaaatcactggcaaaacccatgttaatcgcatcttaatacatcttgcatttcatcatctgtttgtactacctg

SEQ ID NO: 53973 - DNA, 400 bp, Zea mays
  unsure at all n locations
  Clone ID: LIB3068-038-Q1-K1-C9
gcgcccacgcgtccggaacagctgtcgatccgattttcacttgctctccctccaacaagctaatgggngcgggtccatccctcttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaagccggcgccatcgccgtcggcgccttcgcactctacgagaagcacgaagcgaagaaggacccggagcacgcgcaccgtcacaagatcgaagaagaagt

SEQ ID NO: 53974 - DNA, 384 bp, Zea mays
  Clone ID: LIB3068-038-Q1-K1-D1
ttcccggccgaggacgcgtccggagcatggcggagccgagccagcaggatctgctgcggtcgttcgtggaggtgccggcgggctcggactttcccatccagaacctgcccttcggggtcttccgccggcggggggtgcaagcgcatgcgccgctccccgcgggggccatcggggacttcgcgctcgacctcgccgctgtcgccgacgcggggctcttcgacgggcccgcgctctccggctccccgtgcttccaccaggagacgctcaacatgttcctggggatgggccgtccggattggactgaggcgcgcggtacgctacaaaaaatcctatcatccgacgagcccgtcttgcgtgacaacatatcgctgaggaacaagtgtc

SEQ ID NO: 53975 - DNA, 458 bp, Zea mays
  unsure at all n locations
  Clone ID: LIB3068-038-Q1-K1-D10
gactctgagatcaagaagcacccgtggttcctgattaatctttccatcgagatgaccgacgagtagcatcgtagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttgatcgttggtgtctgtagatccttgttgtgctatgcttncattcgttcctggatcagatatgttgttgtgtaaccgagaaaattggcgttgctgtggacaacataaacagacccataaacttatgcggaaatctacccccc

SEQ ID NO: 53976 - DNA, 430 bp, Zea mays
  Clone ID: LIB3068-038-Q1-K1-D2
gaggagagtacagtgcaagcccgacttcttggattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattaaacttctatgacacctacaagattgatcctcaaaggggca

SEQ ID NO: 53977 - DNA, 434 bp, Zea mays
  Clone ID: LIB3068-038-Q1-K1-D3
cggacgcgtgggtttggaattaggaaagtgagcatacaacagggacaagagccagaaagggtggtggacaatgagctatgggggtaccaagttggcttattcggggaaaggaataacatctacacacaagattcaaaaattactgaatggacaagtatcgacaatttgacatatagcccacttacttgactacattttccacaccagtgggaagtgacgcagtgacactgaaccttagtggtatgggtaagggtgaagtatgggtcaatggagagagtatcggacgatattgggtctctttcaaggctcctagtggcaatccttcgcaatcactgtatcacataccacgagaatttctaaaccctcaagacaataccctagccctttttgaggaaatgggaagtaacccacagctaataacagtgaacacaatg

SEQ ID NO: 53978 - DNA, 432 bp, Zea mays
  Clone ID: LIB3068-038-Q1-K1-B6
cggacgcgtgggcggacgcgtggggagagactaaacaaccagcgattgcgtgaggaacgggatgctgcttacagagctgcacttgaagctgatcaggccagggaacgtgaaaggttagaggaactggaaagacgtgaaagagaggctgcagaggctgagaaaaagcgtaaagaagaggaggaagctgtagcaagggcatcccaagaagcagctgagaaggaagctgctcttgcaaggaggaggcaagagaaggccatggctcttggagctgaacctgagaaaggaccaggtgttactcgggttctcataagattcccaactggagagcgcagagagcggagattctacagttctgcaaccgtcgcttccctctatgactatgtcgattctctagactgcatgaaagcggagacgtacaccctagtttcgaat

SEQ ID NO: 53979 - DNA, 468 bp, Zea mays
  unsure at all n locations
  Clone ID: LIB3068-037-Q1-K1-G7
aaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggccgggagcgggtgcgagggcaagaacttctacacccggagcgcgttcctgagcgccgtcaaggcgtacccaggcttcgcccatggcgggtcgcatgtgcagggcaagcgcgagatcgccgncttcttcgcgcacgccacgcacgagaccgggcat

SEQ ID NO: 53980 - DNA, 477 bp, Zea mays
  Clone ID: LIB3068-037-Q1-K1-H1
cccacgcgtccgtgaatccatatgcagaaggtgggcgacccgtcgctgaaggcactgctcctggacgaggagcggctgacggaggcggggatagaggcgatggtgtcgcggttcctggcgcaggtgaaggacgggacgtggggcgagcaggggtggcccaaggtgtggacggactactccgtctccaagctggccctgaacgcctactcccggctgctggcgcggcggctggaggcgcgcggcgtgagcgtgagcgtgaactgcttctgccccgggttcacgcgcacggacatgaccaggggctgggggaagcgcaccgccggcgaggcggccgacgtcggggcgcggctcgcgcttgttgccgccaccgagcttcccacggggaccttcttcaagtggcgcacgccgcagctatactctaagctgtgactggctctgggctctggcttgcttgctagctgagctgtcgtccgtcgg

SEQ ID NO: 53981 - DNA, 424 bp, Zea mays
  Clone ID: LIB3068-037-Q1-K1-H11
gatgaacctaggtctttgacctacaacactgggattgaggagagaccgccgccgcctcagcgccgctgggtgccccctcagcctccaggtgttgcgatgccagaagcagctgctgctatacgtcaaccaaaggtccctccaaagcagccctccagcgatgcctctcgggcagctggagagatgcaggtgaatggtgcttcaagtgcatcaccggatgctgtgactgaggttcctgttaatagtgctaccacaagtgatgctggacacagcgagatcgaagaacaaccagtggccgtctaagtgaaaaaccgagaccagccaagaactgggaagcaatctaagagagatttggggtttctggtacatacctgggtttgtcatacatttctgaataacatgtgtcaaaacagcatgacgacaacat

SEQ ID NO: 53982 - DNA, 358 bp, Zea mays
  Clone ID: LIB3068-037-Q1-K1-H12
gacggatgcatccactctgtcactgtggattcttgatcctgctggacgtgatgcaactgttttgagagaagcggtaaagggtgacactatggatctgagagcagccactgagattatatgttccaggacaccatcacagttgcaaataatgaaacagacttattatgctagattcggtacttatcttgagcatgacattgctcaccacacatccggtgatcaccagaagcttttacttgcatatatggggattccacgctatgaagggcccgaggttgatcctacaaatgtgacacatgatgcaaagggtttgtacaaagctggtgagaaaaggctgggtacggacgaaaagaatttt

SEQ ID NO: 53983 - DNA, 433 bp, Zea mays
  unsure at all n locations
  Clone ID: LIB3068-037-Q1-K1-H2
ccaagaagcaagaaaactagaaaaggctcctcccgaccgcaacgcccctcatctccctcgaccccggcatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgncaagctggcgcggtacaacaagaagcccaccatcacgntccgcgagat

SEQ ID NO: 53984 - DNA, 398 bp, Zea mays
  unsure at all n locations
  Clone ID: LIB3068-037-Q1-K1-H4
gggcttgccaagcttatggactacaaggatacccatgtcacaacagctgttcgtggaacaattgggcacattgctcccgagtacctatctaccggcaagtcttctgagaagactgatgtttttggctatgggatcatgcttctggagcttattactggccagagggcatttgatctagctcgtcttgcaaatgatgatgatgttatgcttcttgactgggtgaaaggactgttgaaggagaagaaggtggagatgctggtggacccagatctgcagaaagcctacgaggaggtcgaggtggagagccttattcaggtggcactcctctgcacgcagggcttccccctggaccgtccaaagatgtcngaagtggtgaggatgctcgaaagtgacgggct

SEQ ID NO: 53985 - DNA, 358 bp, Zea mays
  Clone ID: LIB3068-038-Q1-K1-A12
cgcgggcagcgccagcctgccgctgatgcagaagctgtgctccgtgctggtggaccacgcggtcagcagcggcgacgcggagcgggagccctccgtgttctccaagatcaccaggttcgaggaggagctccgcgcggtgctgccccaggaggtggaggcctgccgcgtggcggtcgccgagggcaccgtccccgtggcgaaccggatcgcggacagccggtcgttcccgctgtaccgcttcgtgcgcgaggagctcggctgcgtgttcctgaccggcgagaggctcaagtcctccggcgaggagtgcaacaaggtgttcgtcggcatcagccagggcaagctcgtggaccccatgctc

SEQ ID NO: 53986 - DNA, 420 bp, Zea mays
  Clone ID: LIB3068-038-Q1-K1-A5
gcaaaagcaatcgcgaaagcgagcgcgaggcgagtcgggcggcgaacggggcggatggggcgcgagctgcgcggagtccgcgacgacctattcgagctggggcgccacctgctcgacatcggctgatctctgcacccggttgtcaaaccgggccacaccgactcacctgcacgtacccgcacggaccgccggcgtgcgaaccggtatcggggacagcacggtcggtgacgctgcaccacttcgtgcgctaggagcttggctgtctgatcctgaccagatcagaggctcaagtccctgggcgatgagcgcaatatggtgtggcgcggcatcagccagggcaagctcgtggaccccatgctagagcgcctcaaggagtgggacggcaagccgttgcccatcaacatcgagtcaaagaacgcc

SEQ ID NO: 53987 - DNA, 432 bp, Zea mays
  Clone ID: LIB3068-038-Q1-K1-A8
cccacgcgtccgcccacgcgtccgcccacgcgtccgggttctggatgacgccggggtcgggcaagccctcgtgccacgccgtgatgaccggcgactggaggccctccgccaccgaccgcgccgcggggaggctccccggatacggcctgaccacgaacatcatcaacggtggtctagagtgcggcgaggaccgctccaccgacggcgccaaagccgccaaggaccgggtcggctactacaagaggtactgcggtatgctctgagtggggtacggggacaacatggcatgcgggagccagaagccttacggaggatgatgacactagtagctgatctatggttgctgcaatgcaagccttcacgtgtgtttgcctctctacctaaagaataaatcaagctagcagcaaacctaccttccgcgtgtgtctactt

SEQ ID NO: 53988 - DNA, 263 bp, Zea mays
  Clone ID: LIB3068-038-Q1-K1-B10
tacctccctctttctatctccccctttccaacatgacctcctgctagctcccgtcagaacgcctcccagatcccagactcatctctctaccccactcgaacgaaagccggcgctcgacatgggagggtgccacgcgaaaccgctcacgcaggacgcggactgctcgccgtcacacgctgcgccttcgaccccgcccccgggcaacgctacccccggccccgggaaaaatcacttttcggtgtccccgttcttcgcgttctcca

SEQ ID NO: 53989 - DNA, 455 bp, Zea mays
  unsure at all n locations
  Clone ID: LIB3068-038-Q1-K1-B11
ctcagtgttctactatgagattctgaacgcacctgactgcgcctgcagtcttgcaaagcaggcttttgacgaggccatctcggaactggacaccctgatcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccaccttgtttgtggcggngggcgctggagcccgggtctggtgggttg

SEQ ID NO: 53990 - DNA, 454 bp, Zea mays
  Clone ID: LIB3068-038-Q1-K1-B12
gcgctcactcgtccaatatatatcccccaaccgactataactgctctcttcatatgaactgccccgcatgcgtcaagtgcatcaccggactgatcactccaaacatcaactatacgtggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgg

SEQ ID NO: 53991 - DNA, 432 bp, Zea mays
  unsure at all n locations
  Clone ID: LIB3068-038-Q1-K1-B3
actgcgccattggccagctagagccggccagaagagcttgcagttactgagagtgtgtggganagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacaagccgcccaaggagcacgggcccaagccggagaagccgcccaaggagcacaagccgacgccggccacgtacaccccgagccccaaacccacgccgtcgacgtacactcccaccccgacgccccccaagccgacgccacccacatacacttccggccctacgcc

SEQ ID NO: 53992 - DNA, 157 bp, Zea mays
  Clone ID: LIB3068-038-Q1-K1-B4
cccactcgttcgaaaaaaaaaaaaaagattaaaattaaaaaaaaaaaaaaaaaaaaaaaagaaaaagtaaaaatgaaaatatagaaaaaataaatattaaatcataatcaattaatataatattaaacaaaaatttaatcaaaatatataaattaaa

SEQ ID NO: 53993 - DNA, 266 bp, Zea mays
  Clone ID: LIB3068-038-Q1-K1-B5
aacaaacaaacaatataaaaaaaaaagactacaaaaattatactaattatcatcgggaagcgcacattcatacagggtcgatacctaacttatcacttcacatcaatgactaatactgacacatcactttacatcatgcatcatctcttaaagataactctactcctataactctaactgacatctccagacaatccctctttaacatattatcagatgctacccaaacagccactctacctgatcggccattaaatccgtctcta

SEQ ID NO: 53994 - DNA, 438 bp, Zea mays
  Clone ID: LIB3068-037-Q1-K1-G5
aaaaaacgtacgaacacgacgtacggcatactggaaatcatgttcgacaaagtaacgggactggagagatacaaagctcagtataagtgcttgtccttgtaggtgttgctgtatgcacagtcactgatgttagtgtgaactctcaagggttactagctgcagtaatagctgtttggagcacagcactacagcagcattatgttcaccaccttcaatggaagtactcgcttggctcattcaacctcttaggccatactgctccagcccaggcagcatcgttgttagtattgggtccttttgtggacttctggctgaccaacaaaagagtcgatgcttttaactacacatcaatagttacgttctttatcgtgttgtcgtgcataattgctgtcgggaccaacctaagccagttcatatgcatcggaagattcacggtcg

SEQ ID NO: 53995 - DNA, 55 bp, Zea mays
  Clone ID: LIB3068-037-Q1-K1-D4
gggccgacccacgcgtacgcccacgcgtacgcccacgcgtccgcccacgcgtccg

SEQ ID NO: 53996 - DNA, 460 bp, Zea mays
  unsure at all n locations
  Clone ID: LIB3068-037-Q1-K1-D7
ctttttattccccgtctcctttgttcgcttgcgggctgcggcaagggggagggagaggacgtgacgaggggaggggaggggaggagggagggcaggcgggccgacgaatgcacagtcccggagaatattggtgaagcaataacttgatattgggttctagaccaaagaagcaatggaaaaggaatcatctgccacatacgagccaaaaaggaacagtgaaataagggtttttgagagttcagatgagatttcaacggatcttgctgagtatatctcacaagtttcagaaatttctgtcaaagaaaggggatactttgccatcgccttatctggaggtcccctagtcagntttttggggaaactttgtgaagctccatacaacaagacactggattggtccaaatggtacatcttctggtctgatgaacgtgctgtggcaaaaaaccatgcatagagtaac

SEQ ID NO: 53997 - DNA, 52 bp, Zea mays
  Clone ID: LIB3068-037-Q1-K1-D8
acgctcacgctaccgcatatgatagatattctttttctcatcagcaatttaa

SEQ ID NO: 53998 - DNA, 387 bp, Zea mays
  Clone ID: LIB3068-037-Q1-K1-D9
cccacgcgtccggctaccagagagtccctcccgaggaaccctaccctcctccaggacatgctcgatctcaggcgcacccttacccaccgccaccagatgtgtacccgcctccccctcggggccatggacatccaccaccaccccatggcgtgtacccgccgccgccgcagggtccttaccccccaccacagcagcctccaccggggtaccagggctacttcaacgaccagcagcgtccttactacccgccgccgcatggagagcatcaacacaaccaccaccagggaaaccagggtagctcctctgggttcctcaaaggatgtttggctgctctctgctgctgctgcgtgctggaggaatgctggcgctgcttctgagacgtgagat

SEQ ID NO: 53999 - DNA, 380 bp, Zea mays
  Clone ID: LIB3068-037-Q1-K1-E11
caaaaagaggctgatagacgcaaaaaattcaaagaacaaaaatgatattagtgcagttgtgaaaaaggagattgatatggaattagttgctggtcaaaagatagtatctgaagctctcaaaatatcattgctgtctgaccccagagctatggatgcaaaaggtgagaatcgtcttgaagaggagccagcagaaaacaacttggttggaattagagatgctcgattgaaagagcggtgcaccaagactgactccatgacagtcaaagtggaacctgccaaagcagaggcgatggaatgtttagagaacagtagttttggcagttcggaaatggatctttcagcagtgaaagggaaatcaaaacccaagacagaaaagggtg

SEQ ID NO: 54000 - DNA, 192 bp, Zea mays
  Clone ID: LIB3068-037-Q1-K1-E2
cccacgcgtccgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagcccccc

SEQ ID NO: 54001 - DNA, 416 bp, Zea mays
  Clone ID: LIB3068-037-Q1-K1-E3
cccacgcgtccgcggacgcgtgggaaatgattcatttgacccagtcggcaaagaggcccgcactagataggtgacccaataaggcaataatgaacccatggtcggagtagtggtgtcattacatgaacataagttactatttaattagcatggagaatagaaggtggcgatcatttccttagctcctgttagtgtccctgaacataagttacccatggtctgagatgttacatctttctgagctatcttctctcggtttgtacttctgttagtgtccctggcaccatatcattcatttggagatattcaatcagctgtgtggctatgtaaaattggttggattttaagtgatctgtgagcattaactttcaatgtaccaaaaatcgatcttaatatatgagatggattatatgggg

SEQ ID NO: 54002 - DNA, 465 bp, Zea mays
  Clone ID: LIB3068-037-Q1-K1-E4
cccacgcgtccggcaagtctgcctccattggttccgtggaggagttatttgaagaagggtctgcaatgctagaagaaaggtatgcttgctcttccaatgttccactgcattcgtcttgtgttaatttctgtcagtatcattttctctcgttttcatcttgggtttttggccctgtttggcacagcttattttcagcttcttcacaaatttaagcagaagttctgccaaacagccagcttctacagcagcttattagttcagctgcttctcagaatacactaaaagcagccaacaagcagaagctgcctttcaccagcttctcagataagctgctttttcaacaagcagcagttgtgccaaacaaggccttttaatgtacatataatgtgtgggatggtaagatactagcatgctaccttgagccttgtcattttcttagcatatctggacaggcttgtttatttc

SEQ ID NO: 54003 - DNA, 405 bp, Zea mays
  Clone ID: LIB3068-037-Q1-K1-E5
ggccccgtcgcccgtccccacgaagccgcctttccccgccgcttccatcccaatctccgtctccgtctcccccgttcccgttcccgcgtccgtctccgtccccatcggcgccgacgggtttgggtctccgcccaacacgctcacggagccggtatgggacaccatcaagcgagacttagcacgcatcgtcagcaatctcaagctcgtcgtcttccccaatccctaccgcgaggaccccggcaaggcgcttagggactgggacctgtggggtcccttcttcttcatcgtcttcctaggcctcacgctctcctggtcggcttccgtgaagaagtctgaagtatttgctgttgcattcgcggtcctggcagctggtgctataattctgaccttggaatgtctgcttct

SEQ ID NO: 54004 - DNA, 125 bp, Zea mays
  Clone ID: LIB3068-037-Q1-K1-E8
acgcttacgctaagactgactccattgttcccgtgaatcaactatttcaaaaaccgggggtacggctcgaagcaaacgatcctcaggctctcactgtcccacccgatttccctcccggttatttc

SEQ ID NO: 54005 - DNA, 387 bp, Zea mays
  Clone ID: LIB3068-037-Q1-K1-E9
gcgcgtcaggctctacgtccggggcaccatcctcggatacaagaggtccaagtcgaacgagtacgagaccacgtcgttcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaaccttccgcctgagtccatggggcgcaaggtcagagtgttcatgtacccgagcagcatctaaggttaggtttttggtgaagtaaaagtggactccaaatggccatgcttatttcttctctctgagcttaaaat

SEQ ID NO: 54006 - DNA, 366 bp, Zea mays
  unsure at all n locations
  Clone ID: LIB3068-037-Q1-K1-F10
aggtccctggttgacgacacgcttcgaaaagtgaatgggctaaaacctatcgccgctgaacttggcgtttcgttagctcagctctcgattgcttggtgcgcgtcgaaccccaatgtctcgtctgtgatcactggagccaccaaagaaagccagattgtggagaacatgaaggccctagatgtcatcccactgctgacgccggaggtcgtcgacaggatcgaggcggtggtccaaagcaagcccaaacgcaacgtcgagtcatacaggtgaaaattcggtgttcatccgacggagttcaggcctnctncacgaaaactcatccatgatccgggtgtattctgggcgtggtgctgtgttcacaaacac

SEQ ID NO: 54007 - DNA, 343 bp, Zea mays
  Clone ID: LIB3068-037-Q1-K1-F12
gtaaactccgtccaaggctaaatacaggcgagagaccgatagcgaacaagtaccgcgagggaaagatgaaaaggactttgaaaagagagtcaaagagtgcttgaaattgccgggagggaagcggatgggggctggcgacgcgcaccggccgtatgcggaacggctcctgctggtccgccgatcggctcggggcgtggaccgttgtcgcccgcgccggcagccgtcgtcggcgcggacggtatccgcgcgcctatggcgcgcccctcggagcgcttcgccgcaacggcctgcgagctccccatccgacccgtcttggaacacggaccaaggagtctgacatgcg

SEQ ID NO: 54008 - DNA, 185 bp, Zea mays
  Clone ID: LIB3068-037-Q1-K1-F2
cggacgcgtgggaaaaaaaaaaaaaaaaaatataaaaaaaaaaaaaaaaaaaaaaaaaaaaaggaaaaaaaaaaaaaaaaaaaaaaaaaaaaaaataaaaaaaaaacaaaatatttaaaaaaaaaaaaatatataataaaataaaataatatatattaactttttataattttttacctatttaa

SEQ ID NO: 54009 - DNA, 442 bp, Zea mays
  Clone ID: LIB3068-037-Q1-K1-F4
cccacgcgtccggttcaagacgcagacggccgaccagttctccgaccgcctcgtggccatggtcggccgcaccgtgcaggagctctacggcatgggggcgcgccgcgtcggcgtcacgtcgctgccgccgctgggctgcctgccggcgtcgatcacgctgttcgggcacggcgccgccgggtgcgtgtccaggctcaacagcgacgcgcagagcttcaaccggaagatgaacgccaccgtggacgcgctggcgcggcggtacccggacctcaagatcgccgtcttcgacatctacacgccgctgtacgacctggccacggacccccagtcgcagggcttcgcggaggccccgcggggatgctgcgggacgggcacggtggagaccaccgtgctcctttggaaccccaagttcgtcgggacgtgccccaacggcacgttctac

SEQ ID NO: 54010 - DNA, 441 bp, Zea mays
  Clone ID: LIB3068-037-Q1-K1-F6
cccacgcgtccgcccacgcgtccggcattctggaaatcatgttcgacaaagtccgttactgtagagatacaaagctcagtatagtgcttgtccttgtaggtgttgctgtatgcacagtcactgatgttagtgtgaactctcaagggttactagctgcagtaatagctgtttggagcacagcactacagcagcattatgttcaccaccttcaatggaagtactcgcttggctcattcaacctcttaggccatactgctccagcccaggcagcatcgttgttagtattgggtccttttgtggacttctggctgaccaacaaaagagtcgatgcttttaactacacatcaatagttacgttctttatcgtgttgtcgtgcctaattgctgtcgggaccaacctaagccagttcatatgcatcggaagattcacggccgtctcgt

SEQ ID NO: 54011 - DNA, 310 bp, Zea mays
  Clone ID: LIB3068-037-Q1-K1-F7
cccacgcgtccgcggacgcgtgcggttactgtcgtgacatgttcagcggcgcacgagacatatgatataccatgctcaacctagtagcgtgtgcaggatatggccaataattgcactggatctgatcatacagataatgataaagaaaggctcgctccactaatagcttattggagcactttactagacgttcgcatatctcgcgaccattaaagggtaatatctatcacatcatcacaactagtacgccatactgagtgaaagatagcatgatcgctttgcattaccagtactgcgcctgactcgctta

SEQ ID NO: 54012 - DNA, 162 bp, Zea mays
  Clone ID: LIB3068-037-Q1-K1-F8
aaagttcaatatgcttgacgtgttaatcacactgctagagcatgcgataaatcggggttggttcattattaggaaattgcattgagctgtaatcagatgcttctctcctcaggtggtacaccgaaattcatacaatattgtgtgctaaaaaaacaacaaaga

SEQ ID NO: 54013 - DNA, 289 bp, Zea mays
  Clone ID: LIB3068-037-Q1-K1-D12
cgataatgacttgaatattgaaaaaacagagaaaccggcctcgagtttaactgcaacagagatgggctccagtatccaagttgaaccctctacggatgagttagatgaggccatacaacctcctgacgatgacatgggcatctcatcatctgcgtgggtagaagtagagcgtcaagaactagaagtcactgtttcgagtgaaaatgtagttgttgaagatgtaacttctccaagaattgcaccattgccgtcatcaagcccaagaatgcgtcattcggtggcacaaatg

SEQ ID NO: 54014 - DNA, 366 bp, Zea mays
  Clone ID: LIB3068-037-Q1-K1-G11
cccacgcgtccgcccacgcgtccgccagtaccgagtcctacgagcagtcgcacgcaagtgtcaagagacgaaacggtcgacatggctcgcacgcaatctgccgtagcggtcgccgtggtggccgcggtgctgctgctggcaacggcggcgacgacctcggaggccgccattacctgcgggcaggtgagcttcggcatctcgccctgcctctcctacgcccgcggcacggggtccgggccctccgcgtgctgctgtagcggcgtcaggaacctcaagagcgccttcagcaccgtcgtcgacaggcgcgccgtctgcaactgccttaagaacgccgtcaggggcgtcagcggcctcaacgccggcaac

SEQ ID NO: 54015 - DNA, 215 bp, Zea mays
  Clone ID: LIB3068-042-Q1-K1-G3
attccgttcgaccacgcgttcgggaggagaaggggacctgttcaaagctccagaagccatcatcgaggaaccgctgctcctgaactgtctgtctgattctgttcatttgttgctgtgtaagttgggcttgtgccaagcttgaattctcttgtgaaagagtttctcaatgctgctgatgacaagtggaaggaagtcctctcttaaattgaagaaga

SEQ ID NO: 54016 - DNA, 376 bp, Zea mays
  Clone ID: LIB3068-042-Q1-K1-G7
gaacagctcgtccgagaccatgaagagcagcctacacctggtgctgatcctgtgcctgcagtccggtctggtcatgggcgtcttcggcgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgccttctactcgggcaacaacaagttcaggtgcaccgacaccttcctcggcatgtgcggccccaagtgctagatcagagaggaagaacgcgcgctgctgctagctgctatagcttcgttc

SEQ ID NO: 54017 - DNA, 399 bp, Zea mays
  Clone ID: LIB3068-042-Q1-K1-G9
gcctcgcagccgtccgaggaaactcaaggggtcaactggttcagcagcgccttagacttagatgggcagtttgcgtggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatggaaaaaaaccttgcacatctggaacggcatgcatctcagttattagcccctgctgttgcacatgcaaaaa

SEQ ID NO: 54018 - DNA, 475 bp, Zea mays
  Clone ID: LIB3068-042-Q1-K1-H10
gtgtatagggagcaggagcaagaccactcaactctttgctgttatgctattggagatgcttctgaataattgcggagagcctgtccataggcaggtcattgataatggccttcttccaatacttgtgaagatagtgaagaaaaagacggatttaccagttcgagaaaaaatatttcttctgttagatgcaacacaaacatcccttggtggagctaaagcaaggttccctcagtactatgaggcatactatgagttggtgtctgctggtgtgcaattttcaaatcggccaaatgttcttgtcacacgagcagaagtgccagtcccagaaacgagaacagaaccaaataatgaaagtttatcgacccgtttgactgaagctcaacaagaagtgcacactcagcctgttcctgatgcaagtatagtccagaaagcctctagtgtcatggaagtattgagggatgtgcctaattctatg

SEQ ID NO: 54019 - DNA, 409 bp, Zea mays
  Clone ID: LIB3068-042-Q1-K1-H12
cccacgcgtccggcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggtgggcctggtggcgatcgcgatcgcgcacgcgctggcgctgttcgtgggcgtgtccgtcgcggcgaacatctcgggcggccacctgaacccggccgtgacgttcgggctggccgtgggcgggcacatcaccatcctgacgggcgtcttc

SEQ ID NO: 54020 - DNA, 163 bp, Zea mays
  Clone ID: LIB3068-042-Q1-K1-H3
tcgcggactcgtgggctgactcgtgggtgtaactcgtatgtgcttgaattctccatggcagctggtcgtgccatcggtagagttaggtcccgtttgttttgaggaactaaaaattaatccctctattttagtcaaaaaaaaataaaaaaaaaaataataaata

SEQ ID NO: 54021 - DNA, 397 bp, Zea mays
  Clone ID: LIB3068-042-Q1-K1-H4
gagcggcccccgtgaggagctcccacacctcgacggctggcctgctcgcgtggcctcaccccggtggctccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccttcgacgtcgtcgcaactgcctaccgtgatcgtcaggctagccagatcaccttttcccaggacgggaccgttcctaccaggaaggcaacttcagtggctggggtggcaaggcagcgtgagcttagccataccgtccagagtgagggggacag

SEQ ID NO: 54022 - DNA, 271 bp, Zea mays
  Clone ID: LIB3068-042-Q1-K1-H5
gcttctcctccccctccggttcgggttcgggttcgtgaggttctccggggttcgggttcgtgggggagcggatcgagatggcggcgtctgatgttgagtaccgctgcttcgtcggcggtctcgcctgggccacggacgaccactccctccacaacgccttcagcacctactgcgaggtcctcgagtccaagatcatcctcgatcgggagacgcagaggtcccgcggcttctgcttcgtcaccttcttcacggatgaggcgatgcggaacgc

SEQ ID NO: 54023 - DNA, 414 bp, Zea mays
  Clone ID: LIB3068-042-Q1-K1-H6
cggacgcgtgggcggacgcgtggggcggagcaacaccacaccacccttggtccggcactagcacgagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggctttcagacgcggggctcctacctcttcggccacttcagcatgcacatgaagctcgtcggctgcgactccgcgggcaccgtcacggccttctacctgtcgtcgcagaactcggagcacgacgagatcg

SEQ ID NO: 54024 - DNA, 118 bp, Zea mays
  Clone ID: LIB3068-042-Q1-K1-H7
acgcgtgttcggactcgtggttcggagcatcaccacaccagccttggtccagggctatcacgagctattcagtggagacgaagagggctacagctcagaggctgcaggttgtcgccat

SEQ ID NO: 54025 - DNA, 233 bp, Zea mays
  Clone ID: LIB3068-043-Q1-K1-A11
taaaaaaaaaaaaaaaaaaaaaaaaattattaaaaaaaaaaaaaaaaaaaaaaaaaaaagaagaaaatttaaaaaaaaaaaaaaaaaaaaacaaataaaaaaaaaaaaaaaaaaaaaaaaatatctcttttttttcaaattctcattccttacttcttctttttaattttttattcttctcttttctaccctcatttcaattcctttttctttcttaaactatttcttctcct

SEQ ID NO: 54026 - DNA, 389 bp, Zea mays
  Clone ID: LIB3068-043-Q1-K1-A12
cccacgcgtccgggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgccggcctcactggccggaagatcatcatcgacacctacggtggctggggagcccacggcgggggcgccttcttcggcaaggacccgaccaaagttgaccgcaacggggccta

SEQ ID NO: 54027 - DNA, 438 bp, Zea mays
  Clone ID: LIB3068-043-Q1-K1-A3
acgcgcacgcgtccggcacattatccaaacatccatttcggtttagacgactccgggcgagagggcaggatgaggctcgtggatcatgaggcggatgcgtctgtcgtcgcagtcgcagcagcaccgacagctgctgaaaagatccatggtttctactgatggtagcagatacatgtgtagattgattgatacatcatcggacggatggaagaattgataccacacaaactgctatatatatatgtactgtgagtaaacagttaaaattaaacttgtgagatataccgtacatatgaagagctagctagtagtgagtgatacagtgggtaagtgaatcatatatagtcgtagaaacaatcacatgaattgctattacgcaccatatatatgcacttaattatattggttgaggagacctaataaatcatttgacctacc

SEQ ID NO: 54028 - DNA, 424 bp, Zea mays
  Clone ID: LIB3068-043-Q1-K1-A6
cggacgcgtgggtctcgccgccgccacaccacatctccgtcgaagcgaagcaagcaatggccggaggcggatcgaaggccctcgccgatgccgccgttctggcggccgtctccctctcggtggcacgccgcggccgaggcgccggcgcccagccccgtctacgccgccgtcgcggcgtcgtcgcccttcgccgcggccctcgtcgtctacggcgccgccttcctattcgccgccgtccgccactgagcctatggggcctcgtgcctgcaggctacctagcagtacttacgccgctgctgccggcgccgcctagatctatgtattggagtgctatgcagtagtactagtagtagtgagtattcttcggtgctgtcgtgtcgaattcgcattttggtcggatccggttttcttggtgcatggaggg

SEQ ID NO: 54029 - DNA, 452 bp, Zea mays
  Clone ID: LIB3068-043-Q1-K1-A7
cccacgcgtccgggccgccctttttttttttttttgaagtataaaaaacattcgtttattcgtgtggactctggacagaatcaaagcctttcctgaactctagtacacgttaacgcacggaaaagtacacgaacactgagcttgctgttacaggcttacagttacagcgttcagtaaccagcaggtggagaccgtttagccagaaaccccttgtagtgctccaacagccttccggcgtccggcatcacctccttcacggcgtccaccgccaagaagcgctccgcccacgccgtcaaggccgggaacttggcctcgtccagaagctttacgccggccgcctcgtccaccaccctgatccacaccacgaagctcccgagcgcgatgtccacgagcccgacggcgtcgccgccgaagaagggtttccctttggagcactccctgaacgcctgctc

SEQ ID NO: 54030 - DNA, 409 bp, Zea mays
  Clone ID: LIB3068-042-Q1-K1-G2
cgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggctgaagaggtgaaggaggaagcggcagcgcccgctgccgagacagaagcagaaccggcagccgctgagcccgaggctgctgctgctgctgaggagcccgcggcggctgagccggccgctgaggagcccgagaaggccga

SEQ ID NO: 54031 - DNA, 319 bp, Zea mays
  Clone ID: LIB3068-043-Q1-K1-A9
cgccaattgtcacttgctctccctccaacatgcttattaaggccggtccatccctcttctaggtggtttcattatccagggctgacgagaagcaccaccaccaccacctgttccaccacaagaaggacgaggagcatgccgcggccggcgggtacggcgagtccgcctagtacacggaggccacggtgacagatgtcgtgtccacgggcgagaacgagtactactagtacaagaaggaggagaagcagcacaagcacaagcagcacctctgcgaggccggcgccatcgacagcggcgccttcgcactctacgagaagca

SEQ ID NO: 54032 - DNA, 343 bp, Zea mays
  Clone ID: LIB3068-043-Q1-K1-B11
gccctttctttctttttttacttcagcttccagtttatcccagtccttttttgactgcggagatgggtatgaaggtcttggggctgtttcagctggtgtgcttatcttctggggaatagcctttggtcttgcactataatccagggttgtacatgtcacctgctcagcttttgcacggcgtatttagaccttgctcgacaaaacttgatccttgcatttctcaaggataaccttataaaacagacagtgctgaaaatggcactgttcttcaccaagtactttaatggatacacttaacatctgttccaccaaatcaatgactacaacttccacagaacaccct

SEQ ID NO: 54033 - DNA, 487 bp, Zea mays
  Clone ID: LIB3068-042-Q1-K1-D6
tcgcccacgcgtccgaacgtcttcctttgctatacgcttggaagcacattgttcaaatcgttgacgagcattatcaatcaccctgctgagattgtgaatatgcttgccaagagcctgcctggaagcgcaacgttcttcctcacgtttgttgcgctgaagttcttggttggctatggccttgagctctctcgcctggttcctctcatcattttccacctgaaaaggaagtacctatgcaagacggaggaagaagtgagagcggcatgggctccagtggatctgggatataacaccagggtaccaaatgacatgctcatcgcaacagttgttctgtgctactcagtcattgcgcctttgattattccgttcggtgtcgcatactttgccctcggatggcttatagcaagaaatcagatcctgagagtttacgttcctagctacgagagctacggacgaatgtggccacacatgcacacgaggatcatcg

SEQ ID NO: 54034 - DNA, 386 bp, Zea mays
  Clone ID: LIB3068-042-Q1-K1-D7
tgtgatttttgcggaggagaaacacctgtggcagttgggtggagaagaataaagaaagctctcgcgcatcacacacctagcgctcgacggaatgattgagtttgaatcatcatcgtttctgttatttggtttagtatggtacgttaattaatcacgtgagttggagggcaagagttggattaatctcaaggtgaggctgacgattgaacatgaagatttgatgatctggtcaaataccaggaggagagatactcaccaagtggtcatcatttaacaacactatacgtagtgttaatccaaggtgtaagttttgttctgttgtggatggtgctaagtgccggtgggctcggccttcttatataagtatatcccatctttagcttctt

SEQ ID NO: 54035 - DNA, 52 bp, Zea mays
  Clone ID: LIB3068-042-Q1-K1-E10
tgaaaaaataaataaaatccaacacacactcacactggcgactctggacagc

SEQ ID NO: 54036 - DNA, 425 bp, Zea mays
  Clone ID: LIB3068-042-Q1-K1-E4
cgcaactgcgaagctccccccagttcccacggtttcccccacgacgccggcgatgggcaagcggggacagcgcggcggcggcgacggagaacccgccgcggaaggcggtgctggcggaggacacagcccctccaccgtgttcgtttccaacctcccctacaccttcaagtcctccgatctcgaggcggtgtttagcgaggtcggcccagtgcggcgctgctttatggtcgcggagaaagggtcggagaagagtcgaggcttcgggttcgtgcaatttgcaactgttcaagatgctgatcgagctcttcaacaaaagaatggatctcctgttgctggtaggaaaatcagagttaagctagcaatgaatcgtgctccactgaaggaacgtttgcaaaaggtgaacatgcaagtgaaggactctgatg

SEQ ID NO: 54037 - DNA, 399 bp, Zea mays
  unsure at all n locations
  Clone ID: LIB3068-042-Q1-K1-E5
cccacgcgtccgggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcatgagttcatgatcctnccaactggtgcctcctcgttcaaggaggccatgaagatgggagttgaggtgtaccacaacctgaagagcataatcaagaagaagtacggtcaggatgcgac

SEQ ID NO: 54038 - DNA, 482 bp, Zea mays
  Clone ID: LIB3068-042-Q1-K1-E6
acctgctccttctggacgtcaccccgctgtccctgggcctggagactgccggcggggtgatgacggtgctgatccctggcaacaccaccataccaacgaagaaggagcaggtgttctccacctactccgacaaccagccgggggtgctgatccaggtgtacgagggagagcgcgccaggaccaaggacaacaacctccttggcaagttcgagctgtccggcatcccgccggcgcctcgcggcgtgccccagatcaccgtgtgcttcgacatcgacgccaacggcattctgaacgtatcagcggaggacaagactacaggacagaagaacaagatcaccatcaccaacgacaaggggcggctgagcaaggaggagatcgagaagatggtgcatgacgctgagaagtacaaagctgatgacgaggagcatacgaagaaggtggacgccaaagactcgctggagaactacgcctacaacatgcgc

SEQ ID NO: 54039 - DNA, 467 bp, Zea mays
  Clone ID: LIB3068-042-Q1-K1-E8
gagcgtgtggcaccgctcggtggtgaactcggaccgggagcgcatgtccgtggcggggttcctgtgcccgtgcaaccaggtcgtgctcggccccgcgcggaagctcgtcaccgaggacaccctggccgtgtacaggaactacacgtacgacgagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgatccatatacatgattaaatgctttgaaagaaaaagaacaatagaaacacatgtattatggcactactagtgtttttaggaacaaggaaagaggggttgccccctgctggc

SEQ ID NO: 54040 - DNA, 381 bp, Zea mays
  Clone ID: LIB3068-042-Q1-K1-E9
cccacgcgtccgggagtggaagaccaagccgtactgccggaagcacgacaacttcgcgctcgcccgcgtcaaggagtggtctctgaagccgctcccctccggcgcggcgccgcagtgcacggtcaacagttcggccaccgcgttcgtgctgtccacgggcgggttcaccggcaacccgttccacgactacacggacgtgctcatcccggccttcatcacggcgcacccgctccgcggcgaggtccagttcctggtgagcagctacaagtcgtggtggatgaaccgctacatccagatcttccagcagatgagccggcacgaggtggtggacatcgacgcggacgacgaggtccggtgctaccgcagcgtggtggtgggggc

SEQ ID NO: 54041 - DNA, 253 bp, Zea mays
  Clone ID: LIB3068-042-Q1-K1-F10
tctcagactcgtggtctgactcgtgttctgactcgtttgaaaaaaaaaaaaaaaaaaaaaaaaaaaaagaaaaaaagaaaaaaaaaaaaaaaaaaaaaaaaaaaaaaaaaaaaaaaaaaaaaaaaaaaaaaaaaaaaaaaaaaaaaaaaaaaataaaaaaaaaaaaattataaaaaaaaaaaaattaataaaaataaaaaactaaataaaatataaaaaaatattaattaaataaaataataactaataaaaa

SEQ ID NO: 54042 - DNA, 299 bp, Zea mays
  Clone ID: LIB3068-042-Q1-K1-F11
taattccctgttctacccactcttcctaaaaaaaaaaaaaaaaaaaaaaaaaaaaaaaaattttaaaaaaaaaaaaaaaaaaaaaaaaaaaaatgaaaactttgcggtctataaatcggactctccttctctcttgctctcctcttttcttacctctttctttcttgtcaccttactttcatttaattctccttcattttacaacatttttcctttgttaaactcctttcttacccaaataaccctcctttcaccccttttaacttacttcctcttcatccatctctattaattccctc

SEQ ID NO: 54043 - DNA, 386 bp, Zea mays
  Clone ID: LIB3068-042-Q1-K1-F2
ctgcttgctctggggggaaggagagagagagagagcgagagagagatctagtagagaggctagggggtggtcgtcgaacgaagatgtgggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggtcacctcgcctactcccacaccaaccaggcgcttctccgccccaggtcgttcgcggccaatgacgaggtgttctgcctgttcgagggggtgctggacaacctgtgtcgtctgagccagcagcacgggctgtcaagcaagggcgcc

SEQ ID NO: 54044 - DNA, 229 bp, Zea mays
  unsure at all n locations
  Clone ID: LIB3068-042-Q1-K1-F4
tcgtgcacgcgtctcggattaactcttgaaacaacaacgtattaattatctcttgctataaaacaggtctggggttttatcgtttcttaccatttgcgtaactatgagtaatcgagaagcatatttcaagtcccaggcaantttcaataanttatctggtctctagacaccagaataataatagacatttattcctcatattatacacatataagttcaaattctcaat

SEQ ID NO: 54045 - DNA, 219 bp, Zea mays
  Clone ID: LIB3068-042-Q1-K1-F5
cccactcgtccggaacttgctgatagtgatgtattgcaaattaagaattgtttggattttgttagaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaatacaaaaaaaaaaataataaataaaacaaaacttaaataaaaaaacaagtaagttaat

SEQ ID NO: 54046 - DNA, 443 bp, Zea mays
  Clone ID: LIB3068-042-Q1-K1-F6
caggagaccttggcactgcaagatttgtcctgctttcgatgctctgcttggtgtactgatccgggtactattcctgcttcacgtgacttgtggattgttgagtatgttcaggttgttgagggcaatgttggagaaactatggctctagctacccaatcactattagtttttccgttgccttccgaccgaacgattctaattcacagtctggtcttcctatggattctgtgaatgacggtgatcaaagtaatggccactatggacatgccaatcagggattgtctcaggggcttggtgcatttgggggtgggagatcttgcccattcctgagggatgggcgtaattcatccttgggacgcgcatctagagaccgttcagggacttgccagccaccagttaccaaccaggggacagcttgccagatatcgtgcatcgttgacact

SEQ ID NO: 54047 - DNA, 231 bp, Zea mays
  unsure at all n locations
  Clone ID: LIB3068-042-Q1-K1-F7
cggacgcgtgggcggacgcgtggtcggacgcgtgggctgactcgtggtcgccaccgtgctactggaaagcgatgcctaccataccacactgctgtcagtctctggagcatttangtggtctggatcaatggaagggttgtgtcctagccagccggcaaagatgagctgctgatggtaatgatgatgactagaggccactgctaccctactacgtaccctcctctttgtgtg

SEQ ID NO: 54048 - DNA, 173 bp, Zea mays
  Clone ID: LIB3068-042-Q1-K1-G1
gctcctcgctcctgagcaccctttgccggcttgctacgaggactcctttctcgcgctttagggggtatctgccttgggcggtgacccctgtctgtctcgccatggctacatgcccctcatcaaactagccaactacagctccttctacaacatcgttcacaacttatccatga

SEQ ID NO: 54049 - DNA, 434 bp, Zea mays
  Clone ID: LIB3068-042-Q1-K1-D2
caactgtaatacgactgtactgaaatttctctctcctatgaatttgagatgctcgcctgccttctgattcaaggacttattacactaatggcacctcgcaatcatgttcctttgatcattttatgatatgatttatgatctgaaccacattaaacacctttctatttaacgcagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgtcagctctttcaccctgagcagctcatcagtggcaaggaggatgccgctaacaatttcgcccgtggccactacacaatttggcaggagaatgttgatctgtg

SEQ ID NO: 54050 - DNA, 470 bp, Zea mays
  unsure at all n locations
  Clone ID: LIB3068-042-Q1-K1-A8
cttgttccagaaaatagaaggtgtggaagtatgtctatttggaatgtatgttcaagaatttggtgctgaatgctctttcccgaaccagcgtcgtgtttatttgtcatacttggattctgttaagtacttcagacctgagattaaaacagtatctggagaagccttgcgtacatttgtgtatcatgaaattctgataggatatcttgaatactgtaaactgcggggattcacaagttgttacatatgggcttgtccacctttgaagggtgaagattacatcttatattgccatcctgagattcaaaagactccgaaatctgataaactgcgtgagtggtatctatctatgcttcggaaagcttctaaggaggaaattgttgttgagctcacaaatctatatgaccatttcttccttactatgggggaatgcaaggctaangtgactgcttctcgcttgccatatttcgatg

SEQ ID NO: 54051 - DNA, 350 bp, Zea mays
  Clone ID: LIB3068-042-Q1-K1-B3
gtgaaaaacacgcaaacaaggaagatactgaggatccagagccgaagaagagatcagatcctacggaggatccggagccaaagaaagagccaaagaagagaccagagcctactgagggggttcagcaaaagaagagaagtcaaaaacacgcaaacaaggaaaatgagttggtggtggaatgaatagacttcgtgagagatactgagatattcctgtcactaatggatgccaagagattggcgatgcttgtattctttgagaagaggtcatgttgacgcgtttggacatggtttctggaaacatccttgaaaggctgttgtttgcttcggttgatgacaatgggaaacctt

SEQ ID NO: 54052 - DNA, 427 bp, Zea mays
  Clone ID: LIB3068-042-Q1-K1-B4
cccacgcgtccgctcgagtgcgtgccccttctcttctctagttctcttctccgtcgcgtcagagagcagggagagaccagagcaaacaacaaccaccgcttgtttcatcaagaatcgtggaggagaaccgaaagttgagctttttccggcagggcatctgctagagccggccggttgaagcaggggagcgagaggaggagggcagccgaacaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgtcgtcgttctccaagtcgccggggtccctgctgctgctgtccaagtcgctcaccctctactgctgaaccgagccccc

SEQ ID NO: 54053 - DNA, 383 bp, Zea mays
  unsure at all n locations
  Clone ID: LIB3068-042-Q1-K1-B5
ccccatctcaattctcccacccggccgccggcaccacacgcgcgctccgggagccacaacgacggatggcgagggcgcgcctccctctcctcctcctcctcctcgtggcgttcctcgccggcacaggctccacggcggcccgacacgccgcgcccgcacccgcgtccgcgccccgggcgtcgccgtccatctccgcggcgcccgagtacggggcgccgctcccgcgccttccgaaccagcaccagcacccgcaccccttcgcgctggcgccgtcgcaggcgctggcgccggacataatgcccgtgctgccgtctncggccgaggacggcgccgcgccgcgccggccccggcgtcggcgctcctgctgctggctgtgccgtggc

SEQ ID NO: 54054 - DNA, 360 bp, Zea mays
  Clone ID: LIB3068-042-Q1-K1-B6
gtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggaccc

SEQ ID NO: 54055 - DNA, 495 bp, Zea mays
  unsure at all n locations
  Clone ID: LIB3068-042-Q1-K1-B8
cccacgcgtccgcccacgcgtccgcccacgcgttcgcccacgcgtccgcccacgcgtccgtgatgcacgacttcctgataatatcatggcatatgacaatgctgtttcggcgcttggaaaaatatgccaatttcatcgggatggtattgacgcagctcaggttgttccagcctggcttagctgcttgcctataaaagacgacaaggttgaagctaaagttgtacatggacagctttgctccatggtggagaggtcggatgctgaaattcttggtcctcacagtcagtatcttcctaaaattgtttcaatttttgcagaggttttgtgcaatggaacagaacttgccactgatgaaactagaaacaggatggtgaatgtcttgaggcgtttccagcagactttgcctnctgattntcttgcatcgacgttttccaacttgcaaccgcagcaacagctactgctacagtccatcttgtcgacatagttgttttttct

SEQ ID NO: 54056 - DNA, 441 bp, Zea mays
  Clone ID: LIB3068-042-Q1-K1-B9
ggccgccctgcgcatatgtcgcgcccacgaatctcgccatttgatccgatcgtagcatcgcgcggggttgttaaatcatgtggcatggttcttccggggatatatatgcgcaagccgggagggcctggctctacctgggcaaaacgccattaccaacgtgtaggcggtaagggagtagtggtcgccgccatcgggtgcttacacgaccgcttgcagtccgggtggaggtttgggagcttcgcgagcgcgataggaaagcatatcaaccctcaatttggcaaggaacgtcgtggtctggtggggattcttcaccggaattgggtggcagcgcggagctttcccaccccgtggaccagtttgggcacccccgcaaccccgacgagcaagtgaccgatgacccaggtgttcagcatgagaaaattgctaggcatgagctcgttg

SEQ ID NO: 54057 - DNA, 445 bp, Zea mays
  Clone ID: LIB3068-042-Q1-K1-C1
cgcacgcgtccgcggacgcgtgggagcgggagagggagaaggaggaagacgacctggaggcgtaccagattcggctggtgctagagatgagcgcgcgggacaatccggaggagatggagatggaggtcgccaagcagcttagtctgggcttctgccctccacatggatcccctgcggaggtcctcgcggtccgataccggaatttcaatgcccttggctatgacgacaaaatattggatggattttatgatctgttttatgttggaaatgggccagcagcagttactatgccctcttttgctgagctacgagtccggccattttcacataaagtcgattgggaagctgtgttggtccacagaggtgaagaccctgagcctatgaaacttcagcaggaggccttaatcatgaatcatgaacttcattcgagaacttcagaatctgt

SEQ ID NO: 54058 - DNA, 439 bp, Zea mays
  Clone ID: LIB3068-042-Q1-K1-C10
cccacgcgtccgcacacacacagacaagtggtttccaaagccaagtgtgtgtactagcaaccagcgggctcgggcggcagcaggcagccatcatgtcggaggagaagcaccaccacttcttcaaccaccacaagaaggacgaggagcagcccgtcggcgagtacgggtactccgagaccgaggtggtcaccgccaccggcgagggcgagtacgagaggtacaagaaggaggagaaggagcacaagcacaagcagcacctcggcgaggccggcgccatcgccgtcggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaagga

SEQ ID NO: 54059 - DNA, 419 bp, Zea mays
  Clone ID: LIB3068-042-Q1-K1-C11
cccacgcgttcgcgtacccatcatcataattcatacagatacagtgtagtactagtaggaaggagtggcatagatagaaccaaaacaggacaggaggatgaagaacggttcggcgcggttggttgacgccataaactctctctctctctctctctctctcgccttaaataaatgaacggccgaattggaacctactagcaataagtttcgtcagcgccgcgcgcgcacatgtgcagggtgccgtgcgagtacaagcacaggaacctgtcggtgagggtgcaggagaagaggcgctccccggggggccctggcgacctcgccatcaggtttctctaccatggcggccagaccgacatcgtcgccgtcgacgtcgcgcatgtcgggagtcgggttattgctgatacaacggagctttcttg

SEQ ID NO: 54060 - DNA, 208 bp, Zea mays
  Clone ID: LIB3068-042-Q1-K1-C5
agaggcccagagtttttcgttcttgttttgttttctgtagagagaattaccaacctcatctgtggattgcaattgcgctatgtaaatccccaagttgaaagttgtttccttatcttgagaagtataacaaggtatgctggctgcgtcgaaatatattacatacactgcagccatgatttgcgtgttgtatagtaatgcatcttaagct

SEQ ID NO: 54061 - DNA, 196 bp, Zea mays
  Clone ID: LIB3068-042-Q1-K1-C7
tcgcccacgcgtcctcccactcgtcctcccactcgttcgaaaaaaaaaaaaaaaaaaaagaaaaaaaagaaaaaaaaaaaaaagaaaaaaaaaaaaaaaaaaaaaaaaaaaaaaaaaacaaaaaaaacaaaaaataaaacaaaaattaatctacaataaactaaataaaatataaatcaatatacaaaaaaatcaa

SEQ ID NO: 54062 - DNA, 451 bp, Zea mays
  Clone ID: LIB3068-042-Q1-K1-C9
cccacgcgtccgcccacgcgtccgcccacgcgttcgctttcctttcctttcctgcagacaagctagaaatctcgcctagctcgtcgtcggagaccaaggagaagagcaagggggggcgcagaggcagaggcttgccagcctacctagctcgtcggggccctatggagatccagcaccaccgggggctgggcaactccaaggttgtcaaggtgcagagcgaggaggcgtgggatctgttcaccgatcaagcgagcaacgagggccggcccgttgttgcccatttcggggcgtcatggtgcgtgacgtccctgtccatgaactacaagtttgaggagctggcgcagacccaccccgaggtcttgttcctctacgtggacgtcgacgatgtccatagtgtttcatccaggtacggagtgaaggccatgccgacgttcttcctcatcaagagcaa

SEQ ID NO: 54063 - DNA, 298 bp, Zea mays
  Clone ID: LIB3068-042-Q1-K1-D1
taaaaaaaaaaaaaaaaaaaaaaaaaaaaaaaaaaaaaaaaaattcaaacaaaataaaaaaatacaaggttaatttgaaataaattaaaaggaattaaaaattacataaaattacataaattaaaattaacttaaccatattttaaaacatcttaaatcttcaaaaccctatcctttcccaacctaattacctttaaacccattatccttttaccaacttacttaataaccaataatccctcaaaaaatccaattttaaaaaatttttcaaccttaatttataattttaatcctcctt

SEQ ID NO: 54064 - DNA, 318 bp, Zea mays
  Clone ID: LIB3068-042-Q1-K1-D10
tcccactcgttctcccactcgttctcccactcgttctcccactcgtccgaaaaaaaaaaaaaaaaagagaaaattaaaaaaagaaaaaaaagaaaaaaaaaaaaaagacaaacaatctaaaggctccaattttaacatatcctgccttctacctcatagctccaatattatatcccttaatattaatcccctaacactaattttacaacctccttactacaaaaaccttaccgttaaaaaacttaatctccttaaataaaatcccttttttcccatcttgctttataccgatgaggtcctaaccaatagcccttccca

SEQ ID NO: 54065 - DNA, 465 bp, Zea mays
  unsure at all n locations
  Clone ID: LIB3068-042-Q1-K1-D12
cccacgcgtccgtagcacaagactttactactcaagctgctttatatactcatcaccaatacattgcagggttcatcatgacaggggcttttgctcatggagctatttttttcattagggattacaatccggaacagaatgaagataatgtattggcaagaatgttagaccataaggaagctatcatatctcatttaagttgggctagcctcttcctaggattccataccttgggcctttatgttcataacgacgttatgcttgcttttggtactccagaaaagcaaatcttgattgaacctatatttgcccaatggatacaatctgctcatggtaagacgacatatgggttcgatatactcttatcttcaacgaatggccccgctttcaatgcatgtcgaaacatatggtttgcccgatggttgaatgctgntaatgagaatagtaattcgcttttcttaacaa

SEQ ID NO: 54066 - DNA, 420 bp, Zea mays
  Clone ID: LIB3068-042-Q1-K1-A6
cccacgcgtccggaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttccttaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcaatcgtgttttgctaccgtacccaccccatgcatcatctgtcccgcgacgcaataatcatag

SEQ ID NO: 54067 - DNA, 261 bp, Zea mays
  Clone ID: LIB3068-041-Q1-K1-G1
acgcaacaagctgccccgcagcaacgaacacgaaccttggctgaacgaagctgaagtagttcgatgtgaaccgagtatggcaaacgcgccgaggatcctggccctcggcctgctagcgctcctgtgcgctgccgccggccctgccgtcgcgcagaactgcggctgccagcctaacttctgctgcagcaagttcggctactgcggcacgaccgacgcctactgcggcgacgggtgccaatcgggcccgtgccgctcgggcgg

SEQ ID NO: 54068 - DNA, 446 bp, Zea mays
  Clone ID: LIB3068-041-Q1-K1-G11
caaggacacaacatatgcttgatcagctcactgatcttcagaggagggagcaaatgctgggtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagaatgacagctgtgtttcagtcacatatatgatctagtctgtgtgtcaatgtgtcgaaaaacatgtctgtgattttg

SEQ ID NO: 54069 - DNA, 434 bp, Zea mays
  unsure at all n locations
  Clone ID: LIB3068-041-Q1-K1-G12
cccacgcgtccggaagaaaggcatagcagcgggcagcggcatgggcaccagcccgtcatgcctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccggcgactgccaagactgcgaagcgtcgccggccggcgacggcttcgtctgcggggactttatcttaagcctgaccgagcccccggtctgcacaccgaggccgtgggactgctgcgacagcgtggcctgcacaagggactacatncccaactgcatgtg

SEQ ID NO: 54070 - DNA, 441 bp, Zea mays
  unsure at all n locations
  Clone ID: LIB3068-041-Q1-K1-G2
actggctgtacaagctacatggccttgggcaggaattcaagtgtgagatatgtggaaaccatagctattgggggcgaagggcttatgagcgtcatttcaaggaatggcgtcatcagcatgggatgcgatgccttggcattcccaatactaagaatttcaatgaaattacatccatcgaggaggcgaaagcgctctgggagaaaattcaagcacgacaaggggtgaacaagtggcggccagacctagaagaagagtatgaagatcaggaaggcaacatctacaacaagaagacctacactgacctgcagcgtcaaagcctgatctagggctcctgctggttaaagttgtcgggatttgttcagaacttatctcatgtagttgtaactctgaaaatattggcccatctggcatacattntatgtaataagatgatttttccgg

SEQ ID NO: 54071 - DNA, 242 bp, Zea mays
  Clone ID: LIB3068-041-Q1-K1-G3
cccacgcgtccgagcccaccgaattccctgcgattcctctcccctcgcctcctcgtctccccctaggggagcgtcggagaggaatcgcaaagagggccgtctcatccgagttaaggaagccatggagcacaaggaggctgggtgccaggcccccgagggacccatcctctgcatcaataactggggcttcttcggcagcgcggcgaccatgaacatgtgctctaagtgccacaaggagatga

SEQ ID NO: 54072 - DNA, 365 bp, Zea mays
  Clone ID: LIB3068-041-Q1-K1-G4
ctactcgtacgcccacgcgtacgtttacgccttcttccacgcgttcggtcaagcgttccgtcacgccttccaaaggggccagggccaaaccggacccggccaactacaaccctttagccaaagcttccgacacccaagccaaccccggcgtcgaccaccctttttcccaagcctccgacgcccaagccgaccccgccgacgtaaactccaagccccaagccttcacacacgcgatgcccaagccgaacccaccgacgtacacccctttcccaaagccttcgacgcccaagccgtccccaccgacgtacaccccttccccaaagtctatcacacccaagccgaccccaacgacgtacactcccaca

SEQ ID NO: 54073 - DNA, 273 bp, Zea mays
  Clone ID: LIB3068-041-Q1-K1-G5
aaaagatgaacaacggggagatgcatctccaaacaatggttgggctgtacaaacatgatttatcgcggtcagctcgacgcccagggcctgatattggcactcctgctcaattcattcaccaaactgttggcatatcattgaatttgcttataaacgtggggaaacataacttgcctgggaagtggtggctgtcagcctgcgatcgtgaactgtaacttatcgaaaatgcaacggagtttgggactctactatatgatttgtttcagtttttct

SEQ ID NO: 54074 - DNA, 390 bp, Zea mays
  Clone ID: LIB3068-041-Q1-K1-G8
cccacgcgtccgagaactagagcttcggaaacttgaagtggcagtacaggccattcatgagaacttgatatacctcaaagaaaaggaagcagagatgcgaactgtgagtgagacaacaaattcaagggtcgtctggttcagtactctgtcgctatgggtctgcattgcggtatcggttttgcaagtccgacaccttcaagggttcttcagaaagaagaagctcatttagagtctctctgtaagatgttgcgctgtggttcagatgttgttcaccttggaagggtacaattttgccttttacatggaacatttcacaccagtgatgactgatgggctacttgtactgtatgtaatttaagtacgattggatcgaaaatctatatttcaggg

SEQ ID NO: 54075 - DNA, 410 bp, Zea mays
  Clone ID: LIB3068-041-Q1-K1-G9
cccacgcgtccgaaaaaaaaaaaaaaaatttataaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgccctttttaaagttcccaattttacttccccttccttccaaatttaaattttttttttagggtcccctaattaaaattaattgcccttttttttaaaacttttaaatttgaaaaaccttggttttcccaaatttaaacccttttaaaaatttcccctttttcccactttggttaataccaaaaagccccccaccattccccttttcaaaaaatttcccacctttaatggaaattggaacccccct

SEQ ID NO: 54076 - DNA, 421 bp, Zea mays
  Clone ID: LIB3068-041-Q1-K1-H10
gatccaccgccaccaccaccaccaagcactccagtcccgcagcagcatggccggcagcgcgtgccgcctcgccatcctcttggtgctcctggcggcgtcaccgctgcttggcgcgacgcataaggccgcgccagggccggcgtcgtcgtcgggctcgggcgcgggcgcggcggacgcggcgccgccgacggacgtgaacaaggcgctgaaagacgagcagttcagcgagttccggcagctggtgcacgacacgcgcgtggacacgcaaatcaacgcgcaactgacggacagctacaacgggctgaccatcatggcgcccaccaacgcgcgcttcgacaagatgaaagccggcgtgctgaacgggctggcgccgcaggagcagatccagatggggctctactgcgtgctggcccgggtctac

SEQ ID NO: 54077 - DNA, 255 bp, Zea mays
  Clone ID: LIB3068-041-Q1-K1-H3
agaacacgtacattcttttcctggagattgctagcgctaatttatggtgttgaatcaaataatcggaatgttgacgaggagctgcttcgatgagtggacaaggattgtgactgctcgatacactcggttcttgtgatcatgtcttatgcagacctgtgaactgtggtgtttctgacaactatgccgtgcctgtaattatctactatgttccgagagaaacggttatgtatggcttatttgcgcttactttgcttt

SEQ ID NO: 54078 - DNA, 400 bp, Zea mays
  Clone ID: LIB3068-041-Q1-K1-H4
cgacgtcacgcgtccgcacacgttttctgacggctgacctgattgggatcactcacgctacctaatggatttgacgcgattggtctgtattttaaccgtatttaagccttgattatataatctaaaaggttaaccaaccagggcaggttaatcatgtgattctataaccatttgacccattttttacagaatgacagtggaattaagcaaaagatttaaacaatgtaatgacttgctgaggactgaagtattaaagttgtgtcaagacaacaattttcaaacaggtttttttgaaggcactgataatagcactgttgttgatgcttacgagttgaatgtaaatctaaatgtacactctgtactaactacgtgtacacattaattgaacctatcgagcaat

SEQ ID NO: 54079 - DNA, 301 bp, Zea mays
  unsure at all n locations
  Clone ID: LIB3068-041-Q1-K1-H6
cccacgcgtccgcccacgcgtccgcatgaaattcggcaacgggcgctacctcaagacgggggcgtacggccactttggaagggacgaccctgacttcacctgggaggtggtgaagccactcaagtcggagaaaccttctgcctaaggcggccttttttttcagtaagaagcttttggtggtctgctgtgcttaatcatgcttttatatggcttctacatgttgtggttctttcttgatctgcaccgcgcttatcgantgtgttgtactgccctaataattggtgcttatgatgactgtttc

SEQ ID NO: 54080 - DNA, 368 bp, Zea mays
  Clone ID: LIB3068-041-Q1-K1-H7
tgacattgtaaatgttgatgtaactgtatactataaaggtgttcatggtgatttgaatgagacggattttgttggaaatgttgatgaagcttccaaacaccttgtacgttgtacctatgagtgcttggagaaagctattgcgatagttaaacctggagttcggttccgagaggtcggagaagtcataaacagacatgtttcaatgtcaggtttatctgtggtgaaatcttattgtggccatggcataggggaactgtttcactgtgccccaaacattcctcattattcaagaaacaaggccgttggtatcatgaaagctgggcagacatttacaattgaaccaatggtcaatgcaagggtttggaatg

SEQ ID NO: 54081 - DNA, 452 bp, Zea mays
  Clone ID: LIB3068-041-Q1-K1-H8
gacggctgacctgattgggagcacgccgctgccgttggagttgacgccccggcctggagccaccgtcatcgaggggggattgccgcgttcgccgccgctcgcggttacggttggcctcgcactcgctagtcgctactgatggttccaagagcaaaggcccatgttgtttgggatccagtaggcccaatcaagccgttgactccgaggagagccgctgccgatgtcctcgcctcttgccgacaccttcacccactcccagcaggccaggccagcacacattggcgcttctcgccggagaagggtgggcggaggatgccctgcctggcccctgccaattgacggccacatggcttcttctagcagttgcaggcaagtagataaacctaccacgacgagcaaacgcagatctgtagcctagtacctcgtcttcactacttctcgttcggggtggt

SEQ ID NO: 54082 - DNA, 335 bp, Zea mays
  Clone ID: LIB3068-042-Q1-K1-A11
cctcccctatccattggtggcctattctttctagttctatgactattctactgccattgatcttcatctgtatcatcatctgcaatatcatctttcctccctctcctctctctactagtccctctccttctacccctccaactcctaccttctcgatgttcatgatgagcttcttgctgctattaatgattcctaagaaggtcttctccatttgaagctctctatgctacttaatcaagtatattatatctttccatataatgaatcaatatcccaatcaccctaattttctattgactcattatatccctattaattttatccatacccacttt

SEQ ID NO: 54083 - DNA, 238 bp, Zea mays
  Clone ID: LIB3068-042-Q1-K1-A3
ttcgtgttgccgacttcgtttgcctacatggttccattggccagaggctgttcagcttgcacacgctgatgcgggtatgagtgcgagcgagcgtggactgaattcggacctcatgagtccaagggccgtcggcggctcaccgcatacactgcgatgtgcggtgctcttcagagagctgaaccctacttactgatgaaccgattccaaggttgacgggccgttaatcacagatgataac

SEQ ID NO: 54084 - DNA, 176 bp, Zea mays
  Clone ID: LIB3068-041-Q1-K1-F9
taaaaaaaaaaaaaaaaaaaaaaaaaaaatttttaaaaaaaaaaaaaaaaaaaaaaaacaagcaaaatttataaaaaaaaaaattaaataaacataaaatacaaaaaaataacatattctttaatatcaacctaaattctattcactctcctactttaaacaacattctctatttc

SEQ ID NO: 54085 - DNA, 159 bp, Zea mays
  Clone ID: LIB3068-042-Q1-K1-A4
tccacgcgttcgaccacttctttttccactctttcttccaggctttcgtgcactcttccgttcgggcgttcggccactcgttctttcactcttcctcccacgcgttcaaccactcgtacgtcacgcttactctatatctcgagcagcctttctataagt

SEQ ID NO: 54086 - DNA, 288 bp, Zea mays
  Clone ID: LIB3068-042-Q1-K1-A5
ttcctggttcgacccagcgcgtacgcacgcgttagcgcattcgttcggtcaggtgcaatcttgcggggcgcagatcttcagattgcttacgggctacaggtataattgcgtgacactcatttgactgattctaagctcggaagtgcaaatgttcttggagctatcacatgatctacagactgatcctgtagcttgatactgcgtatactgttctttacagatgcatcgtatgcaatgcggcaggaccatctgcagagttcagaactcattcatgagcgacaacacgaa

SEQ ID NO: 54087 - DNA, 354 bp, Zea mays
  unsure at all n locations
  Clone ID: LIB3068-041-Q1-K1-D4
gcgccacccacccacccactcgcttcagccgcctccgtcgcgcgtaccaagcaagtggagacaggatgccggctggccacggcctgcgctcgcggacgcgcgacctcttcgcgcgcccctttcgcaagaagggctacatcccgctcaccacctacctncgcacctacaagatcggcgattacgtcgatgtcaaagtgaacggcgccgtccacaaggggatgccgcacaagttctaccacggccgcaccggtcgcgtctggaacgtcaccaagcgcgccatcggcgtcgaggtcaacaagcaagtcaatgggcgcatcatcaggaagcgtatccatgtccgtgtggagcatgtgc

SEQ ID NO: 54088 - DNA, 60 bp, Zea mays
  Clone ID: LIB3068-041-Q1-K1-D8
cccacgcgtccgcccacgcgtccgcccacgcgttcgcccacgcgtccgcccacgcgtccg

SEQ ID NO: 54089 - DNA, 445 bp, Zea mays
  Clone ID: LIB3068-041-Q1-K1-D9
cccacgcgtccggcgggaagatgatgatgacgcgggcaccgatggggccgatggagggcgcggcggtggacgagatggtgcgccgcctcgtggagggcggccgaggcgggcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaagcaaacagagcctggagactatatgcttgctgctggcgtacaaaatccggtaccccgaaaatattttcctgttgaggggtaaccacgaggatgcaaagatcaacagagtctatggttttta

SEQ ID NO: 54090 - DNA, 441 bp, Zea mays
  Clone ID: LIB3068-041-Q1-K1-E11
cccacgcgtccggagaaattgcgtgaactctttgctgagtatggcaatattacttcctgcaaggttatgcgggattcgaatggtgtcagcagaggttctggatttgttgctttcaaatctgctgaagatgctaaccgagctcttacggagatgaatggcaaaatggttggaagcaagcccctttatgtagctcttgcgcagcgtaaagaagacagaaaggcaaagctacaggcacaattttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactttatgatg

SEQ ID NO: 54091 - DNA, 348 bp, Zea mays
  Clone ID: LIB3068-041-Q1-K1-E2
tcgcccacgcgtccgaccaacccacacagcctgactaggggtctaccggcggcggcaacgagatggtgcagggcctgacctaccgaaagcgtcacagctacgcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaggtccaggttgtctaggaaccacaggactgttaaccgtccttatggtggagtactctcttgaatagctgttagggagagaattatccgtgctttct

SEQ ID NO: 54092 - DNA, 437 bp, Zea mays
  unsure at all n locations
  Clone ID: LIB3068-041-Q1-K1-E5
cccacgcgtccggagagatcatcgatcgatcgacgaccatggcgaggcaacgacaagttgcttgcatgcttgcagctgctctgctcgttgcaacgacgtttgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcggccctactaccccgncgtcggcattaagtacgtcgcggtgggcaacgaggtgcanggcgaccacacgcgc

SEQ ID NO: 54093 - DNA, 282 bp, Zea mays
  unsure at all n locations
  Clone ID: LIB3068-041-Q1-K1-E6
gggtgttgatggcgtcaacggcgtactcgcggccatccaagccgccagggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcgtcgtccatggtgttgaagaacatgccgncagcaacgacgacggtgccgggtacagctacaggggcgc

SEQ ID NO: 54094 - DNA, 211 bp, Zea mays
  Clone ID: LIB3068-041-Q1-K1-E7
aaaaaaaaaaaaaaaaaaaaaaaaaaataaaattcaaacaaaaaaaaaaaaaaaaaaaagggaaagcaaaaataaaccaatattagagaatccaaaccaaaataatccaacatataaaatcttatcatctctactatttccccctactgcaatgcactgaccaacttcttacaatttgtccacttgttaaacctctactttacccaactta

SEQ ID NO: 54095 - DNA, 443 bp, Zea mays
  Clone ID: LIB3068-041-Q1-K1-E9
cccacgcgtccgagcccaccgaattcccttctattcctctcccctcgcctcctcgtctgcgccggacgggatcgtcagagaggaatcgcaaagagggccagctcatccgagttaaggaagccatggagcacaaggaggctgcgtgccacgcccccgagggacccatcctctgcatcaataactgtggcttcttcggcagcgcggcgaccatgaacatgtgctctaagtgccacaaggagatgattacgaatcaggatcaggccaagctggctgcctcctctatcgacagcattgtgaacggcagcgacaccgtcatggagccggatgttgctggcagcaacactgtagtagctgttgcccaagtcgcactgcgaacaatgaacgtgcatcaacccgctgatgttgcccgacccagctagggggtggcggctatctacaaaggg

SEQ ID NO: 54096 - DNA, 424 bp, Zea mays
  Clone ID: LIB3068-041-Q1-K1-F10
cagccaccctcctcccttcgaagtgtgaaccggctgcaccctcacacttgttttgctccgggacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataagttgtattctagtatgttgaaagctcatggtgccgtgctgtatcaataaagtgttatgcgcatagagtggctcaagaccaaggctgcgtttgcgctttgccactggcttgggtgtatggttcttctgctgctatgccattagggtttaaggattgtgtgtggatggcgtcgtgcttgtagtgttaactggatttgaagcggactacat

SEQ ID NO: 54097 - DNA, 435 bp, Zea mays
  Clone ID: LIB3068-041-Q1-K1-F11
cggacgcgtgggaaaccattgttggacgcgttcccctcctgcacgcaacctcatctcgtgctgcagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatca

SEQ ID NO: 54098 - DNA, 381 bp, Zea mays
  Clone ID: LIB3068-041-Q1-K1-F12
cccacgcgtccggagaaattgcgtgaactctttgctgagtatggcaatattacttcctggagggttatgcgggattcgaagggtgtcagcagaggttctggatttgttgctctcaaatctgctgaagatgctaaccgagctcttacggagatgaatggcaaaatggttggaagcaagcccctttatgtagctcttgcgcagcgtaaagaagacagaaaggcaaaactacaagcacaattttcacaaatgcgtcctgttgcaatggcgccttcaataagtcctcgcatgcccatgtttccacctggtgtccctggaattggtcagcaacttgtctatggtcaatcaccaccagcctttatcaacccttatgcttgatttgct

SEQ ID NO: 54099 - DNA, 170 bp, Zea mays
  Clone ID: LIB3068-041-Q1-K1-F3
ggcctgtcttctgccatcccggccgtataatttactagtgtgttcgtcctatatgtttagcagcggcaggtgtattgtgcgggtatgtaatggtattgcaactatattgggtgtaaaaccataataaatgtgggcaaatatgcaaggaaaaatactggatttctagcaag

SEQ ID NO: 54100 - DNA, 381 bp, Zea mays
  Clone ID: LIB3068-041-Q1-K1-F4
gtgtttctgttggagaggtgatgaagagccctgtgttcagtgaggatgagtcatcggagaactgcttctgggttgatttgggacagagtccacttggttcaaaccattcagagcaatcaagcaagggaaaattgggctctccattgccagcatcctggttttctggcaggaagagtgctcagaaagcgtcacccaaagtgccattcaaactgtcaaggagtcctattcatgataaccatgttatgtcatttgatgcaaccgtgaagtctgtatcacaagagcccaggcccgataaaggggatctggatgaagataattcacatattaacatcaagaatactcctatcagcgagattgaagaagataataaagatgctaaag

SEQ ID NO: 54101 - DNA, 331 bp, Zea mays
  Clone ID: LIB3068-041-Q1-K1-F5
attgttggacgcgttccgctcctgcatgcaacctcatctcgtcctacagatcctggatggccgggctccttgataccttgcctcacgagtgctctcggtgagctactttgtttcgatttatcaggaaatccgtttgcttcatgttatgcacgctcagatctgattgctggattcggcatcttacgggcttgaatagagctaggactgggagaaaacaacaaacccgcgttggatcctgtatcggttagtccatgccttcaaggttcatgtatgtctgtattggtggtcgagcatcgcatgttctgcttatggttccagatctggagaaatt

SEQ ID NO: 54102 - DNA, 393 bp, Zea mays
  unsure at all n locations
  Clone ID: LIB3068-041-Q1-K1-D2
ggcgaatcctgtactgtaatagccccgcgctgaactttgtgcatagtgtccgtcttcctgtgtgtattgattttttgatggattggtaagataattcatttggctccggcggctgctgctttctgctgtacacaagtccagagtcttatattgcgctgccttcagatgtacatggaccaaaaagaagtggtcgatgccctcttccaccactcgaagatagagccctgcattactgaacttgtttggcgacaacttgagcatcaaaatcctctggttttcaaggcgtattatatgaggctaatgcttaagactcanataatggtcttcaacaagcttcttcaggatcagtttgaggttatcaataaagaattttcttcagggatcccttctatg

SEQ ID NO: 54103 - DNA, 317 bp, Zea mays
  Clone ID: LIB3068-041-Q1-K1-F7
gccacgcttccgacgcttgagctgacgctgggtcagcacgtatatggtcagggccggtccgtccagcttgggagaatatatcggctatgtcaaggatgcgatatggtgatgcagtaaaacttatgtaatgcttgaggatgcttcaaatgggttttctagtgctggaacttaccatttcaagtctgaccctgtccaatgcacccgcaaagtgaggtcgacgtgcagctagacttgacacactttctgcttttctagcttatttgtgtgctttggtttcttctatttcaagagaccgaagcctaaatcaactgaacacc

SEQ ID NO: 54104 - DNA, 454 bp, Zea mays
  Clone ID: LIB3068-041-Q1-K1-F8
cccacgcgtccgcccacgcgtccgctcacacagcaaataccccacaaggccactccaaagaccgagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcatcggcgagttcctcggccgcggcgtcacctgccagcttatcagctccaccgtcgtcgaccctaacaacggcaaccgcgggaagttgggcgcggaggcgagcctggagcagtggctgctgaacccgccgtcgcttctgtccagcgagaaccagttccgcgtcaccttcgactgggaagtggagaagcagggcatcccgggcgccatcatcgtcaagaacaaccacgc

SEQ ID NO: 54105 - DNA, 379 bp, Zea mays
  unsure at all n locations
  Clone ID: LIB3068-041-Q1-K1-A9
ccaattgtcacttgctctccctccaacaagctaattaaggccggtccatccctcttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgncacaagatcgaagaggaagtcgcggcgg

SEQ ID NO: 54106 - DNA, 160 bp, Zea mays
  Clone ID: LIB3068-041-Q1-K1-B1
aaaaaaaaaaaagaaaaaaaaaaaaaaaaaaaatgacaatcgataatacaatgatacaagctcaaagactcgggcatccaacatcctaggtcttacatactgtaacgtaaaaccaaatcactgttcagtgacctacaatatacaaactggtaacaaccat

SEQ ID NO: 54107 - DNA, 424 bp, Zea mays
  Clone ID: LIB3068-041-Q1-K1-B10
atcatcaccaatggaagatacaagagtttagttcatcgagctgttgtcaatgctgagcgggcgggcttatcagtagcaacagtttatgatccatcaaaatcaaggaaaatatgcactgccccgcagcttgtgagtgagaatgaaccacaaaagtatcgggatgtaatttatggtgactatgtctcatcttggtatagcaaaggtccagagggcaagcgaaacatcgatgccctcctgattcagcactagagccataagtatgccttaaaacaaggttgggccactcattctgttcctaaacttctaaagcatgtacaatatatcaagtttcaactctaaacaatcatgattaggaaaccaacttgtatactggatgcagtgcaataaagtaccttttcattgtcaaaaaataaaaactatattt

SEQ ID NO: 54108 - DNA, 350 bp, Zea mays
  Clone ID: LIB3068-041-Q1-K1-B2
aaattggaagaggctgaaaagatgataataaggctaagagaagagagcagaaataccacccaggagcgggatgagctacagcaagaaatggtattcctaagaaagaagggaaccgcaaggagtcaaatgggtttccccctgctctttgtggtgtacgtggcgcttcttggtacctgtatcgggtacctgctccgcatatgagttccaaacttcaaaaaagttcagcagatgggatatgcttcgtatgtgggcaagacaattgaacggcagatgcactccaaaatgttgaggggtgaatatattagcattattagttccgaacttcatatggttttgcacataacagcagt

SEQ ID NO: 54109 - DNA, 117 bp, Zea mays
  Clone ID: LIB3068-041-Q1-K1-B3
gtccaacatcaagcccctgtggtggcaacaccatcttcgccaggagctggctcgtcctcgcagggtgggaaagctgaggtgagcactggacaagtccagcaacagttccagcaactt

SEQ ID NO: 54110 - DNA, 64 bp, Zea mays
  Clone ID: LIB3068-041-Q1-K1-B4
aaaaaaaaaaaatgccttgtggtggcaacaccttctatttcagttaactctctataactaacaa

SEQ ID NO: 54111 - DNA, 168 bp, Zea mays
  Clone ID: LIB3068-041-Q1-K1-B5
aaaaaaaaaaaaaaaaaaaaaaaaaaaaaaaaaaaaaaaaaaaaaaaaaaaaaaaaaaagaaaaaaaaaaaaaaaaaaaaaaagaaaaaaaaaaaaaaaaaaaaaaaaaaaaaaaaaaaaaaaaacgaaaaacataaaaaaaaaaaaaggctagaatgcactagcatt

SEQ ID NO: 54112 - DNA, 435 bp, Zea mays
  Clone ID: LIB3068-041-Q1-K1-B8
atagggtctaatacatgaggtatttaccaaagttcttcgtggtctatctggtgctaaagtcacagggccaggttctttcagaagttgccaagatggatatgcagttaaatcatctctcaaagctgaagatggactgttgtatccacttgaaaagggtttctttttcctgccaaagccacctacactcattcttcatgaggagattgagtttgttgagtttgaacgtcatggtgctgggggtgccagtatatcatctcactattttgacctccttgtcaaactgaaaaatgaccaagagcatctcttcagaaacattcaaaggaatgaataccacaacctcttcaatttcatcaatggaaagaacattaaaataatgaaccttggaagagatggtcaaggtgcaagtggtgtagttacagatgttctaccagacac

SEQ ID NO: 54113 - DNA, 365 bp, Zea mays
  unsure at all n locations
  Clone ID: LIB3068-041-Q1-K1-C1
cccacgcgtccgccgacgcgtgcgcttacaccgtgtgcaacttcaccgataacggcatgttcggagatggctgcctcaccagctactgctatgaccggctctcctgcaacgggtccgtgggcgccccgccggccacgctagtcgaggtgagcctgcacgaggacgccgcgaaggggagctcctacgacgtgagcctggtggacgggtacaacctccccgtggccgtctccgccaagccagccacgggcggcgcggactcgaacaagtgcgccatcgccggctgcgccaagaacgtgaacgcggtgtgcccgccgggactgcaagtgaccgctaccggcagcggcngcggcaagacggtggtggcg

SEQ ID NO: 54114 - DNA, 428 bp, Zea mays
  Clone ID: LIB3068-041-Q1-K1-C11
catgccaaaaatgagcagtgggatgaagagaatcttcatagggatgacgaggagtacgcgtctgatggtgcaggaggtgactatgaggacaatctccatagcccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaagtggtggtttcaaaagagtctacttgcaccaagagggagttcctggctcaagaaggggctcaattgtttcactttccggtggtggcgatgttcttgagggtagtgagtttgtacatgctgctgcttt

SEQ ID NO: 54115 - DNA, 337 bp, Zea mays
  Clone ID: LIB3068-041-Q1-K1-C2
agcatttgaaatctggactcgggggtggggttgcatgttccctgagggtgattcatcgagggagctacgagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttcatttgagctcgggggagtccgctagtcttatttttcttgatttctcttggctttctggaaccatacgaatcaataagaaatgagct

SEQ ID NO: 54116 - DNA, 387 bp, Zea mays
  unsure at all n locations
  Clone ID: LIB3068-041-Q1-K1-C3
cgtttgcgtggcagagaacgacgcgtgcgagcgagacggtggtgcggtggagagatcgaaggtgaggagtggtggttggccggtccatgggatcctgaagaaggggatccacggcctggaatcactcaagctcaggtcgtagctggtggttttcgtttggcggngctctggcgatcatgtttagagttcagtggcagtgtagtcatgcttattagtggttagcttgtgtgtgagttgtttgcgattcatctctgtgtctgtgtgtgccgagttggttggtttgcaatttttgtcatgtgtgtaaagccttgcacgccgagcaatgctcgatggtgtgaatgtatatacagaattactatttggttcaattcaagataaatagtactc

SEQ ID NO: 54117 - DNA, 352 bp, Zea mays
  unsure at all n locations
  Clone ID: LIB3068-041-Q1-K1-C4
cgagaacggcgtcctgtgggaggtcgagggaaagtgggtcacccaaggtcctgttgatgtggacattggtgccaatccatccgccgagggtggtgaggacgaaagcgttgatgacacagctgtgaaagtggttgatattgttgacacattccgtctacaggagcaacctncttttgacaagaaatcatttgtgtcttacatcaaaaaatacatcaagaatctcactgctgtgttggagccagagaaagcggatgagttcaaaaagggtgtcgagggtgcaaccaagtttctccttagcaagcttgaggaccttcaatttttttgtggtgagtccatgaaggatgatgcgtct

SEQ ID NO: 54118 - DNA, 271 bp, Zea mays
  Clone ID: LIB3068-041-Q1-K1-C6
cgcacgcgtgggcggacgcgtgggcggacgcgtgggcgccgacgtcgagaagcgggggaaggaggtggtttgtgtgggctttgtggatgtgtaattggtgctgatgccattgtggctgaaagagagcggacgaagagcgttttggtgtctacgtgtgtatacgctgccggctgtgggatcacgagggagaggggtttcctactatatacatgtgtaaaaatttgtttcatgtaatcttgtatctgagtgaccagatcaggtgattatgcag

SEQ ID NO: 54119 - DNA, 149 bp, Zea mays
  Clone ID: LIB3068-041-Q1-K1-C7
ctcttcctaaaaaaaaaaaaaaaaaaaaaaaaaaataaaattaaaaaaaaaaaaaaaaaaaaaaaaaaaaaaagaaaaaattaaaaaaaaaaaaaaaaaaaaaaaaaaataaataaattttaaaaattattcaatctaacaaatacaaa

SEQ ID NO: 54120 - DNA, 345 bp, Zea mays
  Clone ID: LIB3068-041-Q1-K1-A8
atatttagcaatttatagactaaaaaggaataaaataaagggactaaacattagtctctagaaagcaaacactccctaaaaatactaaatctttagatttagttaaaagttcaccatatttgcacccttacaacaaatgtttatacatcacgaagtcaagtgcacacctctcaaatttgctctataccactgcacgacgctcatctcgggacaggcaacaacgcatcatctcccagcagcacaaacagtgtcaacagaacggaacagcccaactgctgttcgccctcccggcccctgcccctgcccagtgatctgctgcccccgagccagccagtactgatccgg

SEQ ID NO: 54121 - DNA, 400 bp, Zea mays
  Clone ID: LIB3068-041-Q1-K1-C8
cgagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaagtggaggagccagctgccccggcggagaccgagccagctgccgtcgctgagcccgaggcggcccccgtggcggctgatgaagagacgccaaaggaagaagagacggcaaaggaagcggagccggagccggaaccggcgg

SEQ ID NO: 54122 - DNA, 436 bp, Zea mays
  Clone ID: LIB3068-041-Q1-K1-D10
cccacgcgtccgcccacgcgttcgcccactcgttcgcccacgcgtccggagaaaaagagctacttcgcgcgtagaatggaacggttgcgcagtactaaaatatggaggcttctattgtacccatcctactaggaaattatgagccagttgatgaggcatgaattatttcacgacttggccgcggttagtgtgaaaaggcgacgctgctatatatggtcatcacccttggtttgtccggtcgccagatatcacgattatcatatttatcggttgtaatataagcttcttgtattagcatatggtttaatattttttttcaaatgggatgaagtcctgcgtgatatcctatctgtaaataggaaggcactagcagatcttgaccaatgtacaactggttttttttttgagaaacttggaataagaattattggtcacc

SEQ ID NO: 54123 - DNA, 424 bp, Zea mays
  Clone ID: LIB3068-041-Q1-K1-D12
gctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcagtcgcagcggcagcggctattgtggcgggcgccgtgacggcggttattgcggcggtggc

SEQ ID NO: 54124 - DNA, 458 bp, Zea mays
  Clone ID: LIB3068-043-Q1-K1-G6
cacgtcttcaccttcggcacgatccgggactgccggttcctgtgcctgttccggttcaagctgtggtggatgacgcagcggatgggcgtctccggccgcgacgtccctctggagacccagttcatgctcgtcgaggtccctgccagtgacggcggcggcgacgacgcccccgcgtacgtggtgatgcttccgctgctggaggggcagtttcgggcggcgctgcaggggaacgaccgcgacgagctgcagatctgcatcgagagcggggacaaggcggtgcagacggaccaggccgcgcacatggtgtaccttcacgccggcgacaaccccttcgacaccgtcaccgccgccgtcaaggcggtggagaagcacctgcagacgttccaccaccgcgacaagaagaagctgccgtcgttcctcgactggtttcgctggtgcacctgggacgccttctacac

SEQ ID NO: 54125 - DNA, 421 bp, Zea mays
  Clone ID: LIB3068-043-Q1-K1-G7
gcttcacaccgacacacattcttaatcattgcaacaagataaccaacccatatcactcagctgagttggatacccagcgcatgggcgtgttcgactaacgtgcctctggacaccagctcatgctcgtcgacgtccctgccagacacggcggccgcgacgacgcctccgcctacgtggggatgcttgcgctgctgcaggcgcagtttcaggcggcgctgcaagggaacgaccgctacgagctgcagatctgcatcgagagcggagacaacgctgtgcatacggaccaggccgtgcacatggtgtaccttcacgccggcgacaaccccttcgacaccgtcaccgtcgccgtcaaggcggtggagaagcacctgcatacgttccaccatcgttgacaagaataaactgccgtcgttccttgact

SEQ ID NO: 54126 - DNA, 392 bp, Zea mays
  Clone ID: LIB3068-043-Q1-K1-G9
cactcgtccgcccacgcgtccggttcttgggctgtctgacttcaacctgtcgcggggccttttgttcctgaccaaggctaggaagtacaccttcttcaagcccaagttcatcttctacgccacctacctgtccgagaagatcgggtactggaggtacatcaccatcttcaggcacctcaaggctaacccggaataccaggtgtaccccatcttcaagtacttcgagaactgttgccaggacgagaacaggcactgcgacttcttctctgccctgctcaaagctcaatcgcagttcctaaatgactggaatgccaagctctggtcacggatcttctgcctcttggtgtatgtgaccatgtacctgaatgactgccaacgcactgcattctatg

SEQ ID NO: 54127 - DNA, 239 bp, Zea mays
  Clone ID: LIB3068-043-Q1-K1-H10
ccgagacttccgaaaccttcacgcgctcgtacgagggagttgcaaactgcccggcggcggacgacgactagaccgatgatgccccctacaacgctgccgaatcagcggggggccatatccgatcaagcgaggacaccaccagagaccgaccggatcccgaccgcgctggctgagatcggtgggcggttcatgagctatgatctgcctgatcacatattacgaccgccgattttgggttc

SEQ ID NO: 54128 - DNA, 421 bp, Zea mays
  Clone ID: LIB3068-043-Q1-K1-H12
cccacgcgtccgatttataataccatgattgagtgctgcaaatggctgccatgctggaagtcagctagtgctttgctgtctttgatgcttcgagatggtttcaatcctacggttgtgacttttacatcactcctgaaggttgtattagaaaatgataattttgaaggggctctggatctgcttgatatatgcaagattgaaggacttcagcctggcatacagactttcaacacagtactcttacgtgcatatgctagaagtcaaattcatgtccttgaatatattttggagtgtatacatcgatcaaaaatccaacctgatccatcaacactttggtacacgttttgtgcctacgaggagcatgaactgtacaatactgcaattgagtcactgctagttcttaacatgagaatgatatctg

SEQ ID NO: 54129 - DNA, 132 bp, Zea mays
  Clone ID: LIB3068-043-Q1-K1-H2
tcgttgggaagggagcttcgaggcgggccggcgcggttcgttggccgggcgggctgaaccaatggcacgggcccttggggccccaacgccctaacctgggtcggggccggccgccaacaaaagccccggttg

SEQ ID NO: 54130 - DNA, 428 bp, Zea mays
  Clone ID: LIB3068-043-Q1-K1-H4
cagtcaccaaaccaaaccgctctcgagtctccatccattctctccgctcatccgcagctctctagtctccagctctagctagccttagcctcgtccaagggacgaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtcccgccagccggcgccgctccccgccgaggtcgccgcgctctacgacgccgtcttcgagcagttcgacgccgaccacagcggcgccgtcgaccgcgccgagttccacgacgagatgcgccgcatcatgc

SEQ ID NO: 54131 - DNA, 454 bp, Zea mays
  unsure at all n locations
  Clone ID: LIB3068-043-Q1-K1-H5
cccacgcgtccggccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcaagcatctccccggatgtcattcagatgcttctgcggcatgtcaccaccgtcaagaactgangagtgctgttcccgaactatgctcgcagacttgtaccgtcgatctatttaatttttgtcaagagtgagagtggtgaggaat

SEQ ID NO: 54132 - DNA, 396 bp, Zea mays
  Clone ID: LIB3068-043-Q1-K1-H6
cacacgcgtaaatgcgcgatacagagcaccaatttagggatggacacaaacagacacggagagagaatccattcagaagctggctgcggagcaagaggctcagcaaatagagaatgccgctagagctgccaagtcagcgaggctcaggcaagcaaaagaggaggctgagcgggaaatagccgaataccgtgcccagatggaggctgagtttcagaggaaggttgcagagagcagcggcgactccagtgcaaacgtcaagcgtctcgaggaagaaacggcggcgaagatcgagcaactcacccagcaagccgcaagcatcttcccggatgtcatgcacatgcttctgcggcatgtcaccaccgtcaagaactgaagagtgctgttcccgaactatgc

SEQ ID NO: 54133 - DNA, 53 bp, Zea mays
  Clone ID: LIB3068-043-Q1-K1-H7
cccacgcgtccgcccacgcgtccgcccacgcgttcgctagttctagatcgcga

SEQ ID NO: 54134 - DNA, 331 bp, Zea mays
  Clone ID: LIB3068-044-Q1-K1-A10
gcaaggggcgcacagttgacttcaaaaacacactattgatcatgacatctaatgtgggaaggagtgtcattgagaaaggaggccgcaagatcgggtttgaccttgactatgatgagaaagacaccagctataacaggatcaagagcctggtgaccgaggagttgaagcagtatttccggccagagttcttgaacagattggatgagatgattgtattccggcagctgactaaattggaagtgaaagagattgctgacattatgctgaaaagagtgtttgacaggctgaaggccaaagagattaatctccaggtcacggagaagttccgaga

SEQ ID NO: 54135 - DNA, 457 bp, Zea mays
  Clone ID: LIB3068-044-Q1-K1-A11
cccacgcgtccgcccacgcgtccgcttcactgtttgggatgttggtggccaggacaagatgaggcccctgtggaggcactactttcagaacacacagggacttatttttgttgtagacagcaacgacagggaacgtgttgttgaggctagagatgagctccacaggatgctgattgaggatgacctgcgacactctgctctgtttgtattcgaacacacacaatatttccaaagctctgaaaatgctgctaaaatctactgacaatctgggtctgcattctgtgaaacaggcactctgctacatgcagagctcttgtacaacatgtgaaaaagggtattatgaggttcactagtgtttttccagcaacatctccagcaagtcttgaagcttttcggcagggctactagcgagaggatgtctgaacaacttatggctgctttttttatacatattatt

SEQ ID NO: 54136 - DNA, 457 bp, Zea mays
  Clone ID: LIB3068-044-Q1-K1-A12
cccacgcgtgcgtctacccctccaatctattttttgccattgttctctccacaaccagaccgtaccattgcagacgcactcagcctacaatacactcctactcatttattccgtacacagcaacgacgcataacgtataatgcaagctccatatcacctacactggatactcaataatgataagctgactgactctcttctcctactatctccatacacacaacatcttcctaatgctatgaatgctgctaacattactgacaagcttgatctgcattccctgcgacagcggcactgctacatgcagagcactcgtgctacatctggtgaagggttgtattacgggcttgactggctttccagcaacatctacagctagtcttgaagctcttctgcaggacttctagcgagaggatgtctgaacaacttatggctgcttatttattacatattatta

SEQ ID NO: 54137 - DNA, 256 bp, Zea mays
  unsure at all n locations
  Clone ID: LIB3068-044-Q1-K1-A2
cccacagcgggcgaccacgcgtgcgccaacgcgggcggcaacgcggccgacgaaaaaaaggggaaggaaagcaacaagagcaacggggccgcccgaacanaggagcaaagccaaggcacacgaaaacgcgacgcacggaggaggccaaacgggcaaggaaaaaaaagcgcaacgccgaagaaagacaacacaaggagagggaaaaccacggcggcacccaagagagagagcgggggacgcgcaacaaaaagcacaa

SEQ ID NO: 54138 - DNA, 157 bp, Zea mays
  unsure at all n locations
  Clone ID: LIB3068-044-Q1-K1-A3
gcgnggcgnggaccggaaggaccgcaactcananggnagccgccgnggaaangangaaggaaaggcaaggggaacgnacgcaaacaccangancgngaacaagcncnngaacggagaaccnggacccaagaccacgcaggggccgaccggggagaag

SEQ ID NO: 54139 - DNA, 312 bp, Zea mays
  unsure at all n locations
  Clone ID: LIB3068-044-Q1-K1-A4
cggacgcgngggcggacgcgngggcgcagcagggccaanancnngcnaggngcnnnaacgagaggaaggangcngaagaaaacccngaangcccaanccgcancaggggagaaggccgccancgcgnccgccccnncagggaccggcagcggggccaanncgccccacnaggaggggagcaaacagcngcacagcngcccggggaccggaacnccannggccacagcncccagaggcgcnggnaccccgngnacgcaaccaaacaaancagcnggcgcacgaggaagcaggnggnaacagaccggacacgcc

SEQ ID NO: 54140 - DNA, 419 bp, Zea mays
  Clone ID: LIB3068-043-Q1-K1-G5
taaaaaaaaaaaaaaaaaaaaaaaaaaaaattaatataaaaaaaaaaaaaaaaaataaaaaaagggaaggatttattaaaaatacatgattacttttatattaatttataattatttaatttaatatttttattatatttctttttaattcttatttttttttttatcatccttttttcttaccttattttttttcctgtataataattattaatttttcttattatttttctattatatatttattattttttctttttacaatttttttatttttttttttttttaatattatttttctatttttttattattattttcttttttttttattttttatttttattttttcttttttattttttttatttttttattatttttttcttttttttttattatttatttttttttattta

SEQ ID NO: 54141 - DNA, 197 bp, Zea mays
  unsure at all n locations
  Clone ID: LIB3068-044-Q1-K1-A5
gaagcccaagacccacagccccgnccncgccaagaaaggcanggacaaggagcggcagcgggacgcgcnggncacgcangagcnnggacngcaggacancaacaaggccggcgaccggcnccggcaggggaaaagacngcgcngcagccncngganggacaaggacaagnaacggaaggagaggggcggccggacca

SEQ ID NO: 54142 - DNA, 404 bp, Zea mays
  Clone ID: LIB3068-044-Q1-K1-A6
cccacgcgtccgttcccatatatatgaaactaaaatgaaccctcctcggctaagggggaatcagatatagaagaagcggaagcaggaagctgaaggatatccgtagcgaatgaggaataggacatgcatgtgagctagcgaaaagggaatagcacattctctagggttcgtatcaagcgctagcaaatggagagggtcaatcgaatccgtatcctcgagcgctgggtctgtcctctaatgaggagctccttgcttttttgatccgtgaatccggatctgtaccttcatctgaaaactattcgccggttgtccgcattcctctcctcgagcgaaaggtgttcccacgcaatcgctatcgctgttcctacgacgtagtcaatacgcattggaataatggcatcccc

SEQ ID NO: 54143 - DNA, 206 bp, Zea mays
  Clone ID: LIB3068-043-Q1-K1-D9
gcgcccacgcgtccgctcacccttggccgtcttcgacgagcgccaccacggtaggatgacggggcttaggaaccacaatatcaagacgtttacctgcaagacgatcgtgaaggaccttagctcgtacaataaggtatgttccaaggacgctgccaagactcccgacttgataaagtatgccgctgatacctactacctgttacagc

SEQ ID NO: 54144 - DNA, 327 bp, Zea mays
  Clone ID: LIB3068-043-Q1-K1-E11
ggtacctatatgtcttaggagcctatattttacgtcacctttgatcatactagtcgggagggtctacatcagaatatgcgaacaccaggttgacttgtactatgtggtttaagatgatgatgcgtgattgtcaacgggtagcatctcatgtcgagttgtatattgatcaacgcgtgagttattcgttcgtgcaaccctggcggttaacttgtaatgtgtaagtttcgagcacaatgatagcgatctatggttgatgtgaaggccattcagtctcgtgctaattgactatgatcgcacaaggactaattctagttcttgaatgattga

SEQ ID NO: 54145 - DNA, 369 bp, Zea mays
  Clone ID: LIB3068-043-Q1-K1-E3
cccaggcggcccatcgtagccgtgctcgatcttcttcgctccgcagcacaccactcgtagccgggggcagggcgactgacctctttcctgctgccgagcgccatcgtcttcctagaccatctcacctcagagctgctgcgaccgtcggcaacccgtctaggtcttgtccctgccgctttctgagcctagaacatctttgcattttggagagtctccactcggagctattgtacagtctccatccctttcaacgagatggcacgtcagtctgctctctcgcttgtgagggatcgagcaaagactggagcgctgaaacgtctgactctgagttcatcgaagacggctgggaggaactcgtctgggcgcatc

SEQ ID NO: 54146 - DNA, 419 bp, Zea mays
  unsure at all n locations
  Clone ID: LIB3068-043-Q1-K1-E4
atatgcttccacctagaataactgccaaaatattggagctggaaactgtaacacagtctgagggctgtagggagcgctatcgggttttgagtcacttctcattaacaactacatttcagttctgtgaaattgacttgagtgatgtagtgtcttctaactcactggctccattcttggatgaaatcaagaagcgtgagaaacaaagaaaacgagccgccaagaaggaagaaagtgagagagtgaaggcggaagttgctgctgctgttcaggcatcagctatgcgatttgagtatacaaattcctctcaaagtcacaacgatgtcatgttctctctggatgactttgaagccctgngaaacaancgctggccgtncaccagtccaccagcgagtgaaaggaagctttctctgatgtaacac

SEQ ID NO: 54147 - DNA, 360 bp, Zea mays
  Clone ID: LIB3068-043-Q1-K1-E5
cccacgcgtccgaccacgcgtccgtttcgttcctggaggaatagcttcgcatcatattgctgcgggtactttgggcatattagcgggcctattgcatctaagtgtccgtccgtctcaacgtctatacacagggttacgtatgggcaatattgaaactgtcctttcaatagtatcgctgctgttctttttgctgctttcgtaattgccggaactattttggatggaacagcaactaccctaatcgaattatttgggcctactcgttatcaatgggatcagggatactttcagcaagtaatatatcgaagagttaacgattggttagccgcaaatcttaatttattagaaacttggtctaaa

SEQ ID NO: 54148 - DNA, 404 bp, Zea mays
  Clone ID: LIB3068-043-Q1-K1-E6
cccacgcgtccgaccacgcgtaagatccatgcctgtaggaatagattgccataacaacggttggggtcctttcaccttattagcatgcttatcgcacctaaacgacctaccgtgtacaagtctatacaaatgattacgcatggtcactatgtatgcttacctgctcactggcatcgctgatgtccttagaccaaagaccaaaaccgtctgcaactattctagacgacacactaccatagcctgatgaacatcatttgagcaaccgctagatcatagagatgctctgatacagacaccaagtattagatctactagacaagtcatgtatagtagtacatcgtagttaatgacaaccttgatctcaacttcctataaaaacaatctgtcatgattatatgtgacat

SEQ ID NO: 54149 - DNA, 151 bp, Zea mays
  Clone ID: LIB3068-043-Q1-K1-E8
tcccacgcgtccgtccatccttgtccatactccttacctgacaatgtcttcctcccatatgggccgttccatttttaatcttggaatcactattacattcaatactcatttcttttcacattcaatacataatattacgttataaactatt

SEQ ID NO: 54150 - DNA, 69 bp, Zea mays
  Clone ID: LIB3068-043-Q1-K1-E9
caggacgtatatttttactgaaatgtttctccgaaaaaaaaaaaaaaaaaaaaaaagaggaggaatttt

SEQ ID NO: 54151 - DNA, 477 bp, Zea mays
  Clone ID: LIB3068-043-Q1-K1-F1
acgcgcacgcgtacggaaaacctcgcgcgggggatgctcgagaggaatcgcggtggccggatgagcaggggccggtggaggtggcgcgcgcggtggccgtccgagatggagtacatatcccctgagagaaaattggaggggacttgtggagatcctgggccgttattgccgaccaaggtggcagcttgttggaccacttgggttatcaagggggaggaattccacaacatgagtcttcaacactggatcatggacttttggttgatccagctggtgcaattccgtatttatctacagattctacgcccttcatgaatgatcaaatcacttgcaatgttataaaatctgcttcagctagtccagaatcttgtacaaaacaaccttaagaacctcttaatgtagaatctgatgtacagaatgacgcaactgaacaaaatgttcacaatagtaactttgaaagaaccaaggtgtaatttt

SEQ ID NO: 54152 - DNA, 438 bp, Zea mays
  Clone ID: LIB3068-043-Q1-K1-F10
ccgagctctccaaaaccctaacgcgccagttctggggcgtcgccaacttcctcgcgccagcgcccggggagacgttgccgtcaccctcgcactctccccaatcagcggggggtcaatccgccgatgcgaggacaccacccgagatcgccgggatccggaacgacttcgctgagatcggtgggaggttcagaagcgggatctcccggatctcaggtcacaaggccgtctctgggttctctaagatggcctctagtttcttcgctcctgatgacggccaggaggacgagtgggaagaggagcggatacgacagattaagcatgagatgggagaagaggcggtatggcacgaggaggctgatggcgactaggagtggcatcagtgggaggagagggtaagacttagggtggaagatggcgatacaaggcatgagttggaga

SEQ ID NO: 54153 - DNA, 408 bp, Zea mays
  Clone ID: LIB3068-043-Q1-K1-F11
ggcttctcctccccctcttaccaagtccttttcgggttagggttacttagggttttgtggaggggcgatggcggcggctgatgtggagtaccgttgcttcgtcggcgggcttgcctgggccaccagcaacgagtcgctggagaatgccttcgccttctacggcgagatcctcgactccaaggtcatcaccgaccgggagacggggaggtctcgcggcttcggcttcgttaccttctccttcgagaactccatgctcgacgctatcgagaacatgaacggcaaggagctcgacggccgtaacatcaccgttaaccaggcccagtcccgtggcggtggctgtggctgctgtggctacggcggctgtcgcggcggctgcggctattgttgccggcgccgtgacggcggtta

SEQ ID NO: 54154 - DNA, 323 bp, Zea mays
  unsure at all n locations
  Clone ID: LIB3068-043-Q1-K1-F2
gtcacaccttcgccacctctagaaatctcggtcgcgatatcgcctattcatcccggcaccgacatgatcgcccccaacctcgcgaacgagatcccatatgagaggcttaccaattgattctgcgcgcctcgggcccggggaggcgatggcacggtgctgggcgacctgccggagaactgcgtcgtggatgtgctgctcaagctggacccgctggagatctgctggatggcgcggctcagccgcacgttccacgacgccgcgtnctgggacggtgtctgggagtccaagctgctgacgaactacgtgccgcctctcgccgtcgc

SEQ ID NO: 54155 - DNA, 226 bp, Zea mays
  Clone ID: LIB3068-043-Q1-K1-F3
tttccggtcgacgccacgcgttcgccacgcgttcgctacgcgttcgccacgcgttcgctacgcgttcgccacgcgttcgtccacgcgtgcgccacgcgttcgatttaagaaacaacaatcgaaacttaaattaccattgctgatggtttattcgaaagactcaaactcatatataaagtaaagtaatccaatttggattcttgtgtttgttataagaaaaataaaa

SEQ ID NO: 54156 - DNA, 466 bp, Zea mays
  Clone ID: LIB3068-043-Q1-K1-F5
cccacgcgtccgaccatgcaaaatatccatgcctgcgagaactggctgccaagacgggtgatgagcgcctggcgcatcggcgggatacttcacgccctggaagggtggaccgtgcacgagtgtggggacgccatggtgcatgctgagaaagcatggtcagctgctattaggcacggattcgttcctttgacgaaagcctgaaagcctgtacgcaactctagacgccattcgacgatggctggaaaactacgtttcagcaatcggtagcacaaattctccccagctacagaagccgactatatggtctgcttgacgagtcgtccagggaggcacggcgtgatgaatggcgaccttgattccaacagcatatagtaactatatatatagttatgttgtggcattgtatgatgcaagtgcgagaaactgctttgtggctgtgtgggtgacatatacaaattttaaattt

SEQ ID NO: 54157 - DNA, 397 bp, Zea mays
  Clone ID: LIB3068-043-Q1-K1-F6
cgacgcgctcgccaaggacctaatctcgatgtacctcataccgcagttcaagatcgactggagggtgcgttgcacggtcggcagctgcttgtcgcgccactaccacatgttcttcacctgcgcggcttacttcatcagcttgcgcaccaagtacggctacctgctctctggcaccgcacactggctcaggctacagaccaccacgtactgcccaattgtggactagactctaccaagcgagaagtacttcaccgccgaaaccggccgaactacacgtgctctgctacagacgcgccgtctatgtacgccacaactagtcatgtagcatactgcaaagcggtaacaaatgaactgatacacaagttggtataaaaactatatgaacaagtgtgaggtg

SEQ ID NO: 54158 - DNA, 443 bp, Zea mays
  Clone ID: LIB3068-043-Q1-K1-F7
aaaaacgctcgaaacggtacctaaacacaaagcatctaataactagcacatcaagatcgacagaagggggccttgcaaagtcgtcagctgcttgtcgcgccactaccacatgttcttcacctgcccggcttacttcatcagcttcctcaccagctatggctacctgctctctggcatcgcacacggcctcaggttccagaccaccacgtactgcccgattgtggactacactctagcgagcgagaggtccatcaccgccgaaaccgcccgacctccacgtgctctgctacagccgcgccgtctatgtacgccacaccttgtcatgtcgcatactgcatagcggtaactgatgaactgatacacaagttggaataaaaagaatatgaacaagtgtgatgtgatatagtgatggttaaccagtgtatcactgtgattacatatat

SEQ ID NO: 54159 - DNA, 156 bp, Zea mays
  Clone ID: LIB3068-043-Q1-K1-F8
cggacgcgtgggctagttctagatcgcgagcgtgtgccctatctgttttttttttctatggttgggactcaggagaaatcgggggatgcttgtcgctctgctacgacataccgtgcaccagcgtgggtacctcattgagcttgctcaccaagtatg

SEQ ID NO: 54160 - DNA, 348 bp, Zea mays
  Clone ID: LIB3068-043-Q1-K1-F9
gacccactcctccgttcaagagcttcctaaatgaaacttttattttgatatatgccaaaaaaaaaaaaaaggaagattttaaaaaaaaagaaagacaaaaaaaaaaaaaaaaaaataaaaaaaaaaaaaaaaaaaaaaaaaaaaaaaaaaaaaaaaaatgcctaccatatctaaataatccaaacttacttaccccttctttcaaacttcatacctctccaataatttcccctaaatccaatttattcacctccatttaacaccaatctaacttttaaaaccttacctttacctaatttaatacatctccacaaaatccccttttccccaactttttttaaaccaaaa

SEQ ID NO: 54161 - DNA, 410 bp, Zea mays
  Clone ID: LIB3068-043-Q1-K1-D7
acaaaagctccaattatacttcaacaacagagtttccgtagagatacccagtcacgatggtaaggatgacctatacgtcaaagtatacgtaacagtagactactaccttcactgccaacagagttcgatggagatccaggtatctggctaatcaactactcttagagaggtcaatctagaactgaactaggaagaaattgctgacatgctcagaagactggacacactatatatatatagcatctaccttgagcatagcaacctcacgctcaagaattgcgacgtatgactcatgttgatacaggaaattccttgcaatctgtgagaactgcaagcaaatgctattgccaaaatatacaatgcactataatgtgtattataatcatttttttcgaaacttatttgtgcaa

SEQ ID NO: 54162 - DNA, 252 bp, Zea mays
  Clone ID: LIB3068-043-Q1-K1-G11
cgacggcttcctatacctgagatccttcttacggaaccaactgacactacttacaggaggtgaccgtccagactcatacgtccacctaaaactctcagcaaccataagaccattaattgaatacagggactacactgactgatgagctcgttgtgtccagagatcattccttaagaactataacatagcgatatcctatgataccaaggattacacatgcacgtaacgagacaaaagcgatcatgcggaaaa

SEQ ID NO: 54163 - DNA, 456 bp, Zea mays
  unsure at all n locations
  Clone ID: LIB3068-043-Q1-K1-B2
cccacgcgtncgatgccatcatgttatctggcgaaactgctcatgggaagtatccactaaaggcagtcaaggtgatgcacactgtggcactcagaacagaatccagcctttataacccaactacttctcctagtcttgttgcatctgcacagggtctacagaatgaggacttctccgcaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccaaggcgtcatccctattcacatgcagttctctgacgacgcagaagaaactttcttcagagcaattagcagcttgctgaaagcacaatatgtgaaga

SEQ ID NO: 54164 - DNA, 446 bp, Zea mays
  Clone ID: LIB3068-043-Q1-K1-B5
cggacgcgtgggtttggatttctggagaaaaggaaggtttttagttcgaaccggctccaagttggtatcttataaagcgggaatgacccgtttatcgaaatcgtggagaacatggaatacccctgaattgacctttgtgtcaccaattgctgttgttggtggacagaagatctccctcattcttaaaggccgcaatctatctattcctggcacacagatccattgtacaagtacaggaaagtacatatccaaagaagttctgtgctcagcatatccaggtaccatatatgatgattcaggtgtggagacttttgacttgccaggacaaccagattttattcttgggcgctgctttattgaggtggaaaacaggttcaggggtaacagcttccctgttattgttgcaagttcaagtgtttgccaggagttgagaagtctagaagtgg

SEQ ID NO: 54165 - DNA, 457 bp, Zea mays
  Clone ID: LIB3068-043-Q1-K1-B7
cccacgcgtccgttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggccgggg

SEQ ID NO: 54166 - DNA, 345 bp, Zea mays
  Clone ID: LIB3068-043-Q1-K1-B8
cccacgcgtccgttggcttctcctcccactccgtatcgggttcgggttcgcgaggttctgcggtgtatcatttcaagggtgagcggatcgagatggcaacgtctgatgtagagtaccgatgcttcatcagcggactctcctgggccacggacgaccactccctccacaactccttcagcacctacggcgaggtcctcgagtccaagatcatactcaatcgcgagacgcataggtaccacagcttatgctacgtcaccttctccactgaggaggcgatgctgaacgccatcaagggcatgaactgcaaagagctggacggccgtaacatcaccgtcaactaggccc

SEQ ID NO: 54167 - DNA, 331 bp, Zea mays
  Clone ID: LIB3068-043-Q1-K1-C1
acgcccacgcgtccggagccaaagctagctagctcctctcggtgcacgatcgagttacgagtacgagcacacgtggcctttcctaccgttgccaacaagcaacagagccaagaaatcagtcgcgctagagcgagcaaggacgatgctgggatgcttctcgcggctgctgctgccgacgacagctgcgccggagcccatgccggcggcgtccgacgacgcgttcacgtcgacggcctcggcggcgggctccacctcgtcgtgctcgtggtcgtcctcggcgcgctgcaaggacgactaggaccactgcagctgcacggaggtcaaggacccg

SEQ ID NO: 54168 - DNA, 354 bp, Zea mays
  Clone ID: LIB3068-043-Q1-K1-C10
cccgatcagcagctgatcgctcactcttgcagctcgatcattctttagctgctctagctggagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgtcgccgaggccaaggtggaggagccagctgccccggcggagaccgagccagctgccgccgctgagcccgaggcggcccccgtggcggcggatgaagagacgccaaaggaggaagagacggc

SEQ ID NO: 54169 - DNA, 460 bp, Zea mays
  unsure at all n locations
  Clone ID: LIB3068-043-Q1-K1-C2
gcgnccacgccgtcggccacgccgtccggtttgaatattccttcctgcttgattggaaatcccaacttggagggcttcaaaccttaatatccaacaatctataataacttgtggctagctgaaaatggcatgaagatgcacggttataatggcagccaactttgggatacagctttcacagttcaagccattgtggctaccaaccttattgaagagtttggtcctacccttaaactagcacacaactatatcaagaattcacaggttcttgatgactgccctggtgatctgaatgactggtaccgccacacatctaaaggtgcatggccattctcaactgctgatcatggttggcctatatctgattgcactgcttaaagactaaaggcctcattattgttatcaaagatctcttccaaaatttgtggtgaacccattgaagcctatagattttatgatg

SEQ ID NO: 54170 - DNA, 251 bp, Zea mays
  Clone ID: LIB3068-043-Q1-K1-C3
tcccgtcacccacctccgcggaccgtcgtcacccattcgtcagtactcccttttagctgacatatcaaatccagggtggctgatactcctaaccttacctgtcaaatactatccactggtattgcttccacaagatcctgattgctacatgtttagcttatccatagagcctacacaccttagcctctttccatgtcatgcttcatgtaagtgaccttgaacattctatcaatttttatgataatgcccta

SEQ ID NO: 54171 - DNA, 454 bp, Zea mays
  Clone ID: LIB3068-043-Q1-K1-C6
aggccatcgacgaggtactcgaggaacgccgcagcgaccagctcgcggcgatgctcaagacagcggtgtggtgcttgacgtcgccggagaagcacttcgcggaggtgatccggaggtccatcgtcgggctcggtacggacgaggaatccctgacgagggtgatcgtttcgcgcgccgagatcgacatgaagaaggtgaaggaggagtacaaggtcaggtaccgcacgacggttaccagcgacgtcaacggcgacacttccggatactacaattccatcttgctcactctagtcggccctgagtgaatgagcatggccacgagtgatccttgttggctcaagttgagaccgtagtgcaagctcatcaaagaaggaggtgtggccaatttgacatctacaactatagaaggcactaaagctttaacttttctagtcattgttgattgtaccaaaaa

SEQ ID NO: 54172 - DNA, 145 bp, Zea mays
  Clone ID: LIB3068-043-Q1-K1-C8
cccacgcgtccgcctacgcttgggcacgtccattttacaagcgcttggtcataatcatccgagcgtggatattctagctagctacgggcatatattttgctgtgtatatctgtatgtgtatcgacggtctcatcacctacctcta

SEQ ID NO: 54173 - DNA, 274 bp, Zea mays
  Clone ID: LIB3068-043-Q1-K1-C9
attgatgcgctcgtgaggcttaccggaattactgcagagggccaaggtgtgaatgggggagtccttaacaggttcttgagcctaaactccagatgttgctgaagcacaagctacagctgctgatgaggaagacaattatgatgttgacctccatgttcaggagactcaacatgagcacaaagctgctgaagatcgtactgcaacgtccaatgcttctatcacgataacagaatctttaatgtcatgagatttacttgatgtgaatccatatgac

SEQ ID NO: 54174 - DNA, 204 bp, Zea mays
  Clone ID: LIB3068-043-Q1-K1-D1
aaaaaaaaaacgcatacacatacacaaaaacatttacatttatatataaatttaaaacatcaaacgggaagggctaaacaaaagttcgagtaagaaaaaaaaaggggcggccactttatagagacaaaatttaccacctctttaattatatcccatatctctactgtggtgttacctaatttaaattaactgaccttgatctaa

SEQ ID NO: 54175 - DNA, 388 bp, Zea mays
  Clone ID: LIB3068-043-Q1-K1-D11
tcggcaccacacaaccaatgccggctgtcccttgcacgcgcaccagcaccaccacgacccatggccgacaccggcaacccgccgaccaagcccaccaaagcctccgcccccttcgtcgtaattgacgccgtcagcgccaacaaggcccgcgacggtggcgccgatgccccgacaccgtcggcggggcacggccgccgctggctgcagcgggcgtgctgcggcgtagccatcgccggcgcgctggccgcggctgcggtgctgtcgctgtcgctcaccgtgctcagggtgcgggacccgacgctgtccatggagtccgtggccgtcaggcgcttcagcgtgcgcctggacgccgcgttcccggcgcgcccgctgcggatcaacgtcacgc

SEQ ID NO: 54176 - DNA, 414 bp, Zea mays
  Clone ID: LIB3068-043-Q1-K1-D12
gaaaatcttttcgccaatcggatatttgtccttttcgatgtcaagaaaaggggtgtcatggattttggtgactttgtccgagctctaaatgtgtttcatccaaatatcccaatggaagaaaaagtcgatttctcgttcaagctatacgatatggatggcacagggtttattgaacgaaaggaggttaagcagatgttaattgctctcctaggagaatcagaaatgaggctatctgatgagatcattgagacaatcctggataagacattttcagatgctgatgcaaatcaagatggaaaaatagatagaacagagtgggagaattttgtcacaagaaatccttccttgatgaagataatgactctgccatacctcaaggacattacaacaacattccctagctttgtgtttaac

SEQ ID NO: 54177 - DNA, 167 bp, Zea mays
  Clone ID: LIB3068-043-Q1-K1-D3
caataaataacaaccatcttcacaaacattctaccacctagctacttatatgccataactaaacttaactgacaaatcttatacgtcaactgaactatatgatgatctctgccatcctccccaacgttaccctgctattgctctaaacgttatacctctcctccatt

SEQ ID NO: 54178 - DNA, 440 bp, Zea mays
  Clone ID: LIB3068-043-Q1-K1-B12
cccacgcgtccgcaactgcaaagcagcatgctctactcttcttctgtactgaacgtgtgagtagataacaacaagcgtgaaccatggcggacgagtacggccgcagcggctacggcaggtccggcgccggcgacgactacgacagcggctacaacagcaagtccggcactgatgactacggccgtggcgaaagtggctacaacaagtcgggcggcgatgacgactacggccgcagcggcggcgatgggtacggcaggtccggcggcgacgactacggccgtggcaccggcggcggtggctacaacaagtccggcggcggaaacgactacggccgcaacggcggcgacgactacggtcgtggcaccggctgccgcgggtacaacaagtccggaaacgacggctacgacagcgggtacaacagatcgggcaccaccaacgac

SEQ ID NO: 54179 - DNA, 453 bp, Zea mays
  unsure at all n locations
  Clone ID: LIB3068-043-Q1-K1-D5
cggacgcgtgggcggacgcgtgggcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtaggaccgccgccaagccgccttcgttctccgtctcccagcagcaggccggtgccgccaccttcaagaccgacgccgccatccctgacgccgtcggccggaccgtcgtctgtgacgtgcacggagccctgctgcgctcctncgcgctcttcccctactt

SEQ ID NO: 54180 - DNA, 116 bp, Zea mays
  Clone ID: LIB3068-043-Q1-K1-D6
cgaacgcctccgctcatacttgggcgcacagtttttagtaatgcttttcaggaacgaaagtaggggtcgtttaaaggtcttaagatgcatatcactcctctacaacattctctaca

SEQ ID NO: 54181 - DNA, 305 bp, Zea mays
  Clone ID: LIB3068-003-Q1-K1-F5
acgtccactcgtccgatttattatatcacaaacattgatgctatcataatgatttaggttactgtgactcttgacgtatttgttgttacttttatggcaaccaatgaggcatctacttatgacagactggagtatttttgttagctcaaaaagactggtttctggtgacacatttattttcttgagtgtgacatcattacatgttaaagttgtcttgtacgttacatttatttcctggctttactaaatttttggatcaaccttctaactgttcttcatctaattgatgtgagaacaaatagctg

SEQ ID NO: 54182 - DNA, 329 bp, Zea mays
  Clone ID: LIB3068-003-Q1-K1-F6
aaaaaaaaaaaaaaaaaaaaaattaaaaattaaaaaaaaaaaaaaaaaaaaaaaggaaaaggaaaaaataaaaaaaaaaaaaaaaaaaaaaaaaaaaaaaaaaaaaaaaaaaaaaaaaaaaaaaaaaaaaaaaaagggccgccctttttaaaggttccaattttcctaccccttcctttcaatctaatacctttttttttattgcccccaaatttaattcctttgcccttttttttaaaacttttaacctgaaaaaccctttcctttccccaactaattcccttttaataaaatccccttttccccatttggcttattatcctaaaagc

SEQ ID NO: 54183 - DNA, 328 bp, Zea mays
  Clone ID: LIB3068-003-Q1-K1-F7
ggtcgacgacgcgtccggtaaaggtgctatccagtttttcatgaattattatgtcaaagcgctggaaacttatcaaggtggcctgaagcatgacccgaaaaaccaggagttacttgatggtgtaaggaggtgtgttgaacagatcaacaaggcgagcataggctaactcagtgaggaggaactgaaagagagacagaacatagccatgcaagaccctgagatccagaacatactgactgatccgatcatgcatcaagttttgactgatctgcatgagaacccttgggctgtgcaggcgcaccttaataaccccgtagtgatgcattat

SEQ ID NO: 54184 - DNA, 341 bp, Zea mays
  unsure at all n locations
  Clone ID: LIB3068-003-Q1-K1-F8
aagtggttcgagtgtgtgagtcatcgcctgtcgtggactccgaaatgaatggtgatatctatgctctgagcggggtcgaagcccagagtgaaacctttctggtggatggctttctgaagcgatacctgatcgtgcaatatcnngttcgtctgactttgggtatagtgggcgaaaggaactaatcgaatccatctagtatgctggttcccttccgaagttttctcctcagggatagtctggagctcctacactgagttctattcgggtataagcccaatgatttagaggcattcggggtgcgcaaacgctccttcgaccttatttcttcaaactttaaaata

SEQ ID NO: 54185 - DNA, 117 bp, Zea mays
  Clone ID: LIB3068-003-Q1-K1-G11
ggtcacccttcccctcggcctcaagagctctgcggttgccgcggccaagggcgtccgtggagaagcgggagcaggtggcggcgatggaagagcaaggcggccaggcggcgctcggat

SEQ ID NO: 54186 - DNA, 74 bp, Zea mays
  Clone ID: LIB3068-003-Q1-K1-G3
cccacgcgtccgcccacgcgtccgcccacgcgtccgtccacgcgtccgcccacgcgtccgggtctagatcgcga

SEQ ID NO: 54187 - DNA, 348 bp, Zea mays
  Clone ID: LIB3068-003-Q1-K1-G6
cggacgcgtgggcttcaagagaaagaagacatgaatctaggtgccccttcaatgtgaagacgcttctaaagagattggggacaagaaaggtggtactatcgaaggggatcatgtcaaaggaatcagaaggagcagcaggctggaatctaacgacgagatgaagattgatgataaggctacaacgagagcaatggctaaggatgcgtttattaacaaaggtatatcttctaaccctttttctgttctcaatactgataattatgttcttatggatgttgctttaaagttggaagtagaattaggttcctcttttaatgaagctgtggaaaatttagaaatgataaaatc

SEQ ID NO: 54188 - DNA, 364 bp, Zea mays
  Clone ID: LIB3068-003-Q1-K1-G8
gattcaaggtactggaacaaccctgaagattttagcccagagaggtttcagaataacaatgtcgactacaaagggaccgattttgagttcacccccttcggtgctggtcgtcgacgctgccctgcaatcatgtttgccacttctactctagagattgcattggcaaaccttctctaccacttcgactgggctcttccggatggagtgagcccaaagatggtggaaatgtctgagcaatacgggatgggtgtcaccaaaaagttagacctgcatttgagagccatcccatatgtatactctactatggcataggtatggggggtggttaaagctacctgcaccttaacttgaggtccttttgatg

SEQ ID NO: 54189 - DNA, 407 bp, Zea mays
  Clone ID: LIB3068-003-Q1-K1-G9
cagctgtaagcaagaagctagatgagttaccttccacatttaaagaatcaaaccaaaccatgggtggttcagaagctgttgcaggcaagttggaggctcctgaaattggttgtcaggtaactggttcctctccagtagatgacaaagctagagaatcttcaggatcaccagtgaaggatactcctgatgctggagtcagattgcaaggatcagataactcagctatggcattttctgcactcccacttgaagcacctgtgacaagcagcagagcagagcctgtggcatgtgatggcagtgacatgaaagatgatattccactagacgctgaaagcaacgggaaccttgaagagcgatgaaactgcttccttttggaacatggatgcattacatcaagtattggttaa

SEQ ID NO: 54190 - DNA, 149 bp, Zea mays
  Clone ID: LIB3068-003-Q1-K1-H1
cccacgcgtccgcccacgcgtccgcggactcgtgggaaaaaaaaaaaaaaaaaaataaaagggaaaaagaaaaaaaaaaaaaaaataaaaaaaaaaataaaaaaaaaaaaaaataaaaaaagacatccattttaggggatccattttta

SEQ ID NO: 54191 - DNA, 329 bp, Zea mays
  Clone ID: LIB3068-003-Q1-K1-H11
ttcttgagcaagcaggcgtcggtgttcttctgtcgaacctcggccttaacgcttcttcggcatgaatcctcattagcgccctgacgaccttactgatgctcccaagcatcggcattgcgatgaggctcatggatatgtccggaaggaggtttctcctcctcgcaacgatcccagtcctaatagtcgcgctactcgtcctggtggtgtccaacatcgtggacgtgggggacgtggcgcacgcggcgctctccacggccagcgtcatagtctacttctgcttcttcgtcatggtgttcgggcccgtccccaacatcctctgcgcagagatc

SEQ ID NO: 54192 - DNA, 324 bp, Zea mays
  Clone ID: LIB3068-003-Q1-K1-H12
gcgcttccaacggtagctaactccaaggcaagcatccttggtccattgttggcctcgctcatcgatcagctgtgtctcagcaggaggcgttgcggccatggcggcttcgaagcccatcttgtatagcgcgtggatcagctcctgctccttccgagtccggatcgccctcaacctcaaaggtgtggattatgagtacagggctgtgacaaggaacgatctagattacgaaaagatcaatccaatcaagtatgttccagcattggttgatggggattttgttgtttctgactccctggcaatcatattgtatcttgaagataaata

SEQ ID NO: 54193 - DNA, 370 bp, Zea mays
  unsure at all n locations
  Clone ID: LIB3068-003-Q1-K1-H3
cccacgcgtccgcccacgcgtccgcccacgcgtccgacgagctcccagacccgtgcatctgcaagcacacgcacggccgaggcatatgggagttgaccaaagatgacgcgaccttcgacgccctagtcaacgacgggttggcttccgacagccagctcatcgtcgacgttgccatcaagcagagcgcagaggtcttccaggggataagctcgctcgtcgacgtcggtgggggcatcggtgcggcggcccaagccatctcaaaggcgttcccgcacgtcaagtgtagcgtgctggaccttgcccacgtcgttgcgaaggctccaactcacacggacgtgcaatttatcgctggcgacatngttgagagcat

SEQ ID NO: 54194 - DNA, 400 bp, Zea mays
  unsure at all n locations
  Clone ID: LIB3068-003-Q1-K1-H5
gtcatctattcttctgggccctcattcttcagtagcatgacgaagttaagatcgctggcacaggcccgagtgactagcccggctaatgaaggaagtggcgcttgatgtggaggtgctgctggtgtagtcgtactcatgttgcaggtgatgtcctcatcaataaccttgggaaagccaagccccaatccacttttattttcttaattctttttctttttcgcttacgcttacccttacacagatgacttctcacgagtcctcggaaggagggaacgcacattcccacacggacggacttgcgcaagagggttttccctgcattntgtgggaggtgctgcagggagccggttatctggtgcagttgttcgaggagcaccgggtaccccgctgtagggttgag

SEQ ID NO: 54195 - DNA, 395 bp, Zea mays
  Clone ID: LIB3068-003-Q1-K1-H7
atcagtttcctcaatatcttcttcctctgcttcagcgattgcttgttctgcatggtcattaggaacctcttccgaagtcactagcccagatcgttgcatggcttctgagatggggacagtctccaaagcttcagtttcgtccacctcacgttcaaccctggcggtagaacgcactctggccatttaattatgaacttgtggaactttaatactttcttcctccgaagcaagtttcaaactggagcttctttcgattccgacagacaagcttctgcgactgttaaaaattttggcagcaaaacagtgcaaatagcaatgaatactgtggtaacttcacacctacttgtctgtttatatagtgctgtatgtaagaaagctaaacgccaggattttta

SEQ ID NO: 54196 - DNA, 406 bp, Zea mays
  Clone ID: LIB3068-003-Q1-K1-F4
ggaaaggtgctatccagtttttcatgaaagaatatgacaaagcgctggaaacttatcaaggtggcctaaagcatgacccgaaaaaccaggagttacttgatggtgtaaggaggtgtgttgaacagatcaacaaggcgagcagaggcgaactcagtgaggaggaactgaaagagagacagaacaaagccatgcaagaccctgagatccagaacatcctgactgatccgatcatgcagcaggttttgacggatctgcaggagaaccctcgggctgcgcaggcgcacctcaagaaccccggagtgatgcagaagatccagaagctcgtcagcgcaaggatagttcagatgaagtagacgggggcttggaatgttccgggttcagatcttgggacctgtgcctggaaatg

SEQ ID NO: 54197 - DNA, 339 bp, Zea mays
  Clone ID: LIB3068-003-Q1-K1-H8
cccacgcgtccggcgaccgccgccgcttccctactcacccttggccggcgacgacgagcgcgcaccacggcaggatgacgacgctgaggaacctcaagatcaagacgtcgacgtgcaagaggatcgtgaaggagctgcgctcgtacgagaaggaggtggagaaggaggcggccaagaccgccgacatgaaggagaagggcgctgatccctacgacctcaaacagcaggagaatgttttggctgagtcaaggatgatggtcccagactgccacaaacgacttgaaactgcactggctgacttgaaagcaacactggctgaactgaaggagtcaaatgagc

SEQ ID NO: 54198 - DNA, 216 bp, Zea mays
  unsure at all n locations
  Clone ID: LIB3068-004-Q1-K1-A1
cggacgcgtgggcgacgatgggtgagcttgagcctgaccgatgacgcggntttgggttacgcggtgccactcaggatacgatcccttttattgtaaaagagggatcccttctttccattgcattcttgcaatccgtttcttcttgactatgtttcttcttgactatgtaacgataataacatgagaaaattatctgaatgacattatattttttct

SEQ ID NO: 54199 - DNA, 304 bp, Zea mays
  Clone ID: LIB3068-004-Q1-K1-A9
gccaagcttctcaagccttggtacgcggccttcgtgaacagattcctcgccatggtcgcgctggcatctatcgtagccgccgcgctccggcgggcgtggccagcattcagcatggacgatgtcgtcggcagccttggcgccgcgcggccggtccacgtgctcatggcggtcatcctggctgccggcgtggcgaagctgaggcgcctgcgccggccgcgggacgtgtacctggtggagtacggctgcttccgaccgcggccgtgcttccgggcgccgttcgccacgtgcctggagcacgtgcacc

SEQ ID NO: 54200 - DNA, 271 bp, Zea mays
  unsure at all n locations
  Clone ID: LIB3068-004-Q1-K1-B10
ggaannccgggggggccagcgtccggcaanaccacanananagagagtgttacctacgcgcctgcagatcccaaattcggtggattattaaaaggagggcgaccgaantcttctatngntttcatcatggacttcgcggagaatctgatcctccgtctgatggaagacccggacaagcgcgaccatgttctgcgggagcatgtctacaagatgaaggagcggtgcgagcgcactaaggcggcgtggagccttcctctgcgcccctacggct

SEQ ID NO: 54201 - DNA, 196 bp, Zea mays
  unsure at all n locations
  Clone ID: LIB3068-004-Q1-K1-B2
cccacgcgtncgcggacgcgtgggctcgcggcgaccacccgattcgaaccgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctc

SEQ ID NO: 54202 - DNA, 64 bp, Zea mays
  Clone ID: LIB3068-003-Q1-K1-C1
taaaataaaaaaaaataaaaaataaaaaaaaaatatttaaaattaaaataaaaaaaaataaaaa

SEQ ID NO: 54203 - DNA, 330 bp, Zea mays
  Clone ID: LIB3068-003-Q1-K1-C10
tgagaatctgctacatagggcatttagtgtgttccttttcaactcaaaatatgagctgctacttgagcaaatgtccgcgacaaaggttacctttcctttagttgggaccaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatgtggggagcatgagctcgactacctgctgttcatcgt

SEQ ID NO: 54204 - DNA, 318 bp, Zea mays
  Clone ID: LIB3068-003-Q1-K1-C11
cacgacttttgcctagggataccttttggtggacttttactctccatgggccttattggatttgtcttctggaggagccctgcgagtcttacctttggtgttgcacctggccttgccatattggccctggctgtacttagcctcaatgtctggaggagcgggaagtccagcttaccgttcatactggcgcaagcaggcattgccgctgcggtagcatggaagcacggccaggcgtacaccactacgaggaagctgcttccgtggggcttctacgtcgcgctaagtgccgcaatgatctgcttctactcctacgttctt

SEQ ID NO: 54205 - DNA, 297 bp, Zea mays
  unsure at all n locations
  Clone ID: LIB3068-003-Q1-K1-C3
accggctccgggaattcctcggggtcgactccacgtcgnntccgtgcatcacggtagggcggatctggcntnctgacaccagtctnntcgtcttcttttacgacgaccgtnncaagagccggcgcggaaggggtggtgtcatcaggtnttctcgcgacccgtcctgggacaactgctgcgactnctcggcttacccacgttatcgacgccntngagtccgtacaagggactcnttgccatggcttgctngctgcaaggaatctcngnntcgctgggtggccccnaacggcaagggac

SEQ ID NO: 54206 - DNA, 479 bp, Zea mays
  Clone ID: LIB3068-003-Q1-K1-C6
tcggtcttgaattgcctggccgacccactcgtgcgatcggcatcttcctccccaaagtttaccctttcctcaaggaaccttaattttagattcttgaagaatatgagtcaccctgtatttttggtccaatcttttaacaactatggtcctatgcttgctctaatcaacttatttataggcttatattttcttatgtttcataatatttccttgtattcatatttttttgaccttttatatttatttttccaattttttattttattttttgtttctatttttattttctttttttacctttatatcttttttttttttttatttttttttttttatattatttctttttatatttttattttattttttctttttattttttttattttattttttattttacatttttatttttattctatttattttctttctttttaattattttttatttttttatttatttattcttatttttt

SEQ ID NO: 54207 - DNA, 173 bp, Zea mays
  Clone ID: LIB3068-003-Q1-K1-C8
cccactcgtccgaaaaaaaaaaataaaaattaaaaaaaaaaaaaaaaaaaaaaaggaaacggatataaaatatccaaaactaacattcacttacatacaacaacataatctcttctataaactcacctaaattcaattaacttttccaactactaaacaacatctatactgtc

SEQ ID NO: 54208 - DNA, 324 bp, Zea mays
  Clone ID: LIB3068-003-Q1-K1-D11
tgacaacccacgccacgacgacacaacaaagcaccgcagctactaaacccatggccggggtcgtggtggtgttcgacttcgacaagacgatcatcgacgtcgacagcgacaactgggtcgtggacagcctcggcttcaccgagccgttcgagcgcctactgcccaccatgccctggaacacgctcatggacaccatgatgggggagctgcacgcgcacggcaggacgctggacgacgtcgccgaggcgctccgtgcggcgcccgtcgtcgcgggcgtccccggcgtcatcaaggccgtctacgcgctcggctgcgacctgcgcg

SEQ ID NO: 54209 - DNA, 400 bp, Zea mays
  unsure at all n locations
  Clone ID: LIB3068-003-Q1-K1-D3
cccacgcgtccgcccacgcgtccggctttagcgatggtcctgttcatggctggcgccgcggtgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgncttcttcggccagacgtcccacgaaaccaccggtggatgggcgactgctccggatggaccgtttgcctggggatactgccgggtgaagggacagatacagacggacccactctactatggacgaggaccca

SEQ ID NO: 54210 - DNA, 381 bp, Zea mays
  unsure at all n locations
  Clone ID: LIB3068-003-Q1-K1-D4
nagtcctcgcgtatattgatattgtgctcatcattcagtatattgccaacatgataaagtttcgtgttgagagctacatcaagcccgtccctgctattctggagatcccatccaaagaccatccatatgatccaacgcacgactcggtgctctctcgagcgaaatatctgttctctgcagaatcggttgcgtctgatatgctatgaatgcatccttgcgtagcagtacccttcgatgcatctattttgttatggtattgaaaagaatatggcacgtaccattgggtgcgatcgagccagcatgaacaatattgagcttgctaacaataattggctgaactaaaccaacaccctctttttcataaatggttctaaatgatat

SEQ ID NO: 54211 - DNA, 387 bp, Zea mays
  Clone ID: LIB3068-003-Q1-K1-D6
ggatattgctattgtgctcatcagtcagtatattgccaacatgataaggtttcgggtggagagctacaacaagcccgtccctgctattctggagatcccatccaaggaccatccatatgatccagcgcacgactcggtgctctctcgagtgaaatatctgttctctgcagaatcggtggcgtctgataggcgatgaaggcatccttgcgtagcagtacccttcgatgcatctaatttgttatggtattgaaaagaagatggcacgtaccattgggtgcgagcgagccagcatgaacaataatgagcttgcaaacaataattggttgaacctaaccaacaccctttttttcataaatggttccaaatgatattttggtgccttggggt

SEQ ID NO: 54212 - DNA, 338 bp, Zea mays
  Clone ID: LIB3068-003-Q1-K1-D8
caccgacatgaactactacccggtgtccaagtaccacttcgacctcagcggcacggcggggggcaggctggccaagcccggcctcaacgacaagctccgccactcgggcatcatcgacatcgagttcaccagggtgccgtgcgagttccctggcctcaagatcgggttccacgtggaggagtactcgagccccgtctacttcgcggtgctggtggagtacgaggactgcgacggcgacgtggtgcatgtggacctgatggagtccaagacggcgcgcgggccgacgacggagcgctgggcgccgatgcgcgagtcctgaggctccgaatggcgcatgg

SEQ ID NO: 54213 - DNA, 87 bp, Zea mays
  Clone ID: LIB3068-003-Q1-K1-D9
tcgcccacgcgttcgcccacgcgtccgcccacgcgtccgcccacgcgtccgcccacgcgttcgcccaggcgtccgcggacgcgtggg

SEQ ID NO: 54214 - DNA, 355 bp, Zea mays
  Clone ID: LIB3068-003-Q1-K1-E1
ctcgcggtggtgctcctcctcctcctccctctgctcccggggcgggcgctctcctgttcggcctccggctgctgctggtgccagggccggggggcggcgtggaggtggcgctcatggggctcgccggggacgggtcggcggacaccgtcaacctcagtaatagtgaaaatggtcggttcagatatggagttgcaagttctcccgggaaaagagcatcgatggaggacttctatgaggcaaggatagacgacgttgacggagagaaagttggaatgtttggtgtgtatgatggtcatggaggagtcatagcagctgagtacgttaagcagcatcttttcagcaatttaatcaaaca

SEQ ID NO: 54215 - DNA, 192 bp, Zea mays
  unsure at all n locations
  Clone ID: LIB3068-003-Q1-K1-E4
ttcccgggctcgactccacgtcgtctcgtcccactgcgtctcgaatcgcacngtngccttcgtgctcgtgcgactgcatttcattcaaatnnttctgccctagtnannacttgtcgatggnttaggatagnngggcctactcatgnnngtggtgacccgggttgacgtnngagaattatgggtnnntcgatt

SEQ ID NO: 54216 - DNA, 429 bp, Zea mays
  Clone ID: LIB3068-003-Q1-K1-E6
gcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggaatgatcttaagacttcccaac

SEQ ID NO: 54217 - DNA, 412 bp, Zea mays
  Clone ID: LIB3068-003-Q1-K1-E7
accagacgtccgaccactcgtatctaatattgattgaatacttttaataaagcagtaccgatccattattggtatgtttatgtcatatagtaaacggatcaaagggatatactgtggcattagagaatattcatcttgacaagaaattatctatatgtaaagatatctctgacaacggctatagctcatttcggtagagcaactaatttacacgtgcgccaatgctttttaacggaactttttatgcaatgaacataattgaccttgaagcataatcaatgtcttacttcatggattcgaaagagtcgaacaacagttacctgacaatgacaaacagctgttttagatctattcaagtgccaaatatggagcttactcatatataacttccattgatttcgccttctttgat

SEQ ID NO: 54218 - DNA, 329 bp, Zea mays
  Clone ID: LIB3068-003-Q1-K1-B8
cccacgcgtccgcccacgcgtactcccacgcgtccgattgctgttgaccgattgggtgcgtttcaagatctcagaggtaaagactattttccgacaagagcgttggaaaatattctcaagacgaaagggataattgatgacaagaagaaagatgacgacgatgacgatgaataaagcgaggctaagactaggagggttaggtcttcaactgctcaagactctgactcagactgaacctgagatgaggatcgatgactcaccgtttctgcactttggattttgtcagtatgattgttctgtgttgcgctgtactgtactgtaattgattt

SEQ ID NO: 54219 - DNA, 341 bp, Zea mays
  unsure at all n locations
  Clone ID: LIB3068-003-Q1-K1-E9
gcgcccacgcgtccgcccacgcgtccgcggacgcgtggggctagttttcctttttctctggggaaagagtagagagcccaaagatgagagctttaagcagggtcggagtggggctcgccgtggtgtccgcgctgctccttctagcgctcaccgcggagctctattacatcttcgtgcacaagcgccggctgcggcgacgcgcagccgccatctccgacgcgtcgtcgtccccgtcctcgtcctcccgcgagctgctccagctcttctgcttcaagaagccgccggcgctcgcgtncacctacgccgtcccggaggccgcgacgacgccgacgccgacgacg

SEQ ID NO: 54220 - DNA, 347 bp, Zea mays
  Clone ID: LIB3068-003-Q1-K1-F1
cccacgcgtccgcccacgcgtccgcccacgcgtccgcccacgcgttcgcggacgcgtggggggacaggactcagatggagatgctgttctgctccactgtcgttggccttccgttcctagcggtgcccatggtgttaacaggagagctcgtgactgcttggacttcctgctcccagcatctctacgtgtacgcggtgctggtgttggaggcgatggccacgttcgtcggccaggtctccgtgctctccctcatcgcgcttttcggtgcagcaaccacagccatggtgacgactgctaggaaggcggagacgctgctgcttgtgtacctgatatttaccaagcccctt

SEQ ID NO: 54221 - DNA, 363 bp, Zea mays
  Clone ID: LIB3068-003-Q1-K1-F11
cccacgcgtccggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcggcaccttctccacggaggaggcgatgcggaacgccatcgagggcatgaacggcaaggagctggacggccgcaacatcaccgtcaacgaggcccagtcccgcggcgggcgt

SEQ ID NO: 54222 - DNA, 294 bp, Zea mays
  Clone ID: LIB3068-002-Q1-K1-G8
gtcgccctcccgctcggctcggcgaacgcgatctgttccccaacctccgcagccgctccagcatccttcactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaagcaagcaaaagaggaggctgagcgggaaatagccgaataccgtgcccagatggaggctgagtttcagag

SEQ ID NO: 54223 - DNA, 444 bp, Zea mays
  Clone ID: LIB3068-002-Q1-K1-H10
ggagtgtgcagagctccaatcatacagcacttcgcagagtcgatagcggggtcgagcagcatcagaagtttcggcaaggaagaccagttcgtgtcgactaacagccgtctaacagatgcctactcccggcccaagttctacaacgccggagcgagggagtggctttgctttcgcctggacttgctgccctctcttgcgttcgccttctctctgatctttctgatcaacctaccgaccggtctcatcgatccaggttgtctggagcatgtgcactttggagaacaagatcatatcagtagagagaatcctacagtacatgggcgttcctgcagagcccccgcttgtcatgccagaaaacaagttggctcagagctggccatcgaatggagaaatccagcttcagaatctccatgtgaaatatgcgccgcagctgcccttcgttct

SEQ ID NO: 54224 - DNA, 421 bp, Zea mays
  Clone ID: LIB3068-002-Q1-K1-H5
cgaggacggtttcagctatgccagttatgaggttatgggcttggatgccactgctctgtctgatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgat

SEQ ID NO: 54225 - DNA, 423 bp, Zea mays
  Clone ID: LIB3068-002-Q1-K1-H7
ctttcaggtgagactttcatattcttcaacatgcagatcaaaggaaacaagagggagatcatgcagcttggtgtaccgttatttcaacctaccacagaggatgctaattgtcacacagaaccaatcccccttgtcctgcaggctgtcattgaccaccttgttctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttggcaggtcacttgtcactgacagcaacggtaactacaaaggacctctcacactttcactaaagcaagggtccttactagtgatgcgtgggaacagtgccgacatggcgcga

SEQ ID NO: 54226 - DNA, 399 bp, Zea mays
  unsure at all n locations
  Clone ID: LIB3068-002-Q1-K1-H8
taccgggccgaccgacgcgtccgctgggaggtgagactggcatattcttcaactttcagatcaaaggaaacaagagggagatcagacagcttggtgtaccgttatttcaacctaccacagaggatgctaattgtcacacagaaccaatcccccttgtcctgcaggctgtcattgaccaccttgttctttggcgtttaataccagaaagcaggaaaccaaatagtgtcgtcatcaacttcttcgatgaggatgaacattcgcagccctacttcaagccttcccatcttgacaaccccatttgcactcttctgctgtctgaaaccacgatggcatttggcaggtcacttgtcactgacagcaacggtaactacaaaggacctntcacactttcaactaaac

SEQ ID NO: 54227 - DNA, 206 bp, Zea mays
  Clone ID: LIB3068-003-Q1-K1-A10
gcgtgcgcccacgcgtacggttgaatggcaaacaaatgttctggtcaaacgtaatgaagtagagaatgttggtcattttgcttgtgggcgctgggcgtcattacatgaccgtggtagggacagtgatgatgatgacgtccgttacagggactacgacgtggcagctcttgctaataacttaagtcatgcatttctttatgggatat

SEQ ID NO: 54228 - DNA, 201 bp, Zea mays
  Clone ID: LIB3068-003-Q1-K1-A12
cggacgcgtgggcggacgcgtgggcggacgcgtgtgtcgtgaacctggtgggcgacccttacctgggggcataagaccccggggtagccttcaagacggccatcatggactggatgacgccgcattcagccaagcccatctaccacgccgtgattaccgtcgtcgggaggccctacgccaccgaccgcgccgcggggaggc

SEQ ID NO: 54229 - DNA, 211 bp, Zea mays
  Clone ID: LIB3068-003-Q1-K1-A2
cccacgcgtccgcgcgaagatcaagagcactccagaggccgagaaatacttcgcagcaacgaaagatgctcttggcgatgttctcgccaagctaggctagacgcaagggctaataatggccatgtaatttcggacttgtgtttgttcatatggacccggcaaggcaatgtaccattttctgttgatattgtatcaggaagcacttaactac

SEQ ID NO: 54230 - DNA, 114 bp, Zea mays
  Clone ID: LIB3068-003-Q1-K1-A3
tcgcccactcgttcgcccacgcgtccgcccactcgtccgtttacgctttctaaaaaaaaaaattgataagtgtaaaaattaaaataatttataatataatataaaatattaata

SEQ ID NO: 54231 - DNA, 302 bp, Zea mays
  Clone ID: LIB3068-003-Q1-K1-A4
gtgtgggcgaagagaccccagccagtcgatcgttcaagaaaaataccagcttaccaacagcagcagcggcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcccgggcccgcagaagtgctcgggcgcggtgggcgagtgcgacttggacgaggcggatgagcttgggctgag

SEQ ID NO: 54232 - DNA, 377 bp, Zea mays
  Clone ID: LIB3068-003-Q1-K1-A7
gcttgaggagcagagggttgagtgcattgctcagctagaagagaacaatatgtggagaagtgaactcaaagacattgctgatcagtataacattactcagcagaaatatgctcaccaattgaaagagaaaatgatggaacttgagcttgctgatctgagacttcaacaacatcaagagaaggctgctcacgaacatacccaaatgcaattgtatgccgagcaagtttctcagcttatgactactgagaagaacctgcggttgcaactagcttcggatggagaaagatttcagcactttcaggatgccctgtcaaaaaacaatgaaattctttgaaacttacaagcaagagatggaaaaaatgattttggtgataaaa

SEQ ID NO: 54233 - DNA, 454 bp, Zea mays
  Clone ID: LIB3068-003-Q1-K1-A8
aaaaaaaaaaaaaaaaaaaaaaattaaaaattaaaaaaaaaaaaaaaaataaaaggaaaaatgaaaataattaaaaaaaaaaaaaaaaaaaataaaaaaaaataaaaaaataatatatattaaaattaataaatattttttgtactttttttaactatttttatttttttataacttcttttatttttttactttttttttttttttacatatttttattttttttatatcttttttttacctatttttttctttaaaaaactttctttctttctttttttatttttttatatttttttttcttttttcctttatttgcttttttctttaatatccttttttttttttctttttttatttttttttttaatttttactttaaatattagtttcttctctctttttatcttttttttaatttgtctttttattattatatgtttttttttttctt

SEQ ID NO: 54234 - DNA, 310 bp, Zea mays
  Clone ID: LIB3068-003-Q1-K1-B1
cggacgcgtgggcggactcgtgggcggactcttgggctgacgcgtgggcgccaccatacgtgctagaagagcgatgcctaccataccacactgatgtcagtctctggagcatttaagtggtctggatcaatggaatgtgtgtgtactaggcagccggcaaagatgagctgctgatggtaatgatgatgataagaggtcactggtaccctactacgtaccctggtctttgtgagctggcatccgtgcccgatagacgatcgaggagagaatgacgcacagctctctgctaccggactgtcttctgccgtac

SEQ ID NO: 54235 - DNA, 383 bp, Zea mays
  unsure at all n locations
  Clone ID: LIB3068-003-Q1-K1-B10
cggacgcgtgggatcttactcttattattgaacctggaagatccttgattgctaatacttgctgcgttcgtcaatagagtaactggtgttaaatctaatggtacaaagaatttcattgttgttgatggcagcatggcagaactcatcagacctagcctgtatggagcatatcagcatatcgaattggtctctccccccactcctggtgctgaagtagcgaccttcgatattgttgggccagtttgtgagtctgcagatttccttggaaaagatagggaacttccaacacctgatgagggagctggactggttgttcatgatgcangggcctactgcatgagcatggtttcacctacaacctgaagtgaggccgccaaagactg

SEQ ID NO: 54236 - DNA, 125 bp, Zea mays
  Clone ID: LIB3068-003-Q1-K1-B11
caaaagaaaaaaaaatatacaaaaaaaaaagaatgaataaaagaataaaaaaaaaaaaacaaagcgaatggataaaattaaaagggaggggaaaaaaaaagggcggccaaataaaagggtccaag

SEQ ID NO: 54237 - DNA, 118 bp, Zea mays
  Clone ID: LIB3068-003-Q1-K1-B2
cccactcgtccgaaaaaaacaaaaaaaaatttaaaaaaaaaaaaaaaaaaaaaattaaaaagaaaaaagtaaaatttaaacatttaaaataattaatattaaaataataataaataaa

SEQ ID NO: 54238 - DNA, 251 bp, Zea mays
  Clone ID: LIB3068-003-Q1-K1-B3
gttttagatcgcgagcggccgcgaccactaccacgacggcggccacagtagcagcagcagcgacagggactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcacggatggtttgtttgccaaaaaaaaaaaacta

SEQ ID NO: 54239 - DNA, 330 bp, Zea mays
  Clone ID: LIB3068-002-Q1-K1-G7
tcttcctaaaaaaaaaaaaaaaaaaaaaaaaaaaaaaaattaaaaaaaaacaaccaaaataaaaaaaaccagcctaacttacacaaccatacaacaaccataccacatacctaaccccacctaaaaccaatccactaccccttattctacaacatcttaacttcaaaacccctgtctttccccaacttaatcaccttccaccccatccccctttcaccctcttctcttattacccaaaacccccttacccaccccccttaccaacctttcctcacccttaatacccaatctccccccccctttaaccccccattaaacacctccctttct

SEQ ID NO: 54240 - DNA, 282 bp, Zea mays
  Clone ID: LIB3068-003-Q1-K1-B4
gaagctacaatcctaaaaccatctgcttcatccttcagctagccccaagtttagtcggccgatcgagcactgaagtagtaatggcctgcgccaacagctggaccctcgagatcgcgtcgccggtggccccgcagcgcctgttccgcgccgccgtgatggactggcacaccctggcgcccaaggtcgccttccacgtcgtcgccagcgcgcagcccgtggagggcgactgcggcgttggcagcgtcaggcagttcaacttcaccttagtcatgccgttcatct

SEQ ID NO: 54241 - DNA, 371 bp, Zea mays
  Clone ID: LIB3068-003-Q1-K1-B5
cccacgcgtccgcccacgcgtccgcccacgcgtccggttcttctgtgaagtcggtgatgggtacattcaagacgacttcaacctttgtggcctcagcagccaagttccttattatgattatgctcttgatctcattttagatattgaatcatctcatggtgatatgttcactgaggaacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatctagta

SEQ ID NO: 54242 - DNA, 86 bp, Zea mays
  Clone ID: LIB3068-003-Q1-K1-B6
aattccctgcccgacccactcttcctcccactcgtcctaaaaaaaaaattttaaatttaaaaaaataaaaaaataaaaaataaaaa

SEQ ID NO: 54243 - DNA, 385 bp, Zea mays
  unsure at all n locations
  Clone ID: LIB3068-003-Q1-K1-B7
cccacgcgtccggcaccatcgacgggcagggagccctggtgtggagcaagaaccagtgcgagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctncatcggccccgggagcaagatgatccgcatccatggcgtcaagtgcgggccaggccacggcatcagcgt

SEQ ID NO: 54244 - DNA, 461 bp, Zea mays
  unsure at all n locations
  Clone ID: LIB3068-024-Q1-K1-A2
cccacgcgtccgaaatcaggcatgtacactcacatattatggaatcaggttcacctgaagatgaggcaggatctgaggacaactttgtgcaaggggagaatgggacttctgtagcaaatgcttcgattgatcctgctcaatctttacatggcagcaatctttcaccaccaacagtactacagtttgggaagacaaggaagctatctgagagatctgaccctagaaatcggcaactcctgcaaaaacgacagttcttccattctcacaaggcgcaacccatgcaactggagcaagtgttctcggaccgtgatagtgaagatgaagttgatgatgatattgctgacttcgaggatagaagaatgcttgatgattntgttgatgttacgaaagatgaaaaacttattatgcatatgtggaattcatttgttcgaaaacaaagagtgttagctgatggtcatata

SEQ ID NO: 54245 - DNA, 192 bp, Zea mays
  Clone ID: LIB3068-024-Q1-K1-A8
tccaagccgggagtcaccgggaggggcatccccaacagcatctccatttgacccgtccgtcctcgccatccaatgggggtttgccttattgcgtgcacgctagctagctgcttggaaataaaaataattaaaataaaaggtctcgtctgtactattgtattgtaccatggatcatatcgtacatgttgtgtc

SEQ ID NO: 54246 - DNA, 431 bp, Zea mays
  Clone ID: LIB3068-024-Q1-K1-B10
gggaattgctgagaggtccactctattatgtcctggtgctgctgttcagcgttttagtcttctggcgtgagtcccccatcgggatcgtctccttgtcgatgatgagcggtggcgatggtactcccgtccccagtatctaatagcacgatgtcgttttgtagaacgccgttgcatttgattgtttgtgccatataacttgcaggttttgctgacattgtcgggaggaggtatggctcagcgaagctgccattcaatcggaagaagagctgggccgggagcatctcgatgttcatttctggtttcctgctgtccgcgatgatgatgctctacttctcaagcctgggttacattgatgttatctgggaagaggcacttggtaagctggcgcttgttgcactagcagcaacagtagtggagtgcgtccctgtgac

SEQ ID NO: 54247 - DNA, 408 bp, Zea mays
  Clone ID: LIB3068-024-Q1-K1-B3
cccacgcgtccggccaaccagaagagcttgcagttactgagagtgtgtgtgagagagaggatggggggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccagccaaggagcacaagccgcccaaggagcacgggcccaagccggagaagccgtccaaggagcacaagccgacgccgaccacgtacactccgagccccatactcacgccggcgacgtacactcccacccggaccctctcatgcctgccccaaccacatacactt

SEQ ID NO: 54248 - DNA, 289 bp, Zea mays
  Clone ID: LIB3068-024-Q1-K1-B5
acagaatctagtaaagattgagaaaaacattttttttgagaaaaaaaaaaaaaaaaaaaaaaaagaaaaaaaaaaaaaaaaaaaaaaaaaaaaaaaaaaaaaaaaaaaaaaaaaaaaaaattacatacaaaaaaataaaaaataatataaatataatataatgtaaactaaattgaatgaactggacaacgttttacaatggcaaaaaatgtaaaaaccctgaacgctaataaacttaaatgacattgcaccatataccactttctacatctgacataatatccaaaag

SEQ ID NO: 54249 - DNA, 484 bp, Zea mays
  unsure at all n locations
  Clone ID: LIB3068-024-Q1-K1-B6
ccaagaagcaagaaaactagaaaaggctcctcccgaccgcaacgcccctcatctccgtcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgncaagctggcgcggtacaacaagaagcccaccatcacgtcccgcgagatccagacctncgtgcgcctagtcctncccggagagctcgccaagcacgccgt

SEQ ID NO: 54250 - DNA, 224 bp, Zea mays
  Clone ID: LIB3068-024-Q1-K1-B7
cccacgcgtccgcggacgcgtgggatccttgaatttgacaccatacccatattctgtatagaactgagtgtattgtacctgtatgatagaggacaacttttctccttgtttaactaatcaaataggcataaacatttttccttggtttcgtatgccttttttttctggttccttggcttctgggccctaaatgaaatttttaccaaggtactaaagtaatggtc

SEQ ID NO: 54251 - DNA, 469 bp, Zea mays
  unsure at all n locations
  Clone ID: LIB3068-024-Q1-K1-B8
cacgcgcctgcccacctctccctcgccgtgtgccgacctcgctccccacaatcatgcgcaaggagggcatagccatggtgcgggcgagccttctcgccgtgcgcgaggcgctagcggtcggcgctgctgcggccacgcggcacggcgcctccgccgccccgctcggtcccgtggcgatcttgctcctcgcggtggccgcgacggcggccgtggcggccatcgcggcgttcgggtgcgcgcagggcgccaagaagccgcgccggcagagcagcaacaacaacgcatactactacggccagggctacccgccgcctcccgcgggcgcgtacggctaccctgcgcaggccgcgtacggctacccggcgcagggcgctggagggaggcccggccgtagcgggctcgggtcgggagccgcggggctcgccgtcggcgcggtcggcgggctggccgncggcgccatcatcggctc

SEQ ID NO: 54252 - DNA, 433 bp, Zea mays
  Clone ID: LIB3068-024-Q1-K1-C10
ggcggatcgggagcgggagagaccactcccaaatcgcgtcgcgtcgcgtcgagagcgagagcggaagaggtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggtcaccgtcgccaagtgctacatgctgt

SEQ ID NO: 54253 - DNA, 294 bp, Zea mays
  Clone ID: LIB3068-024-Q1-K1-C11
aaaaaaaaaaaaaaaaaaaaaaaaaaaaaaaaaaaaaaaaaaaaaaaaaaaaaaaaaagggaaaaaaaaaaaaaaaaaaaaaaaaaaaaaaaaaaaaaaaaaaaaaaaaaaaaaaaggaaaaaaaaaataaaagatcaggggggtgcttttttgagctcctaacttaagagctcggtaatacggacgccaaaggacaattaacgggccgccaaattaaaatttggggcccgggaaaacaaaggctccgacggggtaaacccctggttgcaacatccttatctgccaggggtcaa

SEQ ID NO: 54254 - DNA, 474 bp, Zea mays
  Clone ID: LIB3068-024-Q1-K1-C3
ggacataaatgcagaaacgatacggtgcagaacaatacccaatgttcttgcaaatcttgagcaggctcaggaccgacagaacagaccatcagagagccctgttacaccatctaggcagctcttggctcctaatgtacatttctatgctggagagtgggatgaactcccaacaattctctcagttgtgcagccacctgcagcaccaacaaacctcagcttctctgaggatgattttatggatggctgcagtagccatgatggaagcagtgtagttggtcatgactactgccccaggagatctaggaagctttctggtagccgtgcatgggagagagctagtgagaccgaccaggcagatagtggctatgatgtgatcttgatttctgatgtcccctacgcagctaactctctgaagaagctctatgcgcttatttcaaagtgcctacgtcctccttatggagtcctgtacgtcgc

SEQ ID NO: 54255 - DNA, 398 bp, Zea mays
  Clone ID: LIB3068-024-Q1-K1-C4
cccacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggt

SEQ ID NO: 54256 - DNA, 487 bp, Zea mays
  Clone ID: LIB3068-024-Q1-K1-C7
cccacgcgtccggctcgcttcgcaccacgcgctgcggcctgcggggcgagagatcgaggcctgagctagggtctggtggcggagatgtcgacgccggcgaggaagcgcctgatgcgggacttcaagcgccttcagcaggacccgcccgccggcatcagcggcgcgccgtacgacaacaatatcatgctctggaacgccgtcatattcgggccggatgacacgccgtgggatggaggcacgttcaagctgactctgcaatttacagaagattaccccaacaaacctccaactgttcggtttgtttcgaggatgtttcatccaaacatctatgcggatggaagcatctgtttggacatcctacaaaaccagtggagccctatatatgatgttgcggcaatattgacctctattcagtccctgctgtgtgacccaaacccaaattctcctgctaactctgaagcagccagaatgttcagcgagaacaagc

SEQ ID NO: 54257 - DNA, 312 bp, Zea mays
  Clone ID: LIB3068-024-Q1-K1-D11
tacgcaccttttgatccacacgagaattctgttcgctttgagctcatcttacgacacctgcggtatggtttaactgatgtgccgacacatccaaactctccacctaacaatgtcttccgacccgatctgcccagctaagactgtccttcgacccaaaaggacgggcgatgccccgctttcgacccacggaataagtcaaataacgtttaaagtactggtatttcacttgcaccccgatgctaccacttatcctacacctgtcaagtcatttcacaaagtctgactatagtcaagcttaacagggtcttcttt

SEQ ID NO: 54258 - DNA, 482 bp, Zea mays
  Clone ID: LIB3068-024-Q1-K1-D5
gcaagccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggtggcgagag

SEQ ID NO: 54259 - DNA, 480 bp, Zea mays
  Clone ID: LIB3068-024-Q1-K1-D6
gcaagccatgtggaggagggctttagcgatggtcctgttcatggctggcgccgcggtgctcgcgggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggtggcgag

SEQ ID NO: 54260 - DNA, 355 bp, Zea mays
  Clone ID: LIB3068-024-Q1-K1-A12
gaattaccagctagacgtacgcgtacgcgtacgcgtacgcgtgcaagcctctgcttcagctgaccactcacgccacccggggatgggtacctgtgcatgttcctcgtgggcgcctaccaagaagttcctcggtttgtctgcacaacctcttcggcgggccgagcgttgtgcgcgtgtcccagtgcgactggccccactgtttcgccgtgacgcccgtccccgcaggcccgtactgtgccgacatgcttctcgcgatgcatcactagcccgaggtgatgtacgaagtgctgaagcagatgaccgactgcgccacggtcgtcgtcctcgcccgggccttcagcgcaatgccgtacct

SEQ ID NO: 54261 - DNA, 349 bp, Zea mays
  Clone ID: LIB3068-023-Q1-K1-G4
cccacgcgtccggtttgctggtccttagtggctatctaaaacacaagtatatatataggtgactgggatgagtactaccggacgtggacggaattcggtcctcctgatttttaagggccggctgcgtcgcatcttactccgttcgatgtgcggtgctctttcggtcgatggaccctaccttcggctgaaccgatttcaggggtggcgggccgttaagcataaaagataactcttttcgaggcccctcgtcggcgttttcggacttcctaacgtcgccgtatgccgtcacgtacttgctcgggaaatcttaacccgatttcctttcggttgacgctcgtgatcgcgctat

SEQ ID NO: 54262 - DNA, 428 bp, Zea mays
  Clone ID: LIB3068-023-Q1-K1-G5
agtgcatcgtggccagcggcctcgcccgccgctgcctcgtgcaggtgtcctacgccatgggcgtgccggagcccctgtcagtgttcgtcgactcctacggcaccgggaccatccccgacaaggagatcctcaagatcgtcaaggagaacttcgacttcaggcccgggatgatcaccatcaacctcgacctcaagaagggcggcaacaggttcatcaagaccgccgcatacggccactttggccgtgacgacgccgacttcacctgggaggtggtcaagcccctaaagaaggcatccgcttaagaatgtattgggaagttcactggacatgaggttcatcttcgtctggctctgctgatacctgcaaggattgctgctgctgctgcccctggatgtgtgtttgatcagtgactgtctgctctgctccat

SEQ ID NO: 54263 - DNA, 430 bp, Zea mays
  Clone ID: LIB3068-023-Q1-K1-G7
cccacgcgtccgcccacgcgttcgcccacgcgtccgcggacgcgtgggggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgaggccaccgtgaccgcgctctaggtacgaccagtagtaaatcatcgacagaggctagct

SEQ ID NO: 54264 - DNA, 268 bp, Zea mays
  Clone ID: LIB3068-023-Q1-K1-G8
cccacgcgtccggtttgctggtccttgtggttatctaaaacacaagtatatatatagggatcgggagctattttgatgctggcgatcatggttctaacgcccttggttttttgggcccgttcctttagctaacgattctgtttgttaatttcttcgggtttttttggagtacagtgatcatgaacctgtgctctaattgccacaaggggattattactcatcctgatcaggccaatctggtattcttcggttatttcttgaatttttt

SEQ ID NO: 54265 - DNA, 435 bp, Zea mays
  Clone ID: LIB3068-023-Q1-K1-G9
caagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccggtccttcgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggtgatagggctggcgga

SEQ ID NO: 54266 - DNA, 435 bp, Zea mays
  Clone ID: LIB3068-023-Q1-K1-H1
atcccttcgtaaacccttctctcttcttcccgcggcctgctcgttcgatctgtccagcagacttgaggttccgagcggccggaaaccagcggcaaacgtcggcatggcgctcgtattgcattctggggctggaaacaaaaatgccttcaaggcacttattgctgcagaatacagtggggtcaaggttgagttgaccaaggattttgagatgggtgtctccaacaagacccctgagtttctaaagatgaacccccttgggaaggttcctgttctggagactcctgatggccctgtttttgagagtaatgctattgcgcgctatgttgctcgcttgaaggatgacaaccctcttttcgggtcttcccgtattgaacaagcccacgttgagcagtggatggactttgctgcaacagaagttgatcctagtgttggatg

SEQ ID NO: 54267 - DNA, 55 bp, Zea mays
  Clone ID: LIB3068-023-Q1-K1-H10
ccgacgcgtccgcggacgcgtgggctgtacgcgtgggctaagttctagatcgcga

SEQ ID NO: 54268 - DNA, 428 bp, Zea mays
  Clone ID: LIB3068-023-Q1-K1-H11
cccacgcgtccgggttcatgaaaaactacggcagagtcgcccactctgcgctggcttagcgccggaacgatgagttctccagagtgctccatcagcaaatggagttcttctccagcaacccaagcgccgacacactcaaccgtctccgtggagaagtcagcgagatacacaccgtcatggtcgacaacatagagaaaattcttgacagaggcgatcgcatctcgctccttgtcgacaagacatccaccatgcaagacagcgcctttcacttccgcaagcaatccaagaggctccgtagagctctttggatgaagaatgccaagcttctagttgtgttgacagttgtcatagtagtgctgctctacttgatcatttctgctttctgtggaggcctttccttgtcatcatgcagatcatgagttacacac

SEQ ID NO: 54269 - DNA, 436 bp, Zea mays
  Clone ID: LIB3068-023-Q1-K1-H12
gcgtccgcgcacgcgtccgcgttcatgaaaaacttcggctgagtcgcccactctgcgctggcttgcgccgtgaacgatgagttctggagagtgctccatcagcaaatggagttcttctccagcaacccaagcgccgacacactcaaccgtctccgtggagaagtcagcgagatacacaccgtcatggtcgacaacatagagaaaattcttgacagacgcgatcgcatctcgctccttgacgacaagacatccaccatgcaagacagcgcctttcacttccgcaagcaatccaagaggctccgtagagctctttggatgaagaatgccaagcttctagttgtgttgacagttgtcatagtagtgctgctctacttgatcatttctgctttctgtggaggcctttccttgtcatcatgcagatcatgagtaacacacc

SEQ ID NO: 54270 - DNA, 367 bp, Zea mays
  Clone ID: LIB3068-023-Q1-K1-H2
gcgattcctctcccctcgcctcctcgtctccccctaggggatcgtcggagaggaatcgcaaagagggccgtttcatccgagttaaggaagccatggagcacaaggaggctgggtgccaagcccccgagggacccatcctctgcatcaataactgtggcttcttcggcagcgcggcgaccatgaacatgtgctctaagtgccacaaggagatgataacgaagcaagatcaggccaagctggctgcctcctctatcgacagcatcgtgaacggcagcgacgccgtcatggaaccggttgttgctggcaacaacacggtagtagcttgtgcccaagtcgagttgcaaacaatgaacgtgcagcagcccgc

SEQ ID NO: 54271 - DNA, 271 bp, Zea mays
  Clone ID: LIB3068-023-Q1-K1-H4
cagtccacgcgatcgctatttctagatctccagcggttgccctatgggatcgtctgtacatgcatcggactgaggcacactgcattgcagttaaggacgccatagtgcactacgagctaccgagccatcccttctatggacccatactatgtgtgaataactgtcccttcttcagcagcgcggccaccatcaacatgtgctctaagtgccacaaggagatgattacgaaccacgatcaggccaagctggctgcctcctctatcgacagcat

SEQ ID NO: 54272 - DNA, 215 bp, Zea mays
  Clone ID: LIB3068-023-Q1-K1-H6
gcgattcctctcccctcgcctcctcgtctccccctaggggatcgtcggagaggaatgggacagagggccgctgcatccgagttaaggaagccatggagcacaaggaggctgggtgccaggcccccgagggacccatcctatgcatgaataactgtggcttcttcggcagcgcggcgaccatgaacatgtgctctaagtgccacaaggagatgatt

SEQ ID NO: 54273 - DNA, 434 bp, Zea mays
  Clone ID: LIB3068-023-Q1-K1-H7
gtcctgtccacccactccctcctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgt

SEQ ID NO: 54274 - DNA, 193 bp, Zea mays
  Clone ID: LIB3068-023-Q1-K1-H8
atcgctagttctagatcgcgagcggttgccctatgggatcgtttttacatacaagggacttggacaaactgcattgcagctcggcacggcatagtgtatacgatccgaccgatcgatcccttttattgacaaacaaaacctgtgcacaagggaccttcattgaatgccctgcgcaccatcaacatgtctatct

SEQ ID NO: 54275 - DNA, 430 bp, Zea mays
  Clone ID: LIB3068-023-Q1-K1-H9
tcgcccacgcgtccgggcacacgaacaactacggcatagtcgcccactctgcgctggcttgggccgtgaacgatgagttctgcagagtgctccatcagcaaatggagttcttctccagcaacccaagcgccgacacactcaaccgtctccgtggagaactcagcgagatacacaccgtcatggtcgacaacatatagaaaattcttgacacaggctatcgcatctcgctccttgtcgacaagacattcaccatgcaagacagcgcctttcacttccgcaagcaatccaagaggctccgtagagctctttggatgaagaatgccaagcttctagttgtgttgacagttgtcataatagtgctgctctacttgatcatttctgctttctgaggaggccttttcttgtcatcatgcatatcatgagtcacaca

SEQ ID NO: 54276 - DNA, 529 bp, Zea mays
  unsure at all n locations
  Clone ID: LIB3068-024-Q1-K1-A10
tcgtctcgtgtcgagtcgacggtggttcaggaaactctgagtatgtcgccaaggggaagctgtactgagctggggagggcccgtcacgtggctcgcagccgcttggctcgacgccttagatgcttctgtgannagggttcgtagcttggtagcaacgccctgtcagggacccctgataagaatggtgaatcttactgcctgatgcgggtgcgaagcccagaggtaaatctctgagtggaggcttcgaagncgatacctgacagtgcataatcgtatcgtcatgactttgggtatatggggccgataagacttaatgcgaacccattcttagtagnnctggttccactcacgaagtcttcctctcagggaatagctggagtcccacaacgagtgtctagtcgggtaaaggccaatggattagtagtgcatcgggggccgcaacgtcccttcgacgtattctcaaacctttaaatagtgtaggacgggcgcggctagcttcggtgaagccgtgcncacggaatcgtggagc

SEQ ID NO: 54277 - DNA, 418 bp, Zea mays
  Clone ID: LIB3068-024-Q1-K1-A11
cggacgcgtgggttggaaatactctcgtgctcaagactgctgaacaaacccctctatcggctttgtatatctccaaattgttgcatgaggctggactacctgagggtgttgtgaatgtcgtttctggttttggccctactgctggtgctgctcttgctagtcacatggatgttgataagatcgcatttactggatctaccgatactggaaaaattattctcgagttggctgcaaagagcaaccttaagacagtgacactggagttaggaggcaagtcccctttcatcataatggacgatgctgatgttgaccatgctgttgagcttgcgcactttgccctgttctttaaccagggacaatgctgctgcgctggatctcgcacgtttgtacatgagcgtgtttatgatgagtttgtgga

SEQ ID NO: 54278 - DNA, 389 bp, Zea mays
  Clone ID: LIB3068-023-Q1-K1-G3
cccacgcgtccgcccacgcgtccgaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaagaaaaaagaaaaaaaaaaaaagggggtagctttaatataattcagagtttacttaatttaaaatggaaatggaataaaatttttttaaaggacaaaaaatcaaaaaaattggagggtttataaaaataagtcgtttgggaaaaaaacgggttgtaacgaattcagtttcttaaaaaaaaagccgcttaatgaacagttgaaaaaatcgaacaaggaaggattaaaaaccgtttgaagggtattttggacattaaaagg

SEQ ID NO: 54279 - DNA, 439 bp, Zea mays
  Clone ID: LIB3068-023-Q1-K1-D12
cttgtggaggtggagatgaacctagagtagaccaaaccctgcctggctgcttatgcccatctgtcagcagaggacttcaagaaggatttagagtgccagcggttggagcccacagataacacaaaccttgagcttgacaacactgatgagtttcgactcacccaaattgaattttcacaggatagctttatgacatgggcagctgaaaagattactgacgactgacgctgctctagtgcactctcggcaccattttggtacatgaagaaacaactgatctgtttttttgtgggacggcagtgaagtctgcaacaacagtggtctcgcttttgctttgagtagctctggtgcacataaaataatttatatgaaatatgaaaggctgaggaatcatgcggtaccaactgtggagtactgttcagtgtgagattggccttgg

SEQ ID NO: 54280 - DNA, 332 bp, Zea mays
  unsure at all n locations
  Clone ID: LIB3068-023-Q1-K1-D2
acgccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgncagcaccgncgncgacaggcgcgccgnctgcaactgcctcaagaacgccggcaggggcgtcagc

SEQ ID NO: 54281 - DNA, 251 bp, Zea mays
  Clone ID: LIB3068-023-Q1-K1-D7
cccacgcgtccgcccacgcgtccgaaaaaaaaaaaaaaaaaaaaaaaaaaaaaaaaaagagaaaaaaaaaaaaaaaaaaaaaaaaaaaaaaaaaaaaaaaaaaaaaaaaaaaaaaaaaaaaaaaaaaaaaaaaaaaaaaaatgaaaatataaatacacataattagataaagaaaaataaaaagaaaaaattgaaagttacagaaataaaaaaaaattaaaataaactaaagaaaaaaaacattagataaa

SEQ ID NO: 54282 - DNA, 425 bp, Zea mays
  Clone ID: LIB3068-023-Q1-K1-D8
cccacgcgtccgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaagctaaccagtacaccgctgcactgaatcccatcctctttcaggtcctcatcagtcctatgcttgggggaaccaccgaccagaaagttgtggatgagaacc

SEQ ID NO: 54283 - DNA, 321 bp, Zea mays
  Clone ID: LIB3068-023-Q1-K1-D9
acggttctagatcgcgggcggtcgctcgcgatctataactaggttctacatcacattcgggggctggttaaactcataatatgacagctcctttatttttaaacaatatgttcctctatagccaaacttacaaccaaacaatttgttacggttttataacgtcctgaattccaaaactcttatcctaaccaacttaatatgcttcgattacaacccacttaataaatctaacatcattaaaaataattctatttcaattacacctttacaacacacacttatcctacacatcttaattcatttcacattgtatcactacat

SEQ ID NO: 54284 - DNA, 351 bp, Zea mays
  Clone ID: LIB3068-023-Q1-K1-E1
gattagtaaactttgtgatatgtgaattgctcctttctatagatggctagttgaaccctgctggtcataataatctggatctgatttgctcttcatttacattgctaggcctagggattagggattgaattccgcaatgcttgacaaatagtgaagttcatactgttatccatgagcactgagcagtatctgccaagacttttttattctgtcgagaagtgataactattccttagatctgctaggtgtgtttggtgtgcaaagggttttgtggtgttaagtgttgcacttggctagactatagactatttaaagtgtgttgatcagagacgaagttgggagttgggacat

SEQ ID NO: 54285 - DNA, 164 bp, Zea mays
  Clone ID: LIB3068-023-Q1-K1-E4
cagacacatactccgacgcgttggctttgactgcaaaggtgccaatatgagaggtgagtctactttctacacttccagttagcaccaacacatacctaattaagcatgataataacgttcgtatgatatctatatgtgctgcttatgaggaaactacaaagcca

SEQ ID NO: 54286 - DNA, 354 bp, Zea mays
  Clone ID: LIB3068-023-Q1-K1-E5
cggacgcgtggggaaacatccacgactctcctcccaactgttttcctaaagcgaaatgataacacttcttaataattgtctatacgattgaagctgatttgattggtaattgtaaacaacttgtctttggatctttgaagtcaaacaaagtcagttggttgaaaaaaaaaaaaaaaaaaaaaaaaaaaaaaaaaaaaaaaaaaaaaaaaaaaaaaaaaaaaaaaaaataaaaaaaaataaaaaaaaaaaaaaaaaataaaaaaaaaaaaaaaaatgtaatcacttttaaaggttctaaattttataaagcttgcttgcctgataataaatttttttttccgtcccttaaattaa

SEQ ID NO: 54287 - DNA, 416 bp, Zea mays
  Clone ID: LIB3068-023-Q1-K1-E6
cggacgcgtgggcggacgcgtgggctcagattgggaaaggttcaagaggagatgttacgtatattgcctacacttgttgtgaacaaccggcaatatcgagggaagcttgagaggaaagctgtcctcaaagctatttgtgctggttttgaggaaactacagaaccaaatgtttgcctgagtgatgatatagagacaaatgagtgtctgaatgacaacgggggctgctggcaagacaaatctgctaatgtaacagcctgtaaggacaccttccgtggtagagtgtgtgaatgccccactttcaatggcgtacaatttaaaggcgatggctacagcaattgtgaacctgctggaccaggaaaatgcttgattaaccatggaagatgttggcatgaaactcgcaacggaaaaacattctc

SEQ ID NO: 54288 - DNA, 144 bp, Zea mays
  Clone ID: LIB3068-023-Q1-K1-E8
cagaaagatactgcaagccgttgatcttgccttcagcgatactaatgtaactgctgtgccaccgttgtcgccgcccagtttggacgaacacaggcatcatagtgaataataatgtcatacgtatgatatatatattttttgctc

SEQ ID NO: 54289 - DNA, 431 bp, Zea mays
  Clone ID: LIB3068-023-Q1-K1-E9
aaaatttccatctatgtgacaagtgtcatgcagaggagcagaatacagcacagaaggacaggcgtccggccaccacaaaacagaagcatgcattcgaaagaatggaggtacaacctcttccagagactgatgatggagatccgacaatggaaagtaagtattttgacagcaggatcgatttcttgaagcactgccaagacaatcaattccagtttgataccattcggcgggcaaagcactctacaatgatgattctgtattacctacacaattcaacctgctctgcttgccatcgtgccgtggaccaatgcttggtgtggccgtgcctagagtgcctaggctgcaccttttgtggtcaatgctataaacaaaatggtcaaggcttgcatattcatgaattaaggcataatgacactagagaaacttcacag

SEQ ID NO: 54290 - DNA, 283 bp, Zea mays
  Clone ID: LIB3068-023-Q1-K1-F11
atacatcatcctatgcacgtgtacatatataatttgagcttgtccaatacatgttatatccactataaaaactatattcttatacactctccttttcacaaaactaccttattattatcgctcatatagacatcttctacattcttctctacccttaaaaatctttcactcccaatcttcttactagattcttttaatcaactaagtctttaacaccccatgtacttacccctttcctccacaacctaatattaacttaaacactaaatatcaattacataac

SEQ ID NO: 54291 - DNA, 180 bp, Zea mays
  Clone ID: LIB3068-023-Q1-K1-F2
aaataaaaaaaaaaatactaaaaaccatttatatataataaaaaaaaaactaaaataacggctattggtaccattttaaactaccaatttaaacgaccactaatcttttaattattatcaccttacttcctcttatatatatatatcttgctctttataaaacttaaatttctttcaatt

SEQ ID NO: 54292 - DNA, 372 bp, Zea mays
  Clone ID: LIB3068-023-Q1-K1-F4
gcgtccgcatcccggcgtcgttcgccgacctgcccagcctccggtcgctggacctggggcacaggcagctgacgggcagcatcccggcggggctggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgtcggccggcccatcggcaaggtggacctgtcgtggaactacctcgacttcgacctgagccagctggtgttcccgccggagatgacgtacctggacctgtcccacaacctcattccgggcaccgtgccgctgtcgc

SEQ ID NO: 54293 - DNA, 420 bp, Zea mays
  Clone ID: LIB3068-023-Q1-K1-F8
gacctccactacaagggaagtaagtgccacagaatcatccccagcttcatgctccaaggaggtgacttcactctcggggacgggaggggtggtgaatctatctacggcttgaagtttgcggatgagaacttcaagatcaagcacactggtccaggccttctgtccatggccaatgccgggagagatacaaacggatcccagtttttcatcaccacagtgacaacaagttggttggacgggaagcatgtggtgtttggcaaggtgttgtctggaatggatgttgtgtacaaggtcgaagctgaaggccggcagagtggagagccgaagagcaaggttgtgatagcagatagcggcgagctgccgatgtgacggcgagctgaactgatgttccatcccgaagcatgatgataagaagttgct

SEQ ID NO: 54294 - DNA, 56 bp, Zea mays
  Clone ID: LIB3068-023-Q1-K1-G1
aaaaaaaaaaaacaataataaaaaaaatactaaattataacaaaaaataaaaaaaa

SEQ ID NO: 54295 - DNA, 228 bp, Zea mays
  Clone ID: LIB3068-023-Q1-K1-G10
cctcccttggtgggctaactccctaactcagctcatggcactcgcccatcagacgctaacgctcttacctaggattctgacttcgacgagctcagtcatcatctgatacaccgtatcttcactcaaatgcctttacaaataatctcgatcacacaaatctgttaatcaacggcttctctaccactctctataaccactattgcgaatcaaccattactattgtactac

SEQ ID NO: 54296 - DNA, 212 bp, Zea mays
  Clone ID: LIB3068-023-Q1-K1-G11
cactcgtacgcccacacgttctcgttcatgaaaaactttagcttattcgcccactctgcgctctcttagtccagttacaatgatttctggagagtgctccatcatcaaatgtagttcttctccatcaacccaagctcctacacactcaaccatattcttcgataactcaaccatatacacaccatcactttccacaacatatataaaattct

SEQ ID NO: 54297 - DNA, 338 bp, Zea mays
  Clone ID: LIB3068-023-Q1-K1-G12
gaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcaagcagctcgtgcagagccagcgcaggaagcgcgacttcgtcaacggggccgtcggcgcgttcgttgccggagcctctgtctgcggttacagaggaaagagtattcagtca

SEQ ID NO: 54298 - DNA, 436 bp, Zea mays
  Clone ID: LIB3068-023-Q1-K1-D10
gactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaagggccctgttcgtgagggtgacatcctcaccctgctcgagtctgagagggaggccaggaggctgcgctgaagccctggtggccttggatgtaattctgttaattttgttctatgtttgtcgaacttgccgtgtgaccttcacaacatctgctttgagatttactcagcctggattgcagttttattttatgttcctgctggaaagtgacttgccgagacatagttatcatt

SEQ ID NO: 54299 - DNA, 301 bp, Zea mays
  Clone ID: LIB3068-023-Q1-K1-G2
gccctccactacaagggaagtaagttccacagaatcatccccagcttcatggtccaaggaggtgacttcactctcggcgaccggaggggtggtgaatctatctaccgcttgaagtttgcggatgagaacttcaagatcaagcacactgctccaggcctcctgtccatgtacaatgccgtgagagatacacacggatcgcagtccgtcatgaccacagtgtcaccctttccgatggacccgacggatgttgcggacttcctgacgtcgtcggctggcgatacgttccggatcgtgaaatctt

SEQ ID NO: 54300 - DNA, 365 bp, Zea mays
  unsure at all n locations
  Clone ID: LIB3068-054-Q1-K1-E2
gaagcgctcgtcaatccccttgatggttgtgttccttgaancgccggtcgatgtccgaagcgattgctttcttgcgncgcctgcacccccttcttcatcttcgtacggcattcacttcccttctggcacccccggcgccgtctcaagacggttcacgaattgctacaacctttccgatttaatcgcgcgacgtctggggttcaagatgagtccacctgcttacctctcgttgacaccggtatcaaagtttgacctgttcacgtgccgaattggtgccaattacgcgtctggtggatctggcattctcaacaccacgggaaacgggacactcacgctgcaaaaacaaatcacgctgttctcgaaaa

SEQ ID NO: 54301 - DNA, 350 bp, Zea mays
  Clone ID: LIB3068-054-Q1-K1-E3
cggccgccccgcgtcgaaaaactaagaatctgaatgcttcgttgggctcggtagaacaatgtaaagctgaaaggaaccttcttgctgaagttgatagtgcttacatagttaagctctattattctttccaagacgaagagttcttatatctcatcatggaataccttcctggcggggacatgatgactttacttatgcgcaaggacatactaacagaagatgaagctagattttatattgcagaaactgtgcttgccattgagtctattcacaagcacaactatattcatcgggatatcaaaccagataatcttctattagatcgcagtggtcacctgaagctttctgac

SEQ ID NO: 54302 - DNA, 380 bp, Zea mays
  Clone ID: LIB3068-054-Q1-K1-E4
cgaggccacgcggacgcccacgcttactttctgttcctgcttgcttttgatctcaacccaagtcgtgcctccgctcgtgtcagtcgtctctccacgcaaccatgtctaggaagaagaccagtgatcccaatgaggagaacgtcacccttggacccactgtccgtgaaagagagtatgtctttggtgtcgctcacatctttgcatccttcaatgacaccttcattcatatcactgatttgtctgggagggaaactctggttcggatcaccggtggcatgaatgtgaaagctgaccgtgatgagtcgtcaccttacgctgctatgcttgctgctcaagacgtctcacagcgcttcaaggagcttggcattactgcactgcac

SEQ ID NO: 54303 - DNA, 432 bp, Zea mays
  Clone ID: LIB3068-054-Q1-K1-E7
cccacgcgtccgctactactcatcactcgccaacgtgcagagatcagggaagcggcgctcgatccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaggaacccgggcaacaccaacaacccggcgggctccgtggtgacggcggccaacgtggagaagttcccgggcgtgaacacgctgggcgtcttcatggcgcgcatcgactacgcgccgggcggtcagaacccgtcgtacacgcacccgcgcgccaccgagatca

SEQ ID NO: 54304 - DNA, 432 bp, Zea mays
  unsure at all n locations
  Clone ID: LIB3068-054-Q1-K1-F10
gtcgtcaccagcagggtgtcccggctcctctctagtttctaccccggcccccaacattggcctgatgctgctgccatgtagcccatcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgtgggagagaagatggtaatggagtgcgtgtgtatgtatgtgtatgcccaaggcgcgcgcgcgcggctctgggcgagtcacagtagagatgcaatatcatgtatccagtatctttcttacaacacaaacagtgagaaattattagtaaagtgtgcatngtggtgc

SEQ ID NO: 54305 - DNA, 363 bp, Zea mays
  Clone ID: LIB3068-054-Q1-K1-F11
ggcgtctactctagctcgacgcatcaggctccccctagtcgccacccctgccgctgccaaggagacctcccccgccctgcaaatcatctcacgaaggaggattcgagggctgatgcaacgggattcgagggctcatggttaggatggacgctcctgattccctacgaaagtggtttctattggccctaaacatgattgcgcaagcactatcaaggtgacaggaaaggaagcttctgcagcttggattgccaatagagtgaagcctatgttgattaaaaagccaaggcttggtgcaagagaaatgcagtatatgttggaggatcaattcacagtcactttgtcatataacaaggtctgggaaag

SEQ ID NO: 54306 - DNA, 392 bp, Zea mays
  Clone ID: LIB3068-054-Q1-K1-F3
cccacgcgtccgcccacgcgtccgttagctttggtgcagtttgacaacgaactctcgagggagatgaacgaagttgtaaatgaaattaggcgccagaggtgctcatacttgaggttaagactatgcagaaggggcgaaccatctggtgatttttttccggtcatttctaatagaggacaaggcacctggcgtcttctcctacgaggagtttctcgtgcatgtccacaggcagatccaaagcaagatgacctgagggccatgcgaatgcaaaggcaacatgaactgagggtcaggctggcaaatgcaaaagcaagatgacctgagggcccagatcctgtctgtagcatttcggtcagtagatggattgtaggtaccaaaacgagttcgatttc

SEQ ID NO: 54307 - DNA, 230 bp, Zea mays
  Clone ID: LIB3068-054-Q1-K1-F4
gaccacgcgtcgactcgcttgctcgctcgggcatttctctcgcgcgggagcgccatgtgagctcgggcggatctgatggcttgtgtgatctcctgcaggtaagaaaaagaggaaggcaagatgtctcaccgtaagttcgagcacccgaggcacggctccctcggcttccttcccaagaagcgctcctcccgtcaccgcggcaaggtgaagtcattccctaaggatgaccc

SEQ ID NO: 54308 - DNA, 371 bp, Zea mays
  Clone ID: LIB3068-054-Q1-K1-F8
cccacgcgtccgaaatggaagacagactctttgctgcctacaaagccacaactgagggcaggttcccagaagcactgaggcagttccttagcatcttacatacgattcctgtaatcgttgtagactcacggagagaagttgatgaagtgaaggaattaattgagatagtgagggagtatattcttggtctgaagatggaactcaagagaaaggaattgagggatgatgtgacccgccaacaggagttggctgcttacttcacaaattgcaagcttcagagaattcatatgaggcttgtgctttctagcgccatggctctttgcttcaagcagaaaaactatgctactgcagcacactttgcaaggatgctt

SEQ ID NO: 54309 - DNA, 395 bp, Zea mays
  Clone ID: LIB3068-054-Q1-K1-F9
cccactcctccgaaatggaagacattctcttgtctgcctacaaagccacaactgagggcgggttcccttaagcactgaggcagttccttatcatcttacatacgattcctgtaatcgttgtagactcacggagagaagttgatgaagtgaacgaattaattgagatagtgagggagtatattcttggtctgaagatggaactcaagagaaaggaattgagggatgatgtgacccgccaacaggagttggctgcttacttcacaaattgcaagcttcagagaattcatatgaggcttgtgctttctagcgccatggctctttgcttcaagcataaaaactatgctactgcatcacactttgcaaggatgcttcttgagaataaccctcaaaaagct

SEQ ID NO: 54310 - DNA, 417 bp, Zea mays
  Clone ID: LIB3068-054-Q1-K1-G10
ggggcgacccacgcgtgcgcccacgcgttcgtccacgcgtcctttcacttcttacgcggacgcgtgggccgccgggctgtgcgccgaccccgagacattcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccct

SEQ ID NO: 54311 - DNA, 287 bp, Zea mays
  Clone ID: LIB3068-054-Q1-K1-G8
tgtgaaaaccggatattaaattgtgaagggttctaaggatgatattaccatgcaaaatcctgccaccggggatatttcaatcccttattggatggcttgcttgtccactggtattggaactcggccattcgttggggaatttatgaaacaaattggccaggccaatcgccgtgtcttggctactgatgaatggctaagggtccgtgaatgtgatggtgtctatgcaataggtgactgtgctacaataaaccaaaggaaagttatggaggacatttcagaaatattca

SEQ ID NO: 54312 - DNA, 358 bp, Zea mays
  Clone ID: LIB3068-054-Q1-K1-H1
cttgagcaagctgaaagaagggacccgcatcttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacagtggaagtcgggaagcgtttctttccgcggtgttcgaaagtacttgacacgatca

SEQ ID NO: 54313 - DNA, 234 bp, Zea mays
  Clone ID: LIB3068-054-Q1-K1-H4
acccggccgaccacgcgtccgcccacgcgtccgcccacgcgtccgaaaatatattatttaaaaaaaaaaaaaaaaaaaaaaggggaaagttaaatattagggtggccgttttaaaagatggcgggctgctttctcgtatcataccatttaatctcctttatgttacgtcacataaattctattgtgtggccgaaattttacaaaatagcgaccggtaaaaaactggcggaccgg

SEQ ID NO: 54314 - DNA, 352 bp, Zea mays
  Clone ID: LIB3068-054-Q1-K1-H6
cggacgcgtgggcggacgcgtgggcggactcttgggtccgcatccccaaattaagccccgcgcgcaaggcagcattacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgttcctggcaccaagcgcctctggtggaggggaaacccgcaccagatgcaagctgcgcggtcagcgattgcgggacggacgtcatcatcgtcggcgccggggtagctggatc

SEQ ID NO: 54315 - DNA, 431 bp, Zea mays
  unsure at all n locations
  Clone ID: LIB3068-054-Q1-K1-H9
cactcgtccgcccacgcgtncgtttactcgtgggcggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgagggggaccacaaggccgaggacgccgccgccgccgncgncaactgatctgctctagcttccggcggcggcggccgtgcgtgggctgctcgatccggtagtggcagtggctttgtgagacagtcgagtcgattgtggtttcccctcctccgccatgtgcgtgtagtggatgatgatgcangaataaacggtgtccctggatccagaactcacgggtcgat

SEQ ID NO: 54316 - DNA, 342 bp, Zea mays
  Clone ID: LIB3068-054-Q1-K1-E10
cccacgcgtccgtcccgctccgatcgaccttctccctccccaccaccgagcccatggcggaccatctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaagacaccgactctgaggaagagctcaaggaggccttccgtgtgtttgacaaggacc

SEQ ID NO: 54317 - DNA, 294 bp, Zea mays
  Clone ID: LIB3068-054-Q1-K1-B3
cccacgcgtccgcccacgcgtccgcggagtgcgagccagccggcgagctacaacccctgtgatgcagccgcgtctgccccgatgatgaccaccatggcgccggcgatgcacgatccgttctacgcctcgaacgggtacgcggcgccgcacggcgtgcagatggcggcgatggctcaccaccagcagcagcagcaggttttcatgctgcagcagcagatgatggcgccggcgccggcggtccaccacccgatgcagatgcagcagaaccccgcgaaccctttcggcaaccccttc

SEQ ID NO: 54318 - DNA, 378 bp, Zea mays
  Clone ID: LIB3068-054-Q1-K1-B4
cccacgcgtccgcccacgcgttcggccaactcgtcgttcaagccgtccgggaaaaggaccggggtgggttgggttaattctaaccgagttgagcagtgtgcttagtgctactggtttctgcctggagagctgatcaaaggatatctgtagcgtgttgttatctgatctgaaagggagtgcttgacctccaacgttgttcaactcgattttgctagcgtttcagtagggtttttctagacttgcaaacgttatgctttcgtcagattctgaagcgtctgcatcctttcctttttcatctatgtactggggctcttgtgtgtgactggaaattcgttaccaagttgctatgctggaacatggaaaagaaaaaaaagagat

SEQ ID NO: 54319 - DNA, 448 bp, Zea mays
  Clone ID: LIB3068-054-Q1-K1-B6
tgtgcctccgcctctgccaccgcgccgaccgtactgcactgagaagaaaccgaatgtcaagagttcgcctgttggtggaagaaagacaaaggcctcagctccacactggcactgaccccattatctaggatcctgcagcataactctgaagccgtgaaggtaaaagctatgcgtctgacgtgacctagaaggctgcatccatcaagcaacgattgatgttatctattgtagcttaccagcagtcttgtgacttgtcacctgtgttagaataaaccgagtagttagtgtatgtagcaacgcgtagcatatatatatatatatatatatccactaatgtctaattgaaccgtagtagaactgccctggatttaactagaacattgtatatacctggaataattggaagctgagtatcgaaccaggagttatccgcacggttttgcaggtc

SEQ ID NO: 54320 - DNA, 400 bp, Zea mays
  Clone ID: LIB3068-054-Q1-K1-B8
acgcccacgcttacagatacccattcctgatgtctatcaatggagctacaaccttttgcctgggttctgttttgccaggagctgctcaaggacgcaagggtccaatttttgaggaagggtcaggctttcagtcagcattcaagcttttccatggccgagatggaatagttcccctttcagaaagatcatatgtatctgatgaaaaccacaatgagagcattgatgtcaggactgaacctgctctgccgtttaatccattggctgctagagcagccacaataagtctatcagcatttggaccatttggttttggcttcttcaacggcaagggcaaaatgcaaaacaagaaacccaacaatctatatcagtcccaccagaagcccaagacaccaaatcagtc

SEQ ID NO: 54321 - DNA, 230 bp, Zea mays
  unsure at all n locations
  Clone ID: LIB3068-054-Q1-K1-C1
gaaaaaaaaaaaannnnattccatttttaccttttttttctaaaaaaaaaaaaaaaaaggaaaggtaaaatttaaaaagggggggggggggcctcccaattaaaaaaacccaaattcccgtgcccgcgaatgcaaaactattttttttgtttaccgaaaccaaaattaaatgcacgggccttacaacaacaacaccgggaaaaccaaaaccctacccaaaccaaacttaa

SEQ ID NO: 54322 - DNA, 274 bp, Zea mays
  unsure at all n locations
  Clone ID: LIB3068-054-Q1-K1-C10
aaaatctcccactcatcccacacccctcaantcattttacaaatttcacccttgattcaacctcaacaatttcttctttcccctcttattacttcaatcccattcccttatctaaaatttcactttatactttacatcttacctttcaatcttattaattcattcattcacttcatttattttattacctttcatttttctaccttaatattactatttattctttccatccatttacccattctttttttttattttcttcaactttttcaat

SEQ ID NO: 54323 - DNA, 233 bp, Zea mays
  unsure at all n locations
  Clone ID: LIB3068-054-Q1-K1-C3
cggacgcgtgggtctctatatcgcgagggccgcccttttttttttttttttttttttttgggtttgttttttttttattttgtttaggtaatnataaattntattttttttttttttttttccccggaaaaaacccacccccccccccccggggacaatttaaaaaaaaaaaaaaccccggccccccaaaaccaaaattccaaccccccaaaaaaaatttcacattttttttt

SEQ ID NO: 54324 - DNA, 168 bp, Zea mays
  Clone ID: LIB3068-054-Q1-K1-C4
tttatagggaaacaaaaggtaaaaaacattgggttggcgtaaaaaaaacatggtgacttgaaaaaccattgttttacctaaaattaagaggccagaagaaaataaacccttcttgccagctcactctttttcaaaaatgccccccccaattagaccttcccaaaaatt

SEQ ID NO: 54325 - DNA, 82 bp, Zea mays
  Clone ID: LIB3068-054-Q1-K1-C7
ctagttctaggcggccgcccgcgttctaattcgtttcccttaagattacctgaggccacggcgagttctatcgggtaaagcc

SEQ ID NO: 54326 - DNA, 427 bp, Zea mays
  Clone ID: LIB3068-054-Q1-K1-C8
gagagagcaataggagttttgaagtagcgttttctcattctaaaagttggaacacaccacgcaattaggaaccaagtgaaaatagcagctgcggcagtgttgttccataatattatacggatgcacaacggggatgaaggttggttgaatagccaaacaagtaacatatcgccagaaacttttgttgatcttcctggaggagacaattactatagcaatgatgttgtgtcacttaatagccaagtggataatgggaactctgttagagatatgattgcattgaatatgtggaatgattatagtcaacatcgttcatgatatatcaagaatgtttggaagaggatctcctaggatgaacttgatccaagctgcaactatgaaaaaaatatcccccagatctactactaacaagcgcaagaagagaaca

SEQ ID NO: 54327 - DNA, 448 bp, Zea mays
  Clone ID: LIB3068-054-Q1-K1-D11
cccacgcgtccgcccacgcgtcctgaggactccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggtgggctggtacttttgtggtggttattttttttggacctcgtgatagtcggtcggttccatgttatcgcggctactggcaaaccttaagtgat

SEQ ID NO: 54328 - DNA, 443 bp, Zea mays
  Clone ID: LIB3068-054-Q1-K1-D12
cccacgcgtccggtcatcctcgtgtcttgtacaatttggtgtgagagaaactcaggaatgtttgagcacaaagagaagaccgtgacacagactatagcgatcattaaggagcaaatccgcctgtggattctaggaggagcaaaacacttagcaaggctgttgtaggttttagggaaggggaggggttggttttgaaacatttgtgtcaccatacttaatgtctccttcactagtgtgatgtacttgtatattttagtcctcgctgcttcaccttctttttaatataacagacaattctcttgccagatttttttttaaaaaagaaggcaggaacgtgatactgcccagaggggccagggactccttttagctagcctaaatgcgtgtcactctccttgctgtagctgattgcagcttccatgtgttcctgattgctaaatgct

SEQ ID NO: 54329 - DNA, 122 bp, Zea mays
  Clone ID: LIB3068-054-Q1-K1-D3
ggaatgtttagaaaccgggagagtagcagtcttacatataacacaagaaatgtactcgtagtgccgttgctgacagaatacttcattagtacagttgctatgaataaagaatcttcagccac

SEQ ID NO: 54330 - DNA, 434 bp, Zea mays
  Clone ID: LIB3068-054-Q1-K1-D6
cttccccgtcgaccatcatcgcctccccatatttggacctaagccctcgcggacgtgcgcgccggccgcctggttgccggtcgaatccgccctccagccgctgccaacgtcgatctgctactgacgcaccgcaagggagcatttagctgtagtgagatggatatcctttatcagtgtaaggaggttttgaagatccagaagtttcggcgtatggtgtcatatgctggattctactgcttcacttccctcattacttatgcttacacaagcaatacgacaagggctgggatgtcaagggctgaccagtattattcctcctaccctgctggtactgaactactaactgacactgcaaagctttacaaggctgcattgggcaattgttttgaagtagatgaatggggcccaatagagttctccatcatggcaaaaca

SEQ ID NO: 54331 - DNA, 456 bp, Zea mays
  Clone ID: LIB3068-054-Q1-K1-D7
gccacgcgctcaactccacgggccttgagtctagggttttcttcgccgctacctccctacgaggcgggcgtgcagccatggcgctggtgcatgcgggcatgggccttacccgggtcgttatcctcgtcggcgccggcgttgccggctccgtcgtcctccgcaacggccgcctcgccgagatcctcggcgagctccaggagatactcgacaaggggaagaaggtgaaggatggaggagggggagacggggaaaccgatctcaacgaggctcttacctcgcaggtgcgtcgccttgccatggaggtccggcaacttggtaattcacgttcaataactgttctcaatggaggttctgcacaatcaggagtatcaggcctgatagtacctgcagcaactgtaggagcactgggttacggttatatgtggtggaaggggatctcgttctcagatctaatgg

SEQ ID NO: 54332 - DNA, 355 bp, Zea mays
  Clone ID: LIB3068-054-Q1-K1-D8
ccactcttcctcttactctttttccgactcgtggttttactcttgggccgacgcgtgggaaaaaaaaaaggagaaaatttaaaaaaaaaaaaaccaaaaacaaaaaaaaataaaaacttacaaaaatcggcatcctacataaacaacacacaattataagttcccttttattcaacaacatactcctttaataaatcccccttaactcaattgtctgtcctctttaaaaaaaacaaactccctggaaatacccttcctttacccatctttctttctttccaacacttttcccttttatgccccttccttttaacctataatccccgaaaatacctttttttcccccattttctcc

SEQ ID NO: 54333 - DNA, 454 bp, Zea mays
  Clone ID: LIB3068-054-Q1-K1-D9
cgtcgcaccaaatatggtcagctggttgtgttctagctgagttgcttcttggacagccacgatttccaggagagagcgctgttgatcagttggtagagatcatcaaggttcttggtactccaacccgtgaggagatacggtgcatgaatcccaactatactgagttcaggtttcctcagataaaggctcatccatggcacaagattttccacaagagaatgcctcctgaagccatagaccttgcttcccgtctccttcagtattcaccaagtcttcgttgctctgctcttgacgcatgtgctcatcccttcttcgatgagctgcggacaccgaatgcacgcctaccaaacgggcgcccgttccctccgctctttaacttcaagcacgaactagcaaatgcctctccggacctcgtcagcaggcttgtgccggagcacattagacggcagatcgg

SEQ ID NO: 54334 - DNA, 374 bp, Zea mays
  Clone ID: LIB3068-054-Q1-K1-B2
cccacgcgtccggagaaatctgccaaaggcttaagcctccttaactgctgctagaacagcagcaagtgccatttatgttccacctgctcagcaaggcactattgatctccagagtggaatcctccatgctgaagaaaaagattacaagactgcttacagctacttctttgaagcatttgaagctttcagtgcactggaagacccgaaagccatctttagcctgaagtacatgctcttgtgtaagataatggttaaccaagctgacgatgttgcaggaataatctcgtctaaggctggcctaaaatatctgggtcctgatgttgatgctatgaaagctgttgctgatgcatactctaaaaaatctctcaagtatt

SEQ ID NO: 54335 - DNA, 298 bp, Zea mays
  unsure at all n locations
  Clone ID: LIB3068-053-Q1-K1-H12
accgggactcgaatcgtcgggtcgagccagcgtacggagaaagatggcccaccggaggtgaccacatccaccatggagaaggacgacggcatgcctgacagatgccatgatgctacccagaaccagaaagaggcttcaggtcacgctggggccgcagcagatgcaacgggtaggccgcatcggngcagccaagcttcccctgaaaaacatacaggtccccaggtggtggtgaacgacaagttctgggagcagttccttaccgagaggccgggctgtcccgaaacccgagaagcaagct

SEQ ID NO: 54336 - DNA, 113 bp, Zea mays
  Clone ID: LIB3068-053-Q1-K1-H2
ccggacgcgtgggcggacgcgtgggtgagttgtcagtgttcttgttcttcaaactctcttagttcgttaattatgtgtatgcgtggcgtggataaaggttcgagagattcgtt

SEQ ID NO: 54337 - DNA, 450 bp, Zea mays
  Clone ID: LIB3068-053-Q1-K1-H3
attctgtgtctgtcgtcgtgtgcctgggtctaccagcgacctggctagctagctctacaggtgcccgcgccatggccaacccaacagctactaagcatgctttcaagcgtatttcgacgagcctgcttaagcctggcggtggtgaatacggcaagttcttcagccttccggcactaaatgatccaaggatcgataagcttccgtactctatacgggttctcctggaatcagctatccgccattgtgataacttccaagttacagagagtgatgttgagacaatcattgattgggagaacacatctccaaagctggctgagatacctttcaagccagcgagatgcattctaatggacaacactggagtcccagcagttgtagaccttgcagctatgcgtgatatgatgccaaagctgggatgcgatccctacaagatcaatccattgattc

SEQ ID NO: 54338 - DNA, 316 bp, Zea mays
  Clone ID: LIB3068-053-Q1-K1-H4
cggacgcgtcggcggacgcgtgggctagctcttcagaacttgcggacgaaagactgaccgggcaccgctagcggatcgatcgaccatggcgtcgtcctctcttctcctcctcgccgccgtcgccctcttcgccgcctccgcagacgcggccaccttcaacgtcatcaaccgctgcaagaacacgctgtggccggccgccctccccggcggctgcgcgcgcctggacccgggcaagacgtggaccgtgcatgtgccgacgggcacggtgcacgcgctggtgtgggcgcgcacggggtgcagcttcgacggcagcatg

SEQ ID NO: 54339 - DNA, 357 bp, Zea mays
  Clone ID: LIB3068-053-Q1-K1-H5
aatagttgcaaactgctagctcggtctgtacattctacagttgctatgggcgtactgcgatggtctcgtaagtttggcgagatgatcaaccaatatttgcatgatatatgtatcgtgttccataacgtaaggttatcacagtctgctatcattacctgaggtgactataacatcaccagactacttcaactcggctaccccaaattaaaaccactggcttttcaatcaaacgcgatgaccaattgtgtgaatcaacgagttcctataatgctaggccgatttactatatccaagcttaccttcactagcatgcaactaaattgctttactacagtctaacctacatctaatgtactg

SEQ ID NO: 54340 - DNA, 459 bp, Zea mays
  Clone ID: LIB3068-053-Q1-K1-H6
cccacgcgtccgaccactcgtccggttcggagccgacggcccgtccgggtccctctccgcgggccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaagcaagaacttcatgattgatttcatgatgggcggtgtttcagctgctgtttcaaagactgctgctgctcccatcgagcgtgtgaagctgcttattcagaaccaagatgagatga

SEQ ID NO: 54341 - DNA, 449 bp, Zea mays
  Clone ID: LIB3068-053-Q1-K1-H7
cttctctctctctcgtcgtgtgcctgggtcgaccagcgacctggctagctagctctccaggtgcgcgcgccatggccaacccaacagctactaagcatgctttcaagcgtattttgacgagcctgcttaagcctggcggtggtgaatacggcaagttcttcagccttccggcactaaatgatccaaggatcgataagcttccctactctatacgggttctcctggaatcagctatccgccattgtgataacttccaagttacagagagtgatgttgagaaaatcattgattgggagaacacatctccaaagctggctgagatacctttcaagccagcgagatgcattctaatggacaacactggagtcccagcagttgtagaccttgcagctatgcgtgatatgatgccaaagttgggatgtgatccctacaagatcaatccattgatt

SEQ ID NO: 54342 - DNA, 442 bp, Zea mays
  Clone ID: LIB3068-053-Q1-K1-H8
cccacgcgtccgtccactcgtccggttcggtaaccaccgacccgtccggctacctctccgggtgccgtccccaatgccaatagttctcaagtgtcaatgtcggaccaggctaaccaacccactgttcttcataagctcggaggccagttccacctgcactcgatcatctctgaaggtgtacgggcccgtaacatatgcccatctgtctcatcttatgaaaggagatttgccacaaggaactacatgacccagatcctttgcggcccttcaatgtctcttaccggtggcatcaatgtcccagtgatgcacaccccactctgtgctaatgctcctgctgagaacggacgcaagaacttcatgattgatttcatgatgggcggtgtttcagctgctgtttcaaagactgctgctgctaccatctagcgtgtcaagctgcttattc

SEQ ID NO: 54343 - DNA, 353 bp, Zea mays
  unsure at all n locations
  Clone ID: LIB3068-053-Q1-K1-H9
caggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctnctnccgagccttgcctacctcaacaagcagcccgtgaagccgcagcgcatcgcgcgggaagtggccacggacagcatcgcgcgcg

SEQ ID NO: 54344 - DNA, 256 bp, Zea mays
  unsure at all n locations
  Clone ID: LIB3068-054-Q1-K1-A1
cacgcgtncgcccacgcgtccgatgtggttgaggtctntagcgatggtcctgttcatggctggcgccgcgctgctcgccggggctgccggcgccngcgcgcatcatggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcag

SEQ ID NO: 54345 - DNA, 466 bp, Zea mays
  unsure at all n locations
  Clone ID: LIB3068-054-Q1-K1-A10
caccggnctcggaatacccgggctcggacccacgtcgtctcgtcccatcgcgtctctgcccacgtctgtccgtgttacaatgtgtaggtgcatcaccgtccgggaccaagcatgcggcgtgagtttttgtccggtcaagcagcatcgaggaccggtgcgcacgtctggtccgactaccaacatttcagtaaggatgagcaccgctccacgttggtgcctgcgtctcaggggtcggcatggcagatcttcgtgaagacacattactggcacagacgatcaccgcttgagggtggagtccctccgacacacattgacatacgtcaaaggccatagatccaaggacaatggaggtgcattgcacacggaccacgcagcaggctgatcnttcgccggcaaagcatctggaggatggtcgcaccttggctgactacaacattcataatgagagcaccctccacctggtgct

SEQ ID NO: 54346 - DNA, 367 bp, Zea mays
  Clone ID: LIB3068-054-Q1-K1-A11
tccgtccgtcttcatctttatccgagagttcctgtgcagtcagtgtgaaaagaagccacgattttagcacgagcgagcgaggggtctggatgaagtcctctcccaagtcttcgatatcgtctatgtcagcccagtcaaaggtgtatcgccgacacggtcggtcgcaacacctctccgagactgtcattcgatcttctgcaagggtgaaccaagatccgatttcgaggagagtcaacgggtggatcttgttcaaagtctcaagcaccctcacaacccgaattcaaaaataatataaccccatgggacaaggtgacccgcaatttgttgatggaaagattcaaaactatttgaaaagtcatgccgattt

SEQ ID NO: 54347 - DNA, 304 bp, Zea mays
  Clone ID: LIB3068-054-Q1-K1-A12
cggacgcgtgggcggactcgtgggctccatcttacaccccttcgccaaagcctccgacaccgaagcctaccccgccgacgtacaccccttcttccaagcctccgacgcccaagccgaccccgccgacgtacactccaagccccaagccttccacacacccgacgcccaagccgaccccaccgacgtacacccctttcccaaaaggctcgacgcccaagccgaccccaccgacgtacacccctttcccaaagccttcgacacccaagccgaccccaccgacgtacacttccacaccgaagccggc

SEQ ID NO: 54348 - DNA, 162 bp, Zea mays
  Clone ID: LIB3068-054-Q1-K1-A3
cgacccactcttcctctttctctttttcggactcgtgggaaaattttttttttaaaaaaaaaaaaaaaaaaaaaaggaaaggttttattttatatattaggtgtcctttcaaacgcccccctccataaaaatacaataacttttaaaaacattcactttaat

SEQ ID NO: 54349 - DNA, 419 bp, Zea mays
  Clone ID: LIB3068-054-Q1-K1-A7
cggacgcgtgggcggacgcgtgttctccatcttacaccccttcgccaaagcctgcgacacgcaagccgaccccgccgacgtacaccccttctcccaagcctccgacgcccaagccgaccccgccgacgtacactccaagccccaagccttccacacacccgacgcccaagccgaccccaccgacgtacaccccttccccaaagcctccgacgcccaagccgaccccaccgacgtacaccccttccccaaagcctccgacacccaagccgaccccaccgacgtacactcccacaccgaagccgccggccaccaaagccgccacctacacttcgacgccgtcggtgttttacacccccagcccggccgcaccatactactagaaagcgatgcctaccataccacactgctgtcagtctctg

SEQ ID NO: 54350 - DNA, 189 bp, Zea mays
  Clone ID: LIB3068-054-Q1-K1-B12
aaaagtgcataaaaattatattgccaattccattttaattatattcttttttctgaatgggaataaaaaaaagaagaaaattctggttttttctttccaaaattcgatataggctgaaagacaatcagatcttttttctcttcagcgggcagttccatatagaatttgttagaataaaacaagcgggtt

SEQ ID NO: 54351 - DNA, 205 bp, Zea mays
  Clone ID: LIB3068-053-Q1-K1-H10
cgtgccgtaagtttctgattccaagcctgagtcttcgagtggtctacggagcagatccgatgttgttaccgtcagagttgacttgcaatcttagctcctgaacctggcggttaccgtggatcagagttcctgttgaatttcacaaaagcctacttgttcctaatagattgctgcaaccaacaatattacgaccctttcgggcttt

SEQ ID NO: 54352 - DNA, 143 bp, Zea mays
  Clone ID: LIB3068-008-Q1-K1-E11
gcatactataatgttactagacagagatagttatccaataaaaaacaaaatataaaaaggaacggttaacatataacacaggaacttcaacataaactatatcctccactctcctcaactactctctaaaacctactactctc

SEQ ID NO: 54353 - DNA, 223 bp, Zea mays
  Clone ID: LIB3068-008-Q1-K1-E12
ctcccacactccttacctcatttgctttaatatcatcattcacaccttatggggctggttttaaaatagggtgggcccatcctactccatccacccaaccaaagtttaccacatcatatcctatttctcaagaacatcttccaacatcatccacaccaccatcctttctctcctctccatcatacatacatcctactccatccttctaccctaacctctcttc

SEQ ID NO: 54354 - DNA, 450 bp, Zea mays
  Clone ID: LIB3068-008-Q1-K1-E5
gatatttggtgccatctcactattggtgttgtctattattcccctattcaatggtttttgcttaggaatacctatggtcagcatgctcctttatgtctggagccgagagaatccaaatgctcagataaatatatacggcctcgtccaattgaggtccttttatcttccatgggctatgctcttattggatgtgatatttgggtcatcattaatgcctggacttctgggtatcatggttggacatctctactacttctttgcagtgttgcaccctcttgccaccgggaagaactacctcaagactcctaaatgggtacataagattgttgctcgattcaggataggcatgcaagcaaactcacccgtccggccaccagccaatggcaacagcgggtctggtgtgtttagaggaagaagctataggctcaatcaatagattcactgattcat

SEQ ID NO: 54355 - DNA, 330 bp, Zea mays
  Clone ID: LIB3068-008-Q1-K1-E6
cccacgcgtccgaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttggatccttttaaatattcaaactttaccttcaattatattaaatttattattttttttataaaatcccttaaattgatttaattatctaatttttcaaacttttaaaactttttaaaaaatttgcattttacctattttaattttttataaaattttccccttttttcaattttt

SEQ ID NO: 54356 - DNA, 453 bp, Zea mays
  Clone ID: LIB3068-008-Q1-K1-E8
cccacgcgtccgcccacgcgtccgcccacgcgtccggaagaaagagaccgagatctcggggatagctagcatcatggcgtccaaggcgctcctcgtggtagcgctcctgctcgccgccaccttcctcgccgcctccgctaacgagcaagcccaggcggccaaagaggagaagaaggcggaggtccaagactggcacggcggcggcggctacccggggcacggcggcggcggcagcggaggctacccggggcacggcggcggcggcggcggcggctacccgcactgccggtggggctgctgcaaccgcgggtaccatggcggctgccggtgctgctcgcaccctgatcagataccagagcccatgtaccgtcctgagctcgtcgaggtccacaactaaatagtaatgagatgcgctgctactatatatacgggtacgtatgcccgatgggaagc

SEQ ID NO: 54357 - DNA, 377 bp, Zea mays
  Clone ID: LIB3068-008-Q1-K1-F1
cccacgcgtccgcccacgcgtccgcccacgcgtccgaagatgattcccactaagcccatggtggttgagaccttctctcagtatcctcctctgggtcgttttgctgtccgtgacatgaggcagacggttgctgttggagtcatcaagagcgtggagaagaaggacccaactggtgccaaggtgaccaaggctgcagtaaagaagaaatgatgcgtcctctcatgtgccctcgtttattttgtacttgtgcccgtatacttcgatctgttaaaatctattggttgtgtgccctgtgtctgttgtttgggtatctatactgttattttgagacatgttgacttgcatggtcatctggattgggttcgcatttctgagtc

SEQ ID NO: 54358 - DNA, 298 bp, Zea mays
  Clone ID: LIB3068-008-Q1-K1-F10
gcagtcaccactcccaagccagtaccgagtcctacgagcagtcgcacgcaagtgtcaggagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaaccttaagagcgccggcagcaccggcgtcgacaggc

SEQ ID NO: 54359 - DNA, 363 bp, Zea mays
  Clone ID: LIB3068-008-Q1-K1-F11
gccacgcgtccgcgcctgcttcttcccccagaccaaagacacgaatcagccatggcgctggcctgcgccacgtcccggcccgtcctcggtcgccccgccggcaccgcgcggccccacctcgccgtttcctcatcctcccccgcctcctcgatccgcttcccccgcggcgccgacggcggcgccagcagagcggccgtctctctccgcgcccccacgcctccagtctgtgaccccaaaagccttcttttcatgtttggaatggagctggactacagcgacgccctcattggtggcggcttcttgttccagaatccaaacgcaccaaaaacctgtgggtgcggcaaatctttcgcgactggaaag

SEQ ID NO: 54360 - DNA, 421 bp, Zea mays
  unsure at all n locations
  Clone ID: LIB3068-008-Q1-K1-F2
cggacgcgtgggcggacgcgtgggctccccggccgcccgtctctcccgagctaaactgtggcaggcggctagctgttacgagctagctccgcgcgcgctaggcggcgtcacgtacgtgctgtgatcaactgtctagttctctactcgacgcggacaccctgacccgcgcgcgcgccgtggccatggtcgccgccgccgccgccatcctcctggtcctgcccgtcgtcgccgtcctcgcgtcgtcgtccgcggcggcggacgggtcgttcataacgtgggacgacctcagcaccccgtccgccgccgncgtgcagggcggcgtgaaggcggccagcgggggaggcgcccgcgagctggacacgatcgtggtggcgcaggacgggacggggcactcgcgcaccgtgcagggcgcagtcgacat

SEQ ID NO: 54361 - DNA, 333 bp, Zea mays
  Clone ID: LIB3068-008-Q1-K1-G11
ggagaaccgagagcagagagacatggcgccccaccaccagcagcgggcgctgctcctggtccgactcgtcttcctcctgctcctccttgccccgcccctcgccggcgcgtggggaaaggagggccacatcatggtctgcaagatcgccgagaagtacctgtcggagaaggcggcggcggcggtgaaggcgttgctgccggagtctgcagtcggagagctgtcggcggtgtgcccgtgggcggaccatgtgcgctggcactaccactgggccagcccgctccactacgccaacaccccccaagtctgcaacttcaagttttctggggactgcca

SEQ ID NO: 54362 - DNA, 313 bp, Zea mays
  Clone ID: LIB3068-008-Q1-K1-G12
cggacgcgtgggaaaaaaaaaaaaaaataaattaaaaaaaaaaaaaaataaaacaacggaaaggtaacataactaaagatagaacaaaaaaaatctaaataaactactactaaatacatacccctattcacacactacgtcatcaaccatctattccacaccaatgccaattaccttccctttatcctattattactcaacgcctctaactcacaatccaagctatctaccactgcctctgctcggaccacgaccacaaccaccttaaggcgttcgcgcttcacgtgcccttaccattacctcattccttcct

SEQ ID NO: 54363 - DNA, 193 bp, Zea mays
  Clone ID: LIB3068-008-Q1-K1-G2
aaaaaaaataaaaaataaaaaaaaaaaacatacaatataaaaaataaaaaaattaaaacaagaaacaggcaaaaatataaaatatactataaaaaaacctaaaattaatttcacttaccgggccttctcttctttttctctcttatttaccctcgcgtttccccacttaattacctttcttctcatccccctt

SEQ ID NO: 54364 - DNA, 422 bp, Zea mays
  Clone ID: LIB3068-008-Q1-K1-G4
ggcgaggccgtgtggttcaaggccggctcccagatcttcagcgagggcgggctggactagctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtg

SEQ ID NO: 54365 - DNA, 401 bp, Zea mays
  unsure at all n locations
  Clone ID: LIB3068-008-Q1-K1-G8
cccacgcgtccgctggtgtcctgtacatctcaagatgaaaaaaagcaccaccgtcctcggcatctccatcttggtcctctcccttgcctcccagttctcatggtgtgcagaagcagctgagggaagcgccggaatttccacagagcctgatctccaggtgcaagaacaagtgcacggcgatatgaaaaaccgcctggaaatgcagggtcgcaaccggaagcttggccatgaggtgaccacagtggagttgaagcatcacaggaggattaccagtgggcacaagggtggcagcgcgggtggaggcgccggcgccggtgccgcgggcgcaggcacgggtgggcataacgtgggcggcgggggcgccgtgacgaggccgtacagcttcaagaacggncgcggcg

SEQ ID NO: 54366 - DNA, 411 bp, Zea mays
  Clone ID: LIB3068-008-Q1-K1-G9
cccacgcgtccgcccacgcgtccgcccacgcgtccggtattctctacctacccacctgggtcggtttcgggtacaggtacgcttttgttgaaggtcgttcgagcttttcctgggagtatggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccttccgtaccaacaaggggtagtccaggaatattgacctgttgtccatcgactacgcttttcggcctgatctaaggc

SEQ ID NO: 54367 - DNA, 264 bp, Zea mays
  Clone ID: LIB3068-008-Q1-K1-H10
cccacacgtccggccacgcgtccgagaacagctgtcgatccaattgtcacttgctctggctggaacaagctaattaaggccggtccatccctcttctagctcgtttcattatccatggctgacgagaagcaccaccaccaccacctgttccaccacatgaaggacgatgagcatgccgcgacctgcgggtacggcgagtacgccgagtacactgaggccacggagacggaggtcatgttcactggcgagaacgactacgactag

SEQ ID NO: 54368 - DNA, 216 bp, Zea mays
  Clone ID: LIB3068-008-Q1-K1-H11
tttaaacccaggtagccctcttgacaaatcttttaccatttctgactatgataaacatccgacctgccacaacattatctcatctatgaacactcaaacctctcttcaataaatactgaatcacaactccctacaattctatccttcctaccaattttccttcatcatttctacttatcacacccattttccattccataaattcctacccatttc

SEQ ID NO: 54369 - DNA, 265 bp, Zea mays
  Clone ID: LIB3068-008-Q1-K1-H12
ctaattcccggtcgggggcgacccacgcgtacgcaactcccccgcaccgtaaccctagcagcagatcggccatggagagctgggctaccggtgtggggacaagcgttagctgcgccttcttcgcctccctcgagcgctgctcctgcatcaacctattcaccgacgactacgactacgacgaggaccacgactaggccaaagaccggtctctcatgctcgccgactacccacgccacgactacgccatcaagcccgatccagactc

SEQ ID NO: 54370 - DNA, 452 bp, Zea mays
  Clone ID: LIB3068-008-Q1-K1-E1
cttcttttgctccctgctttctctagctagctctcggctcatcagcgcgctcacacgatgggatcgacaactactaaagcagcaccaccatattaccaggccggcggccgtatgcgattacccggcaaattagcacccgggttctgatcatcgtcagcccttggattcattccatcctcgttccattggtacggtacggtggccaagctaattaagaagcccacacccagcgtcgtcgatcgtgcttgtgcttccaattgctatcttcttccacatgtctccttcaccggcgccaagcagcggctgcagcctagcagtactagtaggcggcacgagtactgcagggtcgtccaacaagttcaggcacgccatcctcaggaacctgctcctacggctcagcaacaaggacggcgctgcgtcgccgtcgtggtccagtgccatgagcctgcgcg

SEQ ID NO: 54371 - DNA, 234 bp, Zea mays
  Clone ID: LIB3068-008-Q1-K1-C1
cggacgcgtgggcttttcggagatctcgccgcctccgccgtcgacttccgtcgcccccgtgatcccgcgtccgggcttacccgatggcacggctgcactggcttgaggctgtcctgccgctggggatcatcggcggcatgctctgcatcatgggcaacgcccagtatttcatccacaaggccgcgcacggcaggccgaagcacatcgggaacgatatgtgggacgtcgccatgg

SEQ ID NO: 54372 - DNA, 387 bp, Zea mays
  Clone ID: LIB3068-008-Q1-K1-C11
acgctccgtgcggcgacgacggactgggcactcttcatcgccctccttttcctgcgctaggtacggctgaccaaccgctgggtcgcttcgtcacctcttctcctgcggcaacgatcacccaccatcttgatgctgattctttggttgacaatttcaacattactaccttttatgaccctgaggccaagaattattaatcctcccaggctcaaaggcattccaaaatctatcatccattattcaataatgccatcctcaacctatcgactagaacatgaatcagaacttggactcaatggacactgtgatcggcatgatattcaacaacatatcctctttaaaatccccctacattcaacttcatgaagccctcaccccatatgaccc

SEQ ID NO: 54373 - DNA, 275 bp, Zea mays
  Clone ID: LIB3068-008-Q1-K1-C12
cgcaaggttgcttgtatcggtgcatggcatccggctagggtctcgtataccgttgcgggtgcgggtcagaatgggtaccggcaccgcactgagatgaacaagaaggtctacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagagggtggtgac

SEQ ID NO: 54374 - DNA, 457 bp, Zea mays
  unsure at all n locations
  Clone ID: LIB3068-008-Q1-K1-C4
acgcgtccgnggacgcgtgggcgaggctcagaggcagggcaggatctcgttctacctcacttccaacggcgagggggcgatcaacatagcctctgctgctgctctcagcattgatgacattgtgctgcctcagtacagggaacctggtgttcttctatggcgtggcttcactctgcaggagtttgcaaaccagtgctttgggaacaagctggactatggtaaagggaggcagatgcccattcactatgggtcgaaccgtctgaactatttcacagtctcgtcacctatcgcaacacagctccctcatgctgttggagctgcctactctctgaagatggacaagaaggacgcgtgtgccatcacatactttggggacggtgggacaagtgaaggagacttccatgcagcgctcaacttcgcgggtgctatggaggcgccggtgatcttcttctgccgc

SEQ ID NO: 54375 - DNA, 284 bp, Zea mays
  Clone ID: LIB3068-008-Q1-K1-C5
gcttctacgagaggatatagagaggaagaacagctcgtccgagaccatgaagagcagccgacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacg

SEQ ID NO: 54376 - DNA, 455 bp, Zea mays
  Clone ID: LIB3068-008-Q1-K1-C6
aatccccgtgctgagagctgagtgctgccttggttgctccgtactggactcgaggcctcgtcgcagcagaagcatcccgtcccctccgcttctccttgctctgctctggtaacacacagacaaaaaaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaacccaaaggaccgctggaggcacttaggcccaagcttcagccaacacgccaacaacagcaacaacgtgcaaggcgccctatttacact

SEQ ID NO: 54377 - DNA, 417 bp, Zea mays
  unsure at all n locations
  Clone ID: LIB3068-008-Q1-K1-C7
gttcaccttccgggtgcagcccaaccaccccaacctgcaggaagacgagtagctacagcgtgctggatagtgttctgcatgccgctctgaactgaagctgcaggaagacgagtagctacagcctgctggatagtgttctgcatgccgctctgaactggagctcctcacctgcagcttctttctcgcgtttcatcattcagcgttagctggtgatgataatgttggggcgaaggcgaagacgctatcattcgctcgatgccttcgtcgccttcgtcgtctcgcttcaccaacgacgccaaagacgccggtccaatgaggacttcgcgactggacttcgtgggcgtccttcgcccttctccattgcgagacgaaggcaagactccgacgatgtctgctagcctcacgtnctcatcgggt

SEQ ID NO: 54378 - DNA, 401 bp, Zea mays
  unsure at all n locations
  Clone ID: LIB3068-008-Q1-K1-C9
tactcggtccgttgaattcccggggtcgagcccgacgcgtcacgtcccacgtccgtccgtcccatcgccgtctctgattctgttcagtaaggcttcgtgccttagtgaaatctctcgcgatctgtagnatgttagtgttgttgagtccaaaaaaaaanaaaaaangggccggcacgcttcttagaaaggatcctaagncattacgtnatcgcgtgccatgcngactgnntcatagctttcttctaattagtnggtcaccttaannattcatattcacttggcannngtcgttttaccaacngnntcgtgacctgnnggaaaactntnctggcgttaccccaaaacttaatcgccatttgcagcacaaaatccccctattcgccaagcttggcnnngtaata

SEQ ID NO: 54379 - DNA, 438 bp, Zea mays
  unsure at all n locations
  Clone ID: LIB3068-008-Q1-K1-D1
cccacgcgtccgggacgcaggggggcatttccgggaacctcgccgcgggcggggctggagagccgcggagcttttgatttaaccggccggttggtcagccagccagccagccagccactcagtactgcacactgccatcgctctcctacggtactgctgcctaccgcgcgtctcgtcccttcgctgccgctctatctatctcggccggagccatgggcggcggtggcgcggcgctgctgctgctggtgatgtgggcgggcgtggcgtcggcggccgtgtacgaggtgggcggcacgattgggtggaccgtcatgggcaaccccgactacgccgnctgggccagctccaagcagatcgtcatcggcgacactgttgtgttcacgtataacaagcagttccacaacgtgctggcggtgagcaaggcggactacaagaact

SEQ ID NO: 54380 - DNA, 176 bp, Zea mays
  Clone ID: LIB3068-008-Q1-K1-D10
cggacgcgtgggctgccccgacgagtccttctacagcaccacggagctcagctcgtcgcgccgcatcgccgccgcacagtgactgtcccagcgttgttttgtgtataatgatcgtatgcttgcttgttttccgaacaaatcaaatgctatcaaatatagtgatctgagtgatgagc

SEQ ID NO: 54381 - DNA, 420 bp, Zea mays
  Clone ID: LIB3068-008-Q1-K1-D11
tgaatgggtcggcgaagtggccttcagcggctatgggccggtcgtgcaaacgactggcgcagattgctgtgatggctggcttaacagcgggtatcacctgcaaggcgtgaccgcaaactcggaaagcatgggtgtcggtgtcgctacgacggtaacgacgcacgcggccgggcagcaaccggcgatgtggtcattttgcgttctcgacatggggacgacgacgggtgttccggccgcaccgaatctcagtgtgccgacgcaaacgaactcgattccttcgagcggtggacagcaattcgcgacgaacctgatcgttcacgcgccgtacattgacgaggccagtgtggcgactgcactgacgcttggggaagtcccgaatccggcaccggatctgggggcgcctgggcgacccatcatggt

SEQ ID NO: 54382 - DNA, 55 bp, Zea mays
  Clone ID: LIB3068-008-Q1-K1-D12
ctagttctagatcgcgggcggccgctcgcgatcggacgcgtgggcggacccgtga

SEQ ID NO: 54383 - DNA, 407 bp, Zea mays
  Clone ID: LIB3068-008-Q1-K1-D2
cccacgcgtccgcccacgcgtccgcgagggacaccctgacaagctctgtgaccaggtctgagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccc

SEQ ID NO: 54384 - DNA, 371 bp, Zea mays
  Clone ID: LIB3068-008-Q1-K1-D4
aaaaaaaaaaaaaaaaaaaaaaaaaaaaaaaaaaaaaaaaaaaaaaaaaaaaaaaaaaaaagaaaaaagaaaaaaaaaaaaaaaaaaaaaaaaaaaacaaaaaaaaaaaaaacaaaaaaaaaaggccgccccttttaaaaaacccaacttaactcccccttcattgcaactcaaaaccttttttaagggctccccaaaatcaaattacttgcccctcttttaaaaactcctaacctggaaaaaccctggctttcccaaattaaaaccctttcaaaaaaatccccttttcccaacatggcgaaaacccaaaaagcccctccccaatcccctttccaaaaacttccccaccctaaatggcaattggaaccccc

SEQ ID NO: 54385 - DNA, 453 bp, Zea mays
  unsure at all n locations
  Clone ID: LIB3068-008-Q1-K1-D5
cggacgcgtgggcgagggctcagttcgcacgcttcccaacatggctctcggtgccctaggccgcctcctccgccttgcgcccacccctcgcctcgcgcgccccttcgctgcaaaggtccgtgcgtctcggccgcaggaaccggagcttccgtcggaggacgacaacgacttcgccggcggcgagctcaccgcccccaccgagggcatcggcaagccgctcgccgaggtgctcaaagagctcgggaagagggttccggactcccttgtcaagacccgcgtcgagaataatggcttcgctatcaagtacatcccatggcacattgtgaacaaaattctcaacatacatgctccagagtggtcgggtgaggtacgcagcattggttactcatttgacgggaaaacagtatctgttgtctatcgagtgactcttcatgggaatgatgcanagatcta

SEQ ID NO: 54386 - DNA, 369 bp, Zea mays
  Clone ID: LIB3068-008-Q1-K1-D6
gcaaggtgttcgaccatcagctgtgccaaggcccatcggtaccatgtacagcaggataggggtgtttacacatattgacaggacacaactctccagtttaggctttgccaaaaacccatatagaataacgagcatactcaaacgaccaccactccaagcacaccatcatcgccaacctgacggagagcttctcgtactcccacataccatataaagagaatgcctcggaggagaaccctgtccatggtaccattatgctcttgcacatcatctggggatacgcatactaacatctaggaatatgtggtgacatacattgtccaaatgcttccaattcttgatgattacttttttatcgactgacttaac

SEQ ID NO: 54387 - DNA, 317 bp, Zea mays
  Clone ID: LIB3068-008-Q1-K1-B8
actcatacacccactcatcctattcgacagacttcgctttttcctcaagcatattcaaacaaggctcaggcgcatttctaaatcaaccacttccaaactactcccacacatatccaatttcatatccatactaaatattcacatttaatctacttacttgattattatattaaaatatataatcctgctacaacctaacttttcttactctactcacataactttcaaaacatactcatacatttcaataattcccaactacaataatctttatacactttatccactatttatatccatattactcaaattttatc

SEQ ID NO: 54388 - DNA, 452 bp, Zea mays
  Clone ID: LIB3068-008-Q1-K1-D8
ggtacccgttcagccagccgatgaagctctactccagcctgtggaacgccgacgactgggcgacccgcggcgggcgcgagaagacggactggttcaacgcgcccttcgtcgcctcctaccgcggcttccacgtcgacggctgcgaggcctccgcggaggcgcgcttctgcgccacccagggcgcgcgctggtgggaccagccggagttcagggacctcgacgccgcgcagtaccgccgcctggccgacgtcaggcgccgctacaccatctacaactactgcaccgatcgcgaccgctacggcgccgccgtgccgcccgagtgcgcccgcgaccgcgacgtctgatgatgatgcgttgggccggcaagctgcttgatcgagagcagcctgtaatgtatgtatggtatggtattggtgtgtgtcaggttcgtcgtcgtgggtctgcagagacac

SEQ ID NO: 54389 - DNA, 446 bp, Zea mays
  Clone ID: LIB3068-007-Q1-K1-H9
tcgcggacgcgtgggcttattcttaagggttcagccatatgttgacatcctctggaaagcaggggaaatctgtggagtcagcacagaaagatttcttggaggcaaagcaccttgccgcacaacttgttcttgatatccttgattctattgtaccccatgagaaccgcatattggtcaagcttcttgagacatttgaaattgagttgagagacatggcccgtgctttgtatgattcatagttggacgatggtgatctaatgaaagcacgtgaacatctcagacagcaagttaagcgctctatggaatcagaatccaatgcacttgctgtgactctaataacacatttttccatccaatgctgtgatgagtccttcatcatataattgattaaaaacaatcatttagagattgcagagcaattgtgctattttcatgggcaaggaaat

SEQ ID NO: 54390 - DNA, 453 bp, Zea mays
  Clone ID: LIB3068-008-Q1-K1-A1
ctcgcccgcatctgcgacggcatcctcgccctgctcgactcccacctcgtcccatccgcgggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagcttctgcgcgacaacttgaccctatggacttccgacaccaacgaggatggcggcgacgagatc

SEQ ID NO: 54391 - DNA, 467 bp, Zea mays
  unsure at all n locations
  Clone ID: LIB3068-008-Q1-K1-A12
gtcttctctcgaccagggctacgtgtccatcgggtgcgagccgtgcaccaggcctgtggtgccggggcagcacgagcgggaaggccggtggtggtgggaggacgccaaggccaaggagtgcggcctccacaagggcaacatcgacaaggacggccaggcggcggcggctgcggcggcccccaggactgccaacggcaacggctcggcgggcgccccggacatcttcgagagccccgccgtcgtgtccctcacccgcgccggggtcgagaacctgctgcgcctggagagcctcgccgagccgtggctcgtggtgctgtacgcgccctggtgcccgttctgccaggccatggaggcctcctacgtggagctggccgagaggctggcggngtccggcggcgtgaatgtggcccggttccgcgccgacggcgagcagaagccgttcgcgcaggccgagctgcaactgcaga

SEQ ID NO: 54392 - DNA, 455 bp, Zea mays
  unsure at all n locations
  Clone ID: LIB3068-008-Q1-K1-A2
cccacgcgtccgctctaatcacactttcgacactgatcggtactctagtgtccgactcgtgacaattttagcgagaacgagcgagcgagcgagggagaggatgggttccacaggaccggcgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcggccacggaagcacggttgctgtgatagctcctaatgtcccggctgtctatgaagctcacttcggtgtcccaatgtcaggagctgntgtgaactgcgtcaatattcggctaaacgccgagacaa

SEQ ID NO: 54393 - DNA, 451 bp, Zea mays
  Clone ID: LIB3068-008-Q1-K1-A5
aaaaggtgggctcgtccgagtctgccctgctcgtcaagctgggtatccgcccggtctcggatggcctccaggtcaccagtgtctacgaggatgggtccgtgttcagccctgaggtgctcgacctttccgaggaggacctgattgagaagtttgccactggtgtctccatggttgcctccctgtcactggcgatctcatacccgacccttgctgctgtgccccacatgttcatcaatgggtacaagaatgtgcttgctgttgctgtcgagacagactactcatacccacatgctgacaagatcaaggagtacctcaaggacccaagcaagtttgctgttgcccgcccggttgctgctggtgactctggcgctgcagctgctcccaaggaagaagagaaggctgcggagcctgaagaggagtcggacgaggaaatgggcttcagcctcttcga

SEQ ID NO: 54394 - DNA, 445 bp, Zea mays
  Clone ID: LIB3068-008-Q1-K1-A6
cggacgcgtgggcgcgcaggaggtgccgacgacgaggatcgcggtggcgatgaccgggtgcggcggggcggtgctggagggcgtgctcacgttcctgctggtgtacacggtgcacgtggtcggcgagcgcgagcctcggtcgcgcggcggcgacggcaagcgggagttcgcggccacggcgctgggcgcgctggcggttgggctcacgcagggcgcgttcgtgctggccgcgggcgcgctgacgggcgcgtccatgaacccggcccgctcgttcggcccggccgtcgtcagcggccacttcaagaaccaggccgtgtactgggccggcccgatggtcggcgccgccgtcgccgcgctggtgtaccagatcatggcgtgcccgagcgtgacggggaacgtggaggcggtggtcgtttgacaagctagtgtgcaactgtgctgtgca

SEQ ID NO: 54395 - DNA, 432 bp, Zea mays
  unsure at all n locations
  Clone ID: LIB3068-008-Q1-K1-A8
cccacgcgtccgcccacgcgtccgcggacgcgtgggggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcgactcgctggtttcctcgagacccgtttcgggaagctagacatcctggtaaataatgccgcgattggcggngttgagtatgttcatga

SEQ ID NO: 54396 - DNA, 468 bp, Zea mays
  Clone ID: LIB3068-008-Q1-K1-B10
gcaaactgaagtcactcacagctctccagcttccatccagaaaggagaaggaaacaagcgtagtggacaaccaaccatgatcagcgccaagaagattgctcatctcgccaagaagtggcagaggatggctgcacaagggaggaagcgcctcgccttgggggcggcagcaaagcaagccgacgagtgctgcagctatgtggcgagcaagggccactgcgcggtgtacacggccgacggggcacggttcgaggtgcccctggcgtgccttagcaccccggtcttcggggagctcctacaaatgtcacaggaggagttcggcttcacgggcggcgatggcaggatcacgcttgcctgcgacgcggcgatcatggagtacgccatgtgtttgctcaggagaggagcctctgctgagctagagcaggcgttccttagcaccatggccatgtcatgccactgtgccagccacat

SEQ ID NO: 54397 - DNA, 445 bp, Zea mays
  Clone ID: LIB3068-008-Q1-K1-B11
gccagtctgtggacatgaatgccattgcggtcctgtttgatggccgcaggcttcgcggcgaggagacccctgatgagctggagatggaggacggtgacgagatcgacgccatgcttcaccagaccggaggcagcgttcctagcaccacctaaaagcctcgttttgctctccgtcctgcgtagtagtaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgtcatgattgtactcccaatgacgcgcagatcatttgctttgatttgtctgctcgaacctcgaagtcgtctatgcttttcagattattttgggcaaaaaaaaaaaaacagggc

SEQ ID NO: 54398 - DNA, 413 bp, Zea mays
  unsure at all n locations
  Clone ID: LIB3068-008-Q1-K1-B2
ggcggttcatgatggaccagttggtcttttacgaatcaagagcagcagccgctgaccccgacagggacatgagactggacatcgacaacatgagctacgaggacctgttggctttgggagaatctatgggcaatgtcaacacaggcttggccgatgagaaaatttcgaagtgcgtgaaagaagtggtctgctgcagttccgaccagacgcaaaccgatcaagatgaccaggatgacggaagctgcgtcatctgcctggagggttacagagacaaggatatgctggggatactgaaatgcaggcacgacttccacgccggctgcatcaagaagtggctgcagacgaagaactcgtgcccggtgtgcaaagccgncgncgnctaggacgacaccagaggagcgagcaactatttt

SEQ ID NO: 54399 - DNA, 461 bp, Zea mays
  Clone ID: LIB3068-008-Q1-K1-B3
cccacgcgtccgacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcaggggaaggggcacgggatacaccatcaagggaaagatcgatgtcgacactcccttcggcaacatgaagctgcccataagcaaagagggtggaaccacccgcctcaagaaggaggacgacgatgacgacgacgacaactgaagtgaggactgctggggcgctgctgttacctttcacgaaacgcagcgaagcagaggatgcggggatcgtcgtcgacctgatacccatacccttagcgcttgttaagctcttggctttagcttatgg

SEQ ID NO: 54400 - DNA, 396 bp, Zea mays
  Clone ID: LIB3068-008-Q1-K1-B5
atcccactcccgatcagcagctgatcgctcactcttgcagctcgatcattcttgagctggtctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgtcgctgagcccgaggcggcccccgtggcggcggaggaagagacgccaaaggaagaagagacggcaaaagatgcggagccggagccggagccggcggcg

SEQ ID NO: 54401 - DNA, 287 bp, Zea mays
  Clone ID: LIB3068-008-Q1-K1-B6
cccacgcgtccgaaaaaaaaataaaaaaattaaaaaaaaaaaaaaaaaaaaaaaagaaaaagaaaaaataaaaaatataaaaaaaaaaaaaataataacaactaatttaaaataatcaaaagttctttccattttcaaccatacttctttcctttcctttattttcaacttatttcatttactttgctgtcctttaacttcatttaccctgcctactctttacatcatccccaatttaataaactttcgtcttttccaccttattcccttttccatatttccccttt

SEQ ID NO: 54402 - DNA, 450 bp, Zea mays
  Clone ID: LIB3068-008-Q1-K1-B7
cccacgcgtccggtgcgacgggcggcgctcgttcctcaggcatgtgcggacgacgctcagacgcatggctgtgtcgaccacttgcagacgacgccgacacagatccaggtccaggtccaggttaagtattgttttttggtgtgtggacgtgattcttctagtgagatatgttctgaagcggcaaggtaaaccctcttagtctacttgtttaacttttaaaatatacccatcggtttgaatgatgcaaaactacaataatcttcatgtacttgattgactaatgagttggatatgattcgtattctatttcttaaaaaagtaaggcagaagatagctagattcatgatttggcaaatacaacctcaaattaacttgcctattcatcgattatgttcaggaaataatgtatcaattaattgaaggaagtaatagtagtggctcatctagaac

SEQ ID NO: 54403 - DNA, 416 bp, Zea mays
  Clone ID: LIB3068-007-Q1-K1-H8
gcggacgtccatcgagcacaaggcttccaatgtagcacagtcccaatccggagaaggcgcccggggagcacaagccgacgccggccacgtacaccccgagccccaaacccacgccgccgacttacactccaagccccaagcctcccacacaccctacgcccaagccgaccccaccgacgtacaccccttccccaaagcctgcgacgcccaagccgaccccaccgacgtacaccccttccccaaagcctgcgacacccaagcctccgacacctaagccgaccccgcctacgtacactccaagccctaagccaccggctaccaagccttccacgcccaagccgaccccgacaacgtacacccctttgacaaagcctacgacacccaattcgaaccctgctgcgtacaccccttttttc

SEQ ID NO: 54404 - DNA, 449 bp, Zea mays
  unsure at all n locations
  Clone ID: LIB3068-044-Q1-K1-G11
gtcctcccctcgcgagcggcgtgcatctcaccgcgtgcgtcagcgcggcgtgcgaactaacgctagtcccggggggccagcggcgcgaccagcggtgcagccaaatcgaggaaggagtagggcagtggcgcggccagcatctccacggcgcacgggtgctaccagttcagtaggcaggcgagaggaacgcggtgctgcgacggctcggccgctcggcgcctcctgcgtgctgcgcagtctgtataagcgcagagcagcagagcagacaacactcagctacaacaggaagccacatggtgttgaatgctgntatctgttagactttctgagtaggctaggttagataagatatcattgtttttgacaaaaaattctgggttcaggatcaagatgagtagaaaaatatatggtgaaaatgactctgagagaattgctagtgatgggacagc

SEQ ID NO: 54405 - DNA, 407 bp, Zea mays
  Clone ID: LIB3068-044-Q1-K1-G12
ctgacgcgttgggtacctccctccatctgatcgcgtccgtcagctctcgccgcgcaatcagcttaatctattccggcagaaggggacgaccacaggtccagcacaatcgagcacaaacttcagaaccaatccttttaccatatttacggatcacttttgctaacttttcattactacatcgatacaaacgccatactctgaccactttggagacctgatcctgctacgagctccacactctgtataaccgcataccatcataccaaacatcactgacctacaacagcacaccacatactgttcaatgctcgtatctgttacactctcttaatacgatatgttacataacacattataggttttgacaaaaattctgcattcaagatcaatattactttaaaaatata

SEQ ID NO: 54406 - DNA, 330 bp, Zea mays
  unsure at all n locations
  Clone ID: LIB3068-044-Q1-K1-G3
ccgggncgaccgccgcggccgaaaaaaaaaaaaaaaaaaaaaaaaaaaaaaaaaaaaaaaaaaaaaaaaaaaaagggcaacgggacggggggaaccaaaacaggacggacccacacaaacaacaaaaaaaaaacaaggggcggccccccaaaaggaaccaaaccgcccgccccgggacaacaacgngaacagggaaaacccgggccccccaaaacaaaaacaccggccggcgcancccaacgncgccaccgggaaaaccaggagaaagccccccacacaacccccgaaccaaaacccccgcaacccgaagggcgaaaaagacacgccccc

SEQ ID NO: 54407 - DNA, 301 bp, Zea mays
  unsure at all n locations
  Clone ID: LIB3068-044-Q1-K1-G6
cccacgcgnccgcccacgcggccgactagnncnagancgncagcaagcgcaccaggggagcagcgaagcncggagacggagagcngaagccngcaggcaagcggaagnncaacaccaaggaagaggagccagaacagnacnggcagaccgcgggggagagggagggggagaaccccangangacaccccngcccnacancancancnncggcagggccacccccnncgacaaccgcgccaacgccnncgccaaaggcnggaacaaggncccngngcgaagaccgnaacgcgancagccagc

SEQ ID NO: 54408 - DNA, 448 bp, Zea mays
  Clone ID: LIB3068-044-Q1-K1-G8
aagaagcctaccggctcggcggctccggctcacctcccacacccccaaaaaaagtctggcgtgccgccggcggccaccaccatcactgccatgatcagcatcctcgcgcaggagcgcctcctcgggttcgccctgggttccgtctccatgggcggcttcgtcctccaccagcgccgggccatctaccgttcaatcgctgaagccgacgggtcgccctacttttaccagcctggtgaaattgccagtcgaagaagctcaactgaactggctcatgtatggaacaaggcagtggacgagacccttgggcgacttgttgtgtaccttagttcgcgtgggtggtgattcaagctccatgttgaacatggtaaccgaggaagactctttttcaagccactgatgtgctcatactcgatacttccctggtccccggatgaacaagtttttaatt

SEQ ID NO: 54409 - DNA, 461 bp, Zea mays
  Clone ID: LIB3068-044-Q1-K1-G9
cccacgcgtccgcccacgcgtccgcccacgcgtccgggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaagggggggcc

SEQ ID NO: 54410 - DNA, 337 bp, Zea mays
  unsure at all n locations
  Clone ID: LIB3068-044-Q1-K1-H1
ccgggncgacccacgcggccggngacaannaaaaacaagaccgggcgcgnnagngncngggaannggaangagnacaancgagaggccnnaacgagganccannggagggcaagncnggngccagcagccgcggnaannccagcnccaanagcgnanannnaagnngnngcagnnaaaaagcncgnagnnggaccnngggccgggccggccggnccgccncacggcgagaaccgaccggcncgacccnncngccggcgaagcgcnccnggccnnaacnggccgggncgngccnccggcgccgnnacnangaagaaannagagngcncaaagcaagcc

SEQ ID NO: 54411 - DNA, 451 bp, Zea mays
  unsure at all n locations
  Clone ID: LIB3068-044-Q1-K1-H11
cccacgcgtccggcacgttctgggttggaagggtcaatagagcatttggttgaagaagacggactggagaaggatgcttagtaaaaaaggagaaatcctcactaaggagttagctgagcttctagagttggtgaggttgaaagaagcagagatagctgaaaacaatgcccggatccatgaagttcaagaaagaatcagtgcagtggtctccagattccatggttctcagtcagatattgacttgaagctcagttccttgaaggaagaccaaagtaaagtggatctagagactgaagcacttttgttgaagaagaatgaaattgataagttcattactttaacagatcaaaaggattcagagttgagggacataattggtgcttgttcctctgaagcanaagcttgtcgacaatcagttgaaataagaagaaagcttgcatcatcgatcttg

SEQ ID NO: 54412 - DNA, 110 bp, Zea mays
  Clone ID: LIB3068-044-Q1-K1-H3
ccgggccgcccccgcgtccgaaaaaaaaaaaaaaaaaaaaaaaaaaaaaaaaaaaaaaaaaaaaaaaaaaaaaaaaaaaaaggaggggaaaaaaaaaaagggggggaggg

SEQ ID NO: 54413 - DNA, 225 bp, Zea mays
  unsure at all n locations
  Clone ID: LIB3068-044-Q1-K1-H5
ccggggcgacgccgcgtccgnnnnaaaaannnaaaaaaaaaaaaaaaaaaaaaaaaaaaaaaaaaaaaaaaaaaaaaggaaggagaaaaaaaaaaaagaggaagggggcggacggccnaggggaacaaagganacanacgcgggcaggcgaggaaaaaacncaaaaaagggggcaccgaaacacaaaaaacgggccgacgggcaacaacgaaaaaacggggaaaa

SEQ ID NO: 54414 - DNA, 454 bp, Zea mays
  Clone ID: LIB3068-044-Q1-K1-H9
gtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacataaccctggattgtggcctcttttgtctctgaatggttcagatggcagcctgcaggggtttgaggagctattggcctcagtacttggaaagaaggcaggcgagaagggtaccttcaagctactgaaggcacgggcctcggctcaaacctatgtcaagatggcattcacggtggagaagaagcttgctgaaggggatgtgaactggtcaaatattccagaatggaa

SEQ ID NO: 54415 - DNA, 345 bp, Zea mays
  Clone ID: LIB3068-045-Q1-K1-A10
ccctacctcaggtgctaacgtcaagctatgcaacaaatgctttaaatcaggccacatcgccgttgactgcaccaacgaacgggcctgcaacaactgccgtcagccagggcacatagctcgggagtgcaagaacgacccggtctgcaacctgtgcaatgtctctggccacgtcgcgcgcgtctgcccaaagacgactctggcttcagtgatacagggcggcccgttccgagatatcctgtgccgcatctgcggtcagccggggcacatcagccgcaactgcatggcgaccattatctgcgacacatgcggtgggagggggcacatgtcttatgagtgcccttcggc

SEQ ID NO: 54416 - DNA, 281 bp, Zea mays
  Clone ID: LIB3068-045-Q1-K1-A2
tattcggttgccatttgctgtcaacatgggtcccgtgttgctgtcttcatttgtctattatctatgcatatttcaggtccacagatacgtggaaggtctttgttgggctatgagatactactatcaacgtgtttgttcatggcagtggtatgtaaatattgaccatctactgtgagaatttgctatcgcattttctgtggcagataaaacatcacttgattgagtgtgaaagtattattcttcactttttttgcaaagcgcaggagaactgcgcatcatta

SEQ ID NO: 54417 - DNA, 369 bp, Zea mays
  unsure at all n locations
  Clone ID: LIB3068-045-Q1-K1-A3
ccacgcgtncggatccaccgncaccaccaccaccaagcactccagtcccgcagcagcatggccggcagcgcgtggcgcctcgccatcctcttggtgctcctggcggcgtcaccgctgcttggcgcgacgcagaaggccgcgccagggccggcgtcgtcgtcgggctcgggcgcgggcgcggcggacgcggcgccgccgacggacgtgaacaaggcgctgaaggacgagcagttcagcgagttccggcagctgctgcacgacacgcgcgtggacacgcagatcaacgcgcagctgacggacagctacaacgggctgaccattatggcgcccaccaacgccgtctttgacaagatgaaggcgggcgtgctg

SEQ ID NO: 54418 - DNA, 362 bp, Zea mays
  Clone ID: LIB3068-045-Q1-K1-A6
gcaaaccctgccctggttcaactgacgtggccgcctcgttcccggacagtacaccttggcatcttcctcttcgactaccacatcggccgaaccccaaccggtgaggatggggaacattttcgcgaacaaacccaacattaccggactggacagggccatcctcaccctgaagacgcaccgccgcaagctcgcccagttccagcaacagcttgagaaggtaattgaagcaaaaaaggaagctgcactgcaattggttcaacagaagaagagagacagagctttgattgcactgaataagaacaaagctcaggaagagctgttgaaacaatgtgacacatggcaaatgaatgttgaacaacagc

SEQ ID NO: 54419 - DNA, 274 bp, Zea mays
  Clone ID: LIB3068-045-Q1-K1-A8
gctgaacgcgttccacctcatctctttctcggagggcttcgacctgtccccgctcttcgaccagggccgtggcggcggcgtacggaggtctagcgcgggcggcatccgtttcgtgacgcgcgaggccgccagcagcgtggtctcccgtctggagtcgctggtcaccggacgcggagccaacatgcgcgtgacaaagagcggctcgcggggcgtttgtttggaggccgtgtcgcgcgggcgctctgaggcgcggctggcagtggccgcggagatc

SEQ ID NO: 54420 - DNA, 145 bp, Zea mays
  Clone ID: LIB3068-045-Q1-K1-A9
cccacgcgtccgacaaaccttatatgcacacgtaagctgacgagttcgaggacgcgtggggtcacacgtctgtaacaaccttgatcttcagtgaaggattcgagttgtatcactccatgcgagaccctaaagaagagcaactatg

SEQ ID NO: 54421 - DNA, 384 bp, Zea mays
  unsure at all n locations
  Clone ID: LIB3068-044-Q1-K1-G1
cggacgcgtgggcggacgcgtgggcgttgagcaatggatggattttgccgcaacagaaggtgatgctggtgttgcatggtacttgtatccaaggcttgggtacctcccttatgttagcacaactgaggaaacagctatttcttcattgaagaggtcgcttggtgctctgaacacacaccttgcctcaaacacataccttgttgggcatgctgttactctagctgacattgtattgacatgcaacctctaccatggaattgcacggatcttgaccaagaccttcacgtctgatttccctcatgtcgagaggtatttctggaccatggttaaccagcctaacttcaagaaagtcattggtgaggtcaagcangcagagtctgcacc

SEQ ID NO: 54422 - DNA, 284 bp, Zea mays
  Clone ID: LIB3068-045-Q1-K1-B1
cgctctggtcatgggcgtcttaaccgcttaggctaaagaaaatgccctcgttgagagcaaggccatctacatcaacccggtgcagctcaagtgctgcacacaactgcaacttctccttgtcggggctctacacctgcgacgacatcaaaaagcgactgccaccccgtctgcaagaagtgcgtctgtcgtcgtgcacgcgtactactatggcaacaacaagatcaggtgcaccgacaccttccgtggcatgagcggccccaactgcttgatcatagatgaagaac

SEQ ID NO: 54423 - DNA, 262 bp, Zea mays
  unsure at all n locations
  Clone ID: LIB3068-044-Q1-K1-D7
ccccnccnnnccaaaaccccccccggcgccaggcacggggacggcccacccgagcgcggggagcacnagcagccgccgggaaaccaccagaacagcgccaacaaggcccccgcnccncggcaacaagccgcccagacggacaccgccgcgcccccgcaaccgaaagccagcgccggcgacgccacggagaagcngcngcccgccgncgcagccgagggccccaccaggggggggccagacaccaagacgaggggaaagaaga

SEQ ID NO: 54424 - DNA, 390 bp, Zea mays
  Clone ID: LIB3068-044-Q1-K1-D8
cggccggaatcccggtcgcccacgcgtccggtcgccaagccagcctggtgtgcgttcgatcgctttgtgcactagggtttagaggttttctgggcgcggagcggcggcggcggcggcggcggctatggctgcggcggaggaggagatcgcggtgaaggagccgctggatctgatacgcctcacctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatccccttcctttttgtccgaagtgatggtgtcata

SEQ ID NO: 54425 - DNA, 445 bp, Zea mays
  unsure at all n locations
  Clone ID: LIB3068-044-Q1-K1-E10
ctggcgtgcctgctggccatcttctcacagaagagcgcatccagcggccaagacaaggagcgggtgtcgccgcggtcggtctccggctcctgcggaagcagctcagcagacccctactgtgtcccagaattcgggtggcgggacgttggccagtacaagcagttcctgtcagtcgacacgaacatttctgccggcgacgactccgctcttgaccagagactgaaggcgctgctcaggaagctctctttggttgacctagcaggcctctcccaccagcataataggctggcgttctggatcaacacctactactcctgcatgatgaacgcatttctcgagcagggagcgcctagcgacccccgtatgctggtggccatgatgcccaaggcgaccatcaacgtcngcgggcgcgtgctgagcgccgtggcgatcgagcacttcattc

SEQ ID NO: 54426 - DNA, 459 bp, Zea mays
  Clone ID: LIB3068-044-Q1-K1-E11
gataagcatcatgcgggcatgcaaggaggccggcaccgtgcggcgcatcgtcttcacttcgtgcgccgggacggtcaacctggaggagcggcagaggcccgtctacgacgaggaaagctggaccgacgtcgacttctgccgtcgcgtcaagatgaccggatggatgtacttcgtgtctaaaaccctggcggagaaggcggccctggcgtacgcggcggagcacggcctggacctggtcaccatcatcccgacgctcgtggtcggcccgttcatcagcgcgttcatgccagccagcctcatcaccgtgctggcgctcatcacggggaacgcgctccactactcgatcctcaagcaggtgcagctcatccacctcgacgacctctgcgacgccgagatcttcctcttcgagaacctcgccgcggccgggcgctacgtctgctcctcgcacgacgtcaccat

SEQ ID NO: 54427 - DNA, 406 bp, Zea mays
  unsure at all n locations
  Clone ID: LIB3068-044-Q1-K1-E12
cccacgcgtccggtaccgcggcccctaaacccctttcctcgttcccctccgtctctcagtgaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtcccagaggtttggctttataacttacacgtcttctgaggaggcttcngctgccatcactgccatggatggaaagactctggatggacggaacatacgggttaatcatgctaacgagaggacaggtgg

SEQ ID NO: 54428 - DNA, 422 bp, Zea mays
  unsure at all n locations
  Clone ID: LIB3068-044-Q1-K1-E4
cggacccagggagaacaaagagaggcagcaccagctacaggngnatnnncaccnncnncggcaagagactngaccacaatattggcacctatgcttgtcccaacagtgaatagtggagccttaggatactcttgatgaaggaaactaacaacttcacgcatatctgccgtccacccggcattgtaaaagcaatcagatgttatggagatgccaccaagacccctgtggttgcttacaacaacattccatcctttgattgccatagaaaagaccaagtgcttcacataagcagcactagaatcactagttaatccaggtatcacaacaagaaggggtgttgaatcatccttagaaatggttccgtcagaagtgccaatatttccatcttcaaaatcagaagctagtaaccaatctaaggcaat

SEQ ID NO: 54429 - DNA, 244 bp, Zea mays
  unsure at all n locations
  Clone ID: LIB3068-044-Q1-K1-E6
accccgcccccaggcgggaggccnaanccgagcgggccgaccnacacnccaagccccagaccaacgacgcccaagccgaccccaccgacgnacacgcccccccccaagccaccgacaccaaagccgaccccggcgacgaacacaccaagcccaacgccaccggcgaccaagccgagcacgcccaagccagagcccgccaacgaacacccccccgccaaagccgccnacacccaagccgaccccg

SEQ ID NO: 54430 - DNA, 229 bp, Zea mays
  Clone ID: LIB3068-044-Q1-K1-E7
ggagagaataacgcagagctctctgctcccggcctgtcttctgccgtcccggccgtttagtttactagtgtgttcgtcctatatgtttagcagcagcaggtgtattgtgcgggtatgtaatggtattgcaactatattgggtgtaaaaccataataaatgtgggcaaatatgcaaggaaaaaaaaaaaaaaaaaaaaaaaaacaaaaacaaaaaaaaaaaaacaaaagg

SEQ ID NO: 54431 - DNA, 408 bp, Zea mays
  unsure at all n locations
  Clone ID: LIB3068-044-Q1-K1-E8
cggnccggaanncccggggggacggacgcgnccgcccacgcgnccgnaaaaaaaaaaaaaaaaaaaaaaaaaaaaaaaaaaaaaaaaagggaaagaaaaaaaaaaaaaaaaaaaaggaaaaaaaaaaaaaaggggggggcgcccaagaggacccaagcnaacgaacgcgggcaggcgacgacaaagcccnccaaaaggggcaccaaaancaaaagcacgggccggcgnnnaaaaacgccgggacggggaaaacccggggggaaccgaagagaagcgccgggaagcacaccccccnnncgccagcgggggaaaaagcgaaaaggccggcaccgaccggccnncccaacaanggcccagccggaagggcgaaggggacgcgcccgganacggcgcaaaaagcgcggcggg

SEQ ID NO: 54432 - DNA, 400 bp, Zea mays
  Clone ID: LIB3068-044-Q1-K1-E9
tgttgacgtgtgtggaactagttaatctgtagacttatatcgtcatgtgttcaactggtggggcacacatatttagcactggtgtaaattggaaatagtgagtgatatgatcctcggaagcatatcacgcaaaaacaagaaatggtacatggtgtacatccttgactggatgattttttgatgtcatatacagcgcgaagtcttcttcctgcgagacaaaaagctatatgacgttcagacaacatggtgctgcaagatataacataagatcattgcttgttcaaaaaaaaaccatagatccaattataattccgaaaaaaaagatactgtttgccagattaaaatagtctacattgatccattggaaaaaaaggtcgtcacatttaaaacatccaaactt

SEQ ID NO: 54433 - DNA, 456 bp, Zea mays
  Clone ID: LIB3068-044-Q1-K1-F12
cgccgccggcctcgcccgccgcgccatcgtccaggtctcctacgccatcggcgtgcccgaggccctatcggtgttcgtggacacgtaccggaacggggccaatcccgacaaggggatacctgagaatgcgaaaggagaacttgaatctaaggcccggtgtgaacataatcaacctagacctcaagaaaggcggaaacgggctctacctaaagacgggggtctacggacactttgagaggcacgaccgagacttcacctgagaggtggtgaagcccctcaaggcggaaaagccgtcttctgcatgaggcgcctcctctgtttcagaagaagcttttggtctggtctgcctgcgctctatcatgctttattatggctcctacgtgttgtgattcttgatctgccccttgcttatcatttgtactgtactgtcactgtcctaataagtggtacgtgtgc

SEQ ID NO: 54434 - DNA, 395 bp, Zea mays
  Clone ID: LIB3068-044-Q1-K1-F2
cccacgcgtccgcccacgcgtacgggcgcagatgatccttgacaagaaatttgctgggacactagatcaaggtgctggctgcctcattatctttgaggattctaagacggaggatatcttccctgccactctcgaaaccatttcgaatgtcgggaaggttgtggacagcctttatgtgagggcggccaagatcatggcttgaaagcagctagtcttacctgtttgctctgatttcatttccagtctgtcgatgtcctcagacatttattccttcaatattgacagtttattgtgaccgctacaggttcatgtgaccaaaggctagctatttttacgactgaatgagttatgcatgtattggtcttttaataaaaaaaaaaaaaaaaagggcgggc

SEQ ID NO: 54435 - DNA, 428 bp, Zea mays
  Clone ID: LIB3068-044-Q1-K1-F3
cccacgcgtccggggagggagagacggcaattgcatttgctgagagagtaagggacatgagggctgctagagctggactaaagaaggttccttgggatggctatctgaaacacaaccgtcctagtcccaaacacactgaagagaaacaacgcatatttgccgaatctgtcttgatgagactggaggagaaatgaagggacgtcaagccgtacaagtgcacttcgttagggttttacatgcagctaccttgtaattcggttggcttccaggaaaaaaaaagtgagcctgggacacgtcaagtgaccacctcagttttgttgtaaatttgttactagtttgataggattattagtatgtgcttatcaggaaaagaattctcagtatgtgttttggctgcccattcaatgaatggtcagtgaataacaccg

SEQ ID NO: 54436 - DNA, 357 bp, Zea mays
  unsure at all n locations
  Clone ID: LIB3068-044-Q1-K1-F4
cccacgcgnccgcccacgcagacggacccacgcgnccgcggacgcgagggcaagcacaggggcaggcnancaanggcggcggagggngnccccccaagcgacaccgagccaccaaaggcacaagccgacanaaggcggcacagccacaccaaccacacgccccagncacngaggagcgccgnggagcnaggcaaccccacggcgaacaaccgccaaggcggggcngccncagccgcagagccggacacggcgcngncncnccccnccacgaaacagccgagccaccgccggcagcngcggcaacaagccgcggcgggcgggggcaccgncgacaagcagagcacggaggaagagcgg

SEQ ID NO: 54437 - DNA, 346 bp, Zea mays
  unsure at all n locations
  Clone ID: LIB3068-044-Q1-K1-F6
cccacgcgnccggctaaaccctnnggnccacacgagagnncngncncgnggagcggggcnnangacaccgngcggancnnnnaacagangngccgccccagccaaacnccccaccngacaangncnnccgcccggancggcccggcgaggccgggccnnggagccaaaaggaggggcggngccccgcnnccgacccacggaanaagnaaaanaacgnnaaaagnagngggaggncacnggcgcccggaggcncccacnnanccnacaccncncaagncannncacaaagncggaccagagncaagcncaacagggncnnncnnnccccgcggaaaccgccaagccc

SEQ ID NO: 54438 - DNA, 386 bp, Zea mays
  unsure at all n locations
  Clone ID: LIB3068-044-Q1-K1-F7
cccacgcgcccgaggcgggaccacccgcngaananaagcaganaaanaaacacaggagaggaaacccacgaggacggcccgagaaacggcgagcgaaccgggagcagaccagccggagaancgggcggccncgccgcccgaaaaggagnccggagaggcggccccagcgacggaccgggcccaaggaccccggaaagggacgccagggagggngagagccccgcccggcccagacccaggcgcaccacgaggcgccggcaacgaggcagggcggccgggaacgcagcccaaaccgggcgcgaaaccccgnccaaggcnaaaaacaggcgagagacacgaagcgaacaagnaccgcgagggaaagaagaaaaggacgnngaaaagag

SEQ ID NO: 54439 - DNA, 345 bp, Zea mays
  unsure at all n locations
  Clone ID: LIB3068-044-Q1-K1-D6
cccacgcgtccgaaaacccactcccactcctccgacgtacaccccgacccccaagcctgggacacctaagccgaccccgccgacgtacactccaagccccaaaccttcgacgcccaagccgaccccaccgacgtacaccccttcccccaagcctccgacacctaagccgaccccgcctacgtacactccaagccctaagccaccggctaccaagccttccacgcccaagccggccccgncaacgtacaccccttcgccaaagccttcgacacccaagccgaccccgccgacgtacaccccgtcttccaagccttcgacgcccaagccgaccccgccgacgtacac

SEQ ID NO: 54440 - DNA, 111 bp, Zea mays
  Clone ID: LIB3068-044-Q1-K1-F9
cggacgcgtgggcggacgcgtgggcggacgcgtgggcggacgcgtgggcggacgcgtgggaaaaaaaaaaaaaaaaaaaaaaaaaaaaaaaaaggacagacaatataaaaa

SEQ ID NO: 54441 - DNA, 89 bp, Zea mays
  Clone ID: LIB3068-044-Q1-K1-A8
cttttattctcaaagcgttgataaaaagctttctcttcatctgtatattttattgttaatgaaagaaataaaccactatatatttcgac

SEQ ID NO: 54442 - DNA, 274 bp, Zea mays
  unsure at all n locations
  Clone ID: LIB3068-044-Q1-K1-B1
gacccacgcggccggaagaaaccgacgaggannccccgagnaacggcgagcgaaccgggagcagcccancnagagaagggggcggccncaccgcccgacaagaanacaggagaggcgaccacagcgacagaccgggcccaagagcacgggaaagggacgccagggagggggagagccccagccggcccggacccngacgaaccacgaggcgccagcaaccaaccggggcgaccgggaacgcaccccaaaaacagcgagnaacacccggcaaggc

SEQ ID NO: 54443 - DNA, 458 bp, Zea mays
  Clone ID: LIB3068-044-Q1-K1-B10
cccacgcgtccgcacagcttctttgtcgaatgcttcaggcactcggtaattcctagaaaaggttcggtaaagactttgccgagtgtagctctcggtgaactgtatatataatatcatgacatgtcgataaagttcatgattttctgacttcgtttgttgtttatacaattttaaaactactagatctcaagttcacattcatgttttgtgaccatgatactcaaaaattctggtctgtttttaaaataggtcgtaaactgtgctaaaataacataaatatcattttttgcattcactgttttctattttttgagtgacttacaattcaaatatgaattatctgaagaaattcaattaaaagaactaaatataatagctatagctaacactttgataattatgtcaagatggaacatgtatctctatatagtgtaagaacatagtagaaaaaatttgct

SEQ ID NO: 54444 - DNA, 278 bp, Zea mays
  unsure at all n locations
  Clone ID: LIB3068-044-Q1-K1-B2
ggggcgaaaggggaggggaaccancaaggagccggggcccncccaagaaaaccaaaagaaagcgggagcccacacaaganccaacgggaaaagccaangangagaggcancgggggcgcaacgcccgcgaccaaaacacaaacacnaaacaggnaggaccgcccggcngccncggagagcccggccacggaaccaggagccccaagggggccacaaaccggcaagcagaacaggcgaagcaggaagaaccggaagccggggnacggggccaaacagcg

SEQ ID NO: 54445 - DNA, 405 bp, Zea mays
  Clone ID: LIB3068-044-Q1-K1-B4
cccacgcgtccgcggacgcgtggggtaccctgacctggaggagacgagcaccgccgcgcgggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacctacgtgtgtctacctg

SEQ ID NO: 54446 - DNA, 100 bp, Zea mays
  Clone ID: LIB3068-044-Q1-K1-B5
cccacgcgtccgcccacgcgtccgcggacgcgtccggccacgcgtccgcccacgcgtgcgggcacgcgtccgcccacgcgtccgctagttctaatcgcga

SEQ ID NO: 54447 - DNA, 401 bp, Zea mays
  Clone ID: LIB3068-044-Q1-K1-B6
cccacgcgtccggccatcaccctgctccaagatcaagctcagagagttcattcactcaacagggaactgctatgcaaaggctgcggctacagtcaggccttaacaaaggccagcgtcctagtactgatgattcatcaagctgcattatagacgaaccaggaagtcagcacaaagcagaaaaagcagagattgaagaggatgcgagtacaaacctcgctggaagtgctgatgatctacctggtaatatccatgatgatgagcaaaagaacatccctgaacatggtgctgaaatgacttctccagaagccaaatctgttctgaggttgcggaagacttctgaggaaggcaacaaggatgtcaagcaggagagttggctcgagccacacgtgagagcaccaatg

SEQ ID NO: 54448 - DNA, 356 bp, Zea mays
  Clone ID: LIB3068-044-Q1-K1-C11
ccgacgcgtccgcgtactcgtaccgacgcccttttcaatgtccacgaaatctatactctcgacgtgcttatctcacgacatgtccgatctgttgtaacagatgtcccggcccagccgaactcagcacctgacactgtcttccacgccgatatgacctgctagcgactgccttggagcctaaacgagtggctgtgcaccgcttgcgacccacgtactgcgtatataacgctgatgtactggtatttcaatcgtgcacagaggctccaacttatcctacaactgtcacgtcatctgccaatgtctgactaacgtcaacctgaacatgatctgccttaacggctgattccgccaaagca

SEQ ID NO: 54449 - DNA, 147 bp, Zea mays
  Clone ID: LIB3068-044-Q1-K1-C12
cagacgcgtgcgcgcacgcgtgggcgcccttttcttgcacacggcaactatactctcggcggggttctttcacgacatgtcggagatgttcacacagatgcccacgcgcagccgatctccacatctgacaataccttacacgccgat

SEQ ID NO: 54450 - DNA, 273 bp, Zea mays
  unsure at all n locations
  Clone ID: LIB3068-044-Q1-K1-C3
gccagncgccangggcgagagggagancggaancaacggcnncggaaggancggcaggcncgnggccaggggcgcccnccagagcgaggangncgagcccgncgccgncaacgaccccnncancaccacggaccacangaccnacaagnncaaggacgacaccgnccacggccaccggaagcacagcgacancacacgcaaggaccccaagacccnncncnncggngacaagccggncaccgncnnnggcancaggaacccngaggaaaaccc

SEQ ID NO: 54451 - DNA, 424 bp, Zea mays
  Clone ID: LIB3068-044-Q1-K1-C7
cccacgcgtccgcggacgcgtgggcaaggttctgcaatctgtgaaccctattatgcctgaggaggtagtccttgggcaatacgatggctacaaggatgaccctacagtgccagatgactcgaataccccaacttttgcatctgttgttcttcgggtacacaatgaaagatgggaaggtgttcctttcattcttaaagctggtaaagcattgagttcaaagaaagcagaagttcgggtgcaattcaaggatgttcctggtgacatttttagaagcaagaagcaaggaagaaatgagtttgttatacgcctccaaccatcagaagccatgtacatgaaactaactgttaagaagcctgggttagaaatggctactgaacaaagtgaacttgatctgtcatatgggatgcggtaccaaaatgtcaaa

SEQ ID NO: 54452 - DNA, 335 bp, Zea mays
  Clone ID: LIB3068-044-Q1-K1-C8
cccacgcgtccgcccacgcgtccgtgaaaaaaaaaaaaaaaaaaaaaaaaaaaaaggaaagaaaaaaaaaaaaaaaagggaaaaaaaaaaaaaaaaaaaaaaaaaaaaaaaaaaaaaaaaaaaaaaaagggggggccgttaaaaaggaacaaaggttaacgaacccgagaatgcaaaaaaaaaaatttggtatagggtcaccaaaattaaattaacgggccggggtttaaaaacggagaaactggaaaaacccgggcgaaaccaaaataaatgggctggaagaaaaaaaccttttcgccagttagcctaatggcaaaaaggcccgaaccgatcgc

SEQ ID NO: 54453 - DNA, 369 bp, Zea mays
  unsure at all n locations
  Clone ID: LIB3068-044-Q1-K1-D1
cgggccgacgcacgcgnncggnnaaaaagcncgnagnnggaccccgggccgggccggccggnccgccncacggcgagagccgaccggcncgacccnncngccggcgaagcgccccnggccanaacnggccgggncgngccnccggcgccgnnaccccgaagaaannagagngcncaaagcaagccancgcncgggagacacnagcacgggaaaacancanaggannccggccccaccgggggggccgncgggaccggagnaangannaagagggacagncgggggcaagcgaaaaacacagccagaggcgaaannncggggaccaggaaagacgaacaacngcgaaagcacccgccaaggagggggnca

SEQ ID NO: 54454 - DNA, 405 bp, Zea mays
  Clone ID: LIB3068-044-Q1-K1-D10
aagtcagaatcagaacgagcttttacgctgttgttccacacgagatttctggactggctgcgctcatcttacgacacctgcggtatctgtcaacagatgggccgccccagccatactgtccacctgacaatgtatttcgcccggatcggaccgacgaggacgtgcctagtagcccatcggagggtcggtgcccatcttccgacccacgggataagttacatcaccgtaaaggtagcggtatgtcacttactgcccggaggctcccactcatcctacacctctgaagttattgcacatagtgcgactagagctacgctacacacggtattgtcttccagttgattccatccagcccgatcccttggctgtggcttcgctggatagtatacatggtcagtgggaatc

SEQ ID NO: 54455 - DNA, 406 bp, Zea mays
  Clone ID: LIB3068-044-Q1-K1-D11
cggacgcgtgcgcggacgcgtgggcggactcgtggctccgagggcagacagacttcctgtggagccttaacgtaatatgaataagaagctcattgggtgccccattgtgacttgcattccaaatgactctactgcaaaatctgatatgtatgctgctgtctcttctgtcttggctccatatgtaagatcaaaagcacataaccctgatgtgtctgctgttaagttaaatggcaatgggccaagtttgcacggcattgtcctgaccgataatggcaccaccagtgaagagggtctatctacatcaaaatcaaggtaggaccataatgcagctgacaatgagcttttaccgtttcagctttcattgactgatgaaaaaggtagtacacaaaatgctatagacatggat

SEQ ID NO: 54456 - DNA, 318 bp, Zea mays
  unsure at all n locations
  Clone ID: LIB3068-044-Q1-K1-D3
cccacgcgnccgcccacgcgnccgcggacgcgngggcgcccgccgncgcccncgcccagcgccgggggagcncggagacccggagncnncccccacccccanaacgnccacaacngccgagcccngcgnngccgccggcgggcgccgcaagccgngcgngcccgcgggaaccccganngggagnnaacnaacggaagnnnacaanngancaacaagacnnagnccaacccnacgagacaaaacaccanggnnacccnnnccaacagcngggcaagcgnagaaaggcagacaaaangnngggcgcaaagaaggaaagga

SEQ ID NO: 54457 - DNA, 378 bp, Zea mays
  Clone ID: LIB3068-044-Q1-K1-A7
caggttaagaaatctgtgccaaccttgcgcatactgaacgcaaagcccctagaggccacgtccaagagtgatacgaggtctacaaaagagaatcctcctagcaaagatgaagaccccattgggattgatgcaaagaaggataaaaggaagggatctaaacaagaggtaaagggccttgaagagcttgaagtccagagtgtttctacaggtatcaccacttcgaaccctggtaaacttgaagtgccagacggtaaggaaaagaaaaaggtcaaggaagctaagacgaagaaatctgaagagccgtaccatgccaataacagtagcttaaagaacaaagaagttcaatcttttgtctatgataccagcacgaaagacaag

SEQ ID NO: 54458 - DNA, 310 bp, Zea mays
  unsure at all n locations
  Clone ID: LIB3068-044-Q1-K1-D4
cggaancccgggccgacccacgcggccgcccacgcgnccgcccacnaaaacacggacacgagagacaacagaaaaaacacacaccaagggaagggggggcggccgcacaagaggacccaacccaaccnacgcgcgcacgcgacggcacagcccngcgagagcggcacccaaagccaaaaaacaggccgcgcgcaaacaaccccggaacgggaaaaacccacgcaagaccacacaaaancgcccggcagcacacccccccaacgcaggcgggcagaanagcgaacaggcccgaaccgagcgcccgcccaaa

SEQ ID NO: 54459 - DNA, 349 bp, Zea mays
  unsure at all n locations
  Clone ID: LIB3068-044-Q1-K1-D5
gnnaaaaagcncgaaganggacccggggccgggccggccggnccgccncacggcgagaagcgaccggcncgacccnncngccggcgaagcgccccnggccanaacaggccgggncgngccnccggcgccgnnaccccgaagaaannagagngcncaaagcaagccancgcncngganacannagcanggganaacancanaggannccggnccaaaagggnnggccngcgggagcggagnaangannaanagggacagncgggggcanncgnannncaaagncagaggggaaanncnnggannnangaaagacgaacaacngcgaaagcannngccaaggangnnnnca

SEQ ID NO: 54460 - DNA, 441 bp, Zea mays
  Clone ID: LIB3068-005-Q1-K1-C4
caaaggcagcggaggtggcgctgcagtccaccagttcttgggctcttggcaacgtcgccatcgtcatcggccatggttcttggcaacgtcgccatcgtcatcggctccggaattgtcggatcagtacttacaggcggtgagtttggccttcccgacttcagggatgcaatctctggtgctttcaagttcttgaccaagagtgcaaagccaggcaaggatgggccgtctaccagcagtccacatactgctgagttgttcagccaggtcaatcatctcagagaggagctgcaaatgttggctaaatcaaatcatgtttccattgtcactgttgatggtagacctggccctggtgcatacggtataacagctgttggtattggaagagctattggctatttattcataagatggaaggggtggaaactttctgatatgatgttt

SEQ ID NO: 54461 - DNA, 174 bp, Zea mays
  Clone ID: LIB3068-005-Q1-K1-C6
cgccacgcgtccggcctagctctatagctcgagtattgcttgctctccacatgaaacaaagcagggcagcaacaatggccgtcggctcggtggtctcggtcctcctgctgctcctggccgccgccttggctggcatgagcgccaacgccgtcaccttcaccatcaccaacaact

SEQ ID NO: 54462 - DNA, 415 bp, Zea mays
  Clone ID: LIB3068-005-Q1-K1-D11
cataggtcagtctttgggctgatctatgctggcaccccatatcagatttccaggagaggactgggggattgatcactgtgttttcatgtggcattgcacatttgtggtcaactagggaaacagattggtgccgtattgtactttcatgggaccccccctctgaaagagttgagaagtgtacagtcatcggcagtcatctagttagcgctttgtgctaggaggttgtgaccagtggagctctatttggcatattggaatttggaatccggctacattgttgtacagacctttgattgacgtagcttgtagaggatgtatgagtgaacagggccatgctttgaagcgaacaagttataggcatatgggagctggggatcatccgagacagatgccgcttcgagtgtcactgtacttg

SEQ ID NO: 54463 - DNA, 289 bp, Zea mays
  Clone ID: LIB3068-005-Q1-K1-D5
gattccttttccaagggaggtcccatttcgtttgcagatctgatccagtttgcagcagagatcagcactgaagagatcgtttcttgacgctgccattgccaaatgtggcggaaatgaatagaagggaagaacactgtactctgcatatggttcaaatgggcagtggggtctgttcgatagaacgttcgggagagcagactcacatgaagcagatccagatggaagagtgcctgactggagcaaggcttctgtgcaggatatgaaagataggttcgtttcttttgggttg

SEQ ID NO: 54464 - DNA, 77 bp, Zea mays
  Clone ID: LIB3068-005-Q1-K1-D6
aggacacctgcgttatcttataacagatttgccgccccagccaaacttctcacctgacgatttcttccttccggatc

SEQ ID NO: 54465 - DNA, 372 bp, Zea mays
  unsure at all n locations
  Clone ID: LIB3068-005-Q1-K1-E1
cgcgatgcagctggcgtcgtcgtccatcctgcccatgacgctgaagaacgccatcgagctgggcctgctggaagtgctgcagaaggaggccggcggcggcaaggcggcgctggcgcccgaggaggtggtggcgcggatgcccgcggcgcccggcgaccccgtcgccgcggcggccatggtggaccgcatgctccgnctgctcgccttctacgacgtcgtccggtgccagatggaggaccgggacggccggtacgagcgccgctacttcggcgcgcccgtctgcaagtggctcacccccaacgaggacggcgtgtccatgggccgcctcgcgctcatgaaccaggacaaggttctcatggagagctggtacta

SEQ ID NO: 54466 - DNA, 358 bp, Zea mays
  Clone ID: LIB3068-005-Q1-K1-E11
acggttgacgtgtgtggaactagttacatctgtatacttatatcgtcatgtgttcaactgttagagccacttatctagcaatgttgaaaattggaaatagtgagtgatctgatcctcgtaagcatatcacacaaaatcaagatatggtacatgacgtacatccttgactggattattttttgatgccctatacagcgctaagtcttcttgctgcgagacaaaaagctatatcacgctcatacaacatggtggtacaagatataacatacgatcattgctcgttcaaatacaacccttagatccaatcctatttacaaacatacagatacgtttttccgactaatcttgcctacattga

SEQ ID NO: 54467 - DNA, 456 bp, Zea mays
  unsure at all n locations
  Clone ID: LIB3068-005-Q1-K1-E2
cccacgcgtccgctactactcatcactcgccaacgtgcagagatcagggaagcggcactccgtccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaggaacccgggcaacaccaacaacccggcgggctccgtggtgacggcggccaacgtggagaagttcccgggcgtgaacacgctgggcgtctncatggcgcgcatcgactacgcgccgggcggccagaacccgtcgcacacgcacccgcgcgccaccgagatcatcttcgtcctcgacggcacgctcg

SEQ ID NO: 54468 - DNA, 488 bp, Zea mays
  unsure at all n locations
  Clone ID: LIB3068-005-Q1-K1-E3
atcgaatcaatcaagacagccccgtgctagctcacccgccggggctcgccacgatgagaggcctcctcgcgtgcgccggcctcgcccgccgcgccgccggctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactncgtcatcgccaaggtcaccgaccaccacatctac

SEQ ID NO: 54469 - DNA, 465 bp, Zea mays
  unsure at all n locations
  Clone ID: LIB3068-005-Q1-K1-E5
gaaaaactagaccaggttagtgagatgtcaagtaggttgacttcggatactagaatctatgcagaaaaggcgaaagatctcaatcgccaggcattgattcgtaaatatgcccccgttgctattgtgattgggatagtggtgatgctcttctgggtgaagaacaagatatggtgactggtgccatcttgcgatttcacagttatcatgctggaaccagctgagttgtcttgtcttccctcgtgcaaccatatgtttgatcgtggtcccaaaaagaaaagaaaagatggctcgatggtttatcccgcatctgccgattcaagcgactactntagctatcaaaagcaaaaccacggtagtagagatagccttggaactgcacatttctattaactggacatgtataaatagttctcgtgagcgcacaccatgtaatccgtcaaattcatccatgtggtgtgacatttt

SEQ ID NO: 54470 - DNA, 453 bp, Zea mays
  Clone ID: LIB3068-005-Q1-K1-F10
cagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgccttgctctcgggttcgtc

SEQ ID NO: 54471 - DNA, 415 bp, Zea mays
  Clone ID: LIB3068-005-Q1-K1-F11
catgacaccactgaccgcttgtcttccaggagaccgggagcttctgcaagaactttacgccacgtggcaagtcttcagacacgggtgaactgacacagggcccccagcaagctatcatctgcgttttctggtactcatgataagtgtgcatcttgccataaaacagtgtacccgctggagaagttaactctggaaggcgagtcctaccacaagagctgcttcaagtgctcgcacgggggctgcatcctcaccaccttctcctacgccgcgctcaacggcgttctgtactgcaagatccacttctcgcatctgttcatggataatgggagctacatccacatgatgaataagagcccgtcccaatatacacttccggacatggccgtcgactagcaaccgccggaaccggcgccac

SEQ ID NO: 54472 - DNA, 372 bp, Zea mays
  Clone ID: LIB3068-005-Q1-K1-F12
cccacgcgtccgcccacgcgtccgcccacgcgtctttgataaatgagaagccacaggtgattcaggagtttgaataaggcaaggcattcccaaaccagcgattcattaccagcttcaaaaggcccttggaaccaaattgccttgccaggaaatacctttctacaaggttgtgttccggagcatcataataaggggaagacaaagcaagctgtctgcttatttgtctatgtttggtatctcaagtcctgcggactgtttctgttggcacaagagggaattaatgtgttcacagacctgtaatgcttgctccttgtcatatgaccttgctctaaacatttgtgatgaaactgtcaaaggtatatattttctttt

SEQ ID NO: 54473 - DNA, 469 bp, Zea mays
  Clone ID: LIB3068-005-Q1-K1-F4
cccacgcgtccgcccacgcgtccgcggacgcgtggggcgccggtccagcctcttcgacatggtgccgatttgcgagaacagtacgagcatctccgatccgctggacgtggcacgccatggcgtcgcctcggcagactccgagagggcggccgtggacctgacgaatttgacgacggagggtgacgacggcaggagcagggacgttgtgtcgtcggcgtcaggtgcagggaccacactgcggttcctggcagcggcagctcagacggagccgctgcatccttcgtcgtcgcatggccatgggcgcggccaccactgctctccgttggacctggagctgggcatgtccctgcccggcccatccgtcggaacgtgatggagatgagtcgaggccgatgccgtgcgtgactgctgtctccctcagctgtgtgtgtcagccagatggagatgatgcgctagccaatacagtact

SEQ ID NO: 54474 - DNA, 392 bp, Zea mays
  Clone ID: LIB3068-005-Q1-K1-F9
tccacccgtgcgtcaacccgtccggtctggaagcccgaggtggtgttactgtaaacatcaggtggtgaggaagggagcctccatgaagctctgctatggtctagcgccgggcagaataccctttcaaggctgcactacggtgaccagattgccaccgtcagcctatcatcgggtcaagtttacaggttcagcatggatttgaagtgcttgaagacttggcccctgtgatagcacacatttgctgaaatgaaagataccattgattgtgcacaaattcatgaaaacttctggctggcaagaaaataatcgatttcatacatcaatcataacacgtatcatatttcttaaaacacaagcatgtgcagctcattcacctttacgaccatatcaac

SEQ ID NO: 54475 - DNA, 326 bp, Zea mays
  Clone ID: LIB3068-005-Q1-K1-C2
cccacgcgtccggcctagctctatagctcgagtattgcttgctctccacaagaaacaaagcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgatacccggcgggacgtggaccgtcaacgtgccggccggcaccaagctcggccgcgtgtggggccgtaccggcttgctcttcaacggcaacagcgggagct

SEQ ID NO: 54476 - DNA, 396 bp, Zea mays
  Clone ID: LIB3068-005-Q1-K1-G10
tcccacgcgtccgaaaaaaaaaaaaaccaacttacttattaaccaaaaaaaaaaataaaaaaaggcaagtaaaaataaaaacgtacagtagaacaactaaaaaataacaaactaaaaacttaccacatctttatcaatccactaccaactatactcgtccaactcgcacatcttcatttcctacttctaccatacccaccatctaaacaaacatctactatctcataacacatactctgactctctaacaacacactatctcttcatcatctatacaatcacacttacacttatcctctatctaacttcctcactaaacccacacttcctttcactactatctctttctcatcattaacctcctcattgctcatcactcacctctcttttactctc

SEQ ID NO: 54477 - DNA, 138 bp, Zea mays
  Clone ID: LIB3068-005-Q1-K1-A3
acgggacggaattcggtcctgcggatattcaagggccttctgtggcgcatccgacaccgctcgaggtgcggtgctattacagacggtggaccctactttcagctgaaccgattccagggttggcgttccgttaagcat

SEQ ID NO: 54478 - DNA, 316 bp, Zea mays
  Clone ID: LIB3068-005-Q1-K1-A4
ccaggatgatcaaggggattattcgtcagtgagcatggatacagcagtggcgattcggacactagaagcaacatacaaacaatcagctgactctgttgcagttgaatcaatgattgcaaagttgacagagaacgaaggtccttgcttaaaaggtaaaggcagggccagtgatgcagcatgaatcgcggttctgacctggagatcgttgctacatatgtcaagagatgggaagtacttctgcatcaagcttgccttgtatatgcttattgctgtgacaattagaacgatatttaccgatattggccattcactatca

SEQ ID NO: 54479 - DNA, 316 bp, Zea mays
  Clone ID: LIB3068-005-Q1-K1-A5
cccacgcgtcctaaaaaaaaataaaatataattatccaataaaataataaaaaaaaaagacaaatgtaaaaaaaacaaaaataaaaaaattaatatctaacaaaaattatatttaaattaccttctattttctaaattctattatatacaagctctttctcttaaatttttctactttaattcccttttactttcttatcctttcttttttattcctgtctttcttaatcctttttattctttgtttttttcatatcccttttttttaaaaaactttttttatcccaaaatatttccctttatttaaatttccttt

SEQ ID NO: 54480 - DNA, 440 bp, Zea mays
  Clone ID: LIB3068-005-Q1-K1-A6
gtttgggatttcattcgcaacaactgagcgcagggtaggaaggcacctccaaggaggaagaggggctcgcagacattgccatccaagctttctccacgacatcaactgacagcaccaacagagtggccagagcatgagcacgagcgcccccagctacactcccacagctgcagcccgtcgtcgcgtcgtcaccacgccacagcggacactgaccctgtcaccaaatgttggtgacatacacgagcgttactgctatctccaaaacgtcaagtagttagaatgtagattatccattcttaatatgatattctacaatctacatttctgtaaacaatgattattttaccttttcttgttgattgtgagcataactgtagagctcaaagagcttctctggatctgtcatgtgggttatggtttacatttgcacaccatgtggg

SEQ ID NO: 54481 - DNA, 472 bp, Zea mays
  Clone ID: LIB3068-005-Q1-K1-A7
cccacgcgtccggtcaccactcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgtcagcatcccctccaagtgcggcgtcagcatcccctacaccatcagcaccttcaccgactgctccagggtgaactaaaacctagaccacgcgcgacgac

SEQ ID NO: 54482 - DNA, 389 bp, Zea mays
  Clone ID: LIB3068-005-Q1-K1-A8
agcgaatccatccccatcctcatgattataaataaataataattttacacgccctcctctctggggatttctcgcggagcggccctccacctttatcgccgccgcctccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggtgcaccccgtccatcaccgagtccaagtccaagattgatgccaggacctcctgcttctggatatgaccggtcacctctattttac

SEQ ID NO: 54483 - DNA, 365 bp, Zea mays
  Clone ID: LIB3068-005-Q1-K1-A9
agagcatcgtggccagcggcctcgcccggcggtggctcgtgccagggtcctaagccattcgggtgccggaacccctggcagtggtcggcgacttctaacggcaccgggaccatccccgacaaggagatcctcaagatcgtcaaggagaacttcgacttcaggcccgggatgatcaccatcaaccttgacctcaagaagggcggcaacaggttcatcaagaccgccgcatacggtcactttggccgtgacgacgccgactttacctgggaagtggtcaagcccctaaagaaggcattcgcttaagaatgatttgtaaggtcactggacatgatgttcattttcgtcttgctctgctgatacctgca

SEQ ID NO: 54484 - DNA, 439 bp, Zea mays
  Clone ID: LIB3068-005-Q1-K1-B10
cagacgcgtgggccgagtgcgaaccaagcataccatatcaagaagaagcgtagtcgtcgtcggaagtaaatgcgcgaagcaagatgtcgtgtcacgcgtacgtcgacgagcacttgatgtgcgagatcgaaggacagcatctcagcgccgtcgacatcgtcggtcactacagcagcgtttgggctcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaatggcactgggggcattactatcaagaaaaccggcatgtccttgattattggtgtctacgacgagccaatgactccaaggcaatgcatcatggtggt

SEQ ID NO: 54485 - DNA, 306 bp, Zea mays
  Clone ID: LIB3068-005-Q1-K1-B2
gaatccatccccattcccatgagtttaaataaataattattttacacaccctacggtcggtggatttctcgctgagcggccctacacctttatcgtcgtcggcttcgccgacgttgctgtgttccgtcttttcgaccatggcttctgccaagatcagtgctgcccagcaagtggagaaccgaagcgcgctttccaaaaggtcacgtaaccacctttctgtaatggaaggggactggaaattgcctcaatgtggtaatgtcaacttcaattttagaaatgtttgaaaccgtggaacctgttgtgcac

SEQ ID NO: 54486 - DNA, 62 bp, Zea mays
  Clone ID: LIB3068-005-Q1-K1-B3
acccagctcgctcgtcccatctgatcatgtcgtgcacctagtagcgacctgctctatcatca

SEQ ID NO: 54487 - DNA, 393 bp, Zea mays
  Clone ID: LIB3068-005-Q1-K1-B4
acgagctaatgcatccccatcctcatgattataaataaataataattttacacgccctcgtggcgggggatttctcgcggagcggtcctgcacctttatcgccggcggctcctgcgccgttgctgtgttccgtctcttcgccgatggcttcggccaagatctgtgctgcccagcaggtggagaaccgaggcgcgctgtccaaaagggcacgtaacgacgtgtctgtaagggagggggactggaattgtcctcagtgtggtaatgtcaacttcagttttatgaaatgtttgcaaccgtggaagccttgtgtgcaccccgtccatcaccgagtccaagtccaataatgatgccaggaccttctgcttctggatatgaccgggcacctttatttta

SEQ ID NO: 54488 - DNA, 421 bp, Zea mays
  Clone ID: LIB3068-005-Q1-K1-B5
cgctgctggcctgcttcacggggttccagtgccactggatctactcctgcacgtaccgctcgaagatgcgcgcgcagctggggctccccgacgtcggctgctgcgactgctgcgtccacttctgctgcgagccgtgcgcgctctgccagcagtacagggagctcagggcacgcggcttggaccccgcgctcggctgggacgtcaacgcccagaaggccggcgccggcatgatgtacccgccggcggcgcaggggatgggccgctaattacgctacgaccagctccatcggtaaactgatatgtgttgtgttgtgttgtgtcagccagatcatcggtaaactgatatgtgatataatgtcagggaccggcatgcccatgtgtttcaagatatttcacgttcgagtcctttctgtcagctcac

SEQ ID NO: 54489 - DNA, 459 bp, Zea mays
  Clone ID: LIB3068-005-Q1-K1-B6
cccacgcgtccgagcgatggtcctgttcatggctggcgccgcgctgctcgccggggctgtcggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcacgcgggagctcgtcgccttcttcgggcagacgtcccacgaaaccaccggtggatgggcgactgctgcggatggaccgtttgactggggatactgacggctgaaggaacagaaacagacggacctaccctactatggacgaggacccatacagctaactgatgaggacaactacaggctcgccgggcaagcgctgaacctgaacctggtgggcgacccggacct

SEQ ID NO: 54490 - DNA, 133 bp, Zea mays
  Clone ID: LIB3068-005-Q1-K1-B7
tcggtgtgtgaacagtcttgggaacggcttcgttcacgccgtcgacgaggactgtgtcggggcggggcactttttagactgcgccgtgcgcccgagcccggaacgctctcagatcgtggagctgctgactttt

SEQ ID NO: 54491 - DNA, 266 bp, Zea mays
  Clone ID: LIB3068-005-Q1-K1-B8
acgacaaacagcctagctctaataagctcgagtattgcttgctcttcacaagaaacaaagcagggcaccaacaatggccgtcgcctactcgtcctcggtccttctgctgctcctggccgtcgacttggctggcatgagcgccaacgccgacaccttcaccatcaccaacaactgcgggttcaccgtgtggcccgcggccaccccggtgggcgggggcacgcagctgaacccgggcgggacgtggaccgtcaacgtgcccgccggca

SEQ ID NO: 54492 - DNA, 334 bp, Zea mays
  Clone ID: LIB3068-005-Q1-K1-B9
cacgcgtccgaccgaattccctgcgattcctctgccctcgcctactcggctggggctatgggatcgtcggagaggaatcgcaaaaagggccgtctcatccgagttaaggaagccatggagcacaaggaggctgggtgccaggccccctatggacccatcctctgcattaataactgttgcttcttctgcagcgcggcgaccatgaacatgtgctctaagtgccacaaggagatgattacgaagcatgatcaggccaagctggctgccttctgtatcgacagcatcgtgaacggcaaccacgccgtcatggagcccgttggtgcttgcagcaaca

SEQ ID NO: 54493 - DNA, 338 bp, Zea mays
  Clone ID: LIB3068-005-Q1-K1-C10
tccacgcgtccgcggacgctttacgacctgttgttccacactagatttctgctctcctttagcggaggttatgacacctgcggtatctcttaacacatgtgccgccccagcctaactctccaactgacaatgactactgtccagatcggcatcacctggccgcaccttagatccaacatgaggcgctgcgtctcgtattccgacccacacaatatgtaaaatatccttaaactgatggatctttgactagcacctggaaagctccacttatactacagctttcaggtgatcagacagcgtctgactaaagaacacctccacaggcgtttgctttctca

SEQ ID NO: 54494 - DNA, 349 bp, Zea mays
  Clone ID: LIB3068-005-Q1-K1-C12
cacctgccttatctaacaacatatattccttctaacccatactttccacatcacaatctatttcctcctcatctaacctactatgacctaccttttatcacaaaaaactatctatacccctttttctacccacataattcataacataaccctaaaaatattattatttcacttacccccataaactcccacacatcctacacctcataacctacttcacaaactatcactataatccctcttcacactttcttcttctccccctctattaaaccaaccccattccctttcatatcctactctttatattatacacctacattacctaatctcaacttattcattcatt

SEQ ID NO: 54495 - DNA, 423 bp, Zea mays
  Clone ID: LIB3068-005-Q1-K1-A12
gcttgaggagcagagggttgagtgcattgctcagctagaagagaacaatatgttgagaagtgaaggcaaagacattgctgatcagtgtaacattactcagcagaaatatgctcaccaattgaaagagaaaatgatggaacttgagcttgctgatctgagacttcaacaacatcaagagaaggctgctcacgaacatacccaaatgcaattgtatgccgagcaagtttctcagcttatgactactgagaagaacctgcggttgcaactagcttcggatggagaaagatttcagcactttcaggatgccctgtcaaaaagcaatgaagtctttgaaacttacaagcaggagatggaaaaaatgattttggtgataaaaaatcttaagaaggacaatgaatttctgaaaggaaaatgtgagaactc

SEQ ID NO: 54496 - DNA, 333 bp, Zea mays
  unsure at all n locations
  Clone ID: LIB3068-004-Q1-K1-B7
gcaagagcgacagagagagagagagagaccgacgcgccggcagatcccaagttcagcgganagggggaagaggngcgaccgaagcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccaaatcaaccaggccgccggccgtcgggacccctacgacgacc

SEQ ID NO: 54497 - DNA, 138 bp, Zea mays
  Clone ID: LIB3068-004-Q1-K1-B9
catcaatccatattctttctttctcaccataacttcctacacccttgtatattttaaaaggatctctcctccatcacacaatccattctatcttccatcacccatcctacaaacatcccaactcaaatttcacctcac

SEQ ID NO: 54498 - DNA, 262 bp, Zea mays
  Clone ID: LIB3068-004-Q1-K1-C11
attattgtggctatattcaatcatgatctttgcaacaatagtgaaattaggtctgtggggctactgccgaacgtctggtgacaagattgtccgtgcttatgctaaggatcactatttcgatgttgtcacaaatgttgtgggtttggctgctgctgtccttggtgatagattctactggtggattgacccaattggtgcaattgttcttgcagtgtacacgatttcaactggtctggaacagtgtgggaaaatgcagtatcgc

SEQ ID NO: 54499 - DNA, 301 bp, Zea mays
  unsure at all n locations
  Clone ID: LIB3068-004-Q1-K1-C12
cccacgcgtcctaaactaaacaacacctatttctctaaagatcacaatgatnagagcccgtgctgttttagccgtgctggccacctacttcttcnctgtgcccactcacgccgagcagtgctggtctcaatccagccgctcgctgtgccccaactgccttttcttcagccaattctggtagtgcatcagcacctcctactactgcggcaactggtgccaaaaccagtgcaactgcagcttctgcatcacccctaacccttctaacaaccgcggcatttctttcattattccctaatctctc

SEQ ID NO: 54500 - DNA, 120 bp, Zea mays
  unsure at all n locations
  Clone ID: LIB3068-004-Q1-K1-C7
gcccacactatnacatccactcttacntcctctttcatccaacntaataactcttttatactcttacctaaattcaattcattttttctactttttacaacctaaaaacttcaaaaaccc

SEQ ID NO: 54501 - DNA, 278 bp, Zea mays
  Clone ID: LIB3068-004-Q1-K1-C8
cccactcgtcctaaaaaaaaaaaaattaaaaaaaaaaaaaaaaaaaaaaaaaaaaatgtaaaaataaaaaagaaagaagggcaaaatatataaaaaaaaaaaaaattaaataaaaatacatacaaaataataaatattttattatgttacctaaattaaattttttaaacatctttttacaacataattaaataaaaaaacctttgtgttccccaatttaatctcttttaaaaaaatacccttttcgctaacttatttaatatctaaaaagccccaac

SEQ ID NO: 54502 - DNA, 173 bp, Zea mays
  Clone ID: LIB3068-004-Q1-K1-C9
gcggcaagaaggaaggcactgcacagggagtccttgttgggcctgctggacagtaggacttaattagatggattgtgtgtaaaagatgaggaccgatgtgaactgaagtagtttctttgtcacctcttcgggtgctgcagcaatccaagtttttgtttgttattgatgaccca

SEQ ID NO: 54503 - DNA, 182 bp, Zea mays
  unsure at all n locations
  Clone ID: LIB3068-004-Q1-K1-D5
aacccggggcggccgcgcgtccgcccacgcgtncgcccacgcgtccgtgatggtgttcggcgagatcaccaccaangcgagcgtggactacgaggagatcgtgcgcgacacctgccgcgagatcgggttcacctccgacgacgtggggctcgacgccgaccgctgcaaggtgctggtgaaca

SEQ ID NO: 54504 - DNA, 325 bp, Zea mays
  Clone ID: LIB3068-004-Q1-K1-D7
cgagacgatcgagatgacggcgccggtgctgacgcgggtgtcgcccagcgacggggccttctgcgcctgcgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcggggagcaggcggcgcgcctcgaggccagcctccagggcacccggtgggccgccgccgtcaacgacgcgcgcagggccgacccggccttgccctacaccgtcgcgcagtacaac

SEQ ID NO: 54505 - DNA, 376 bp, Zea mays
  Clone ID: LIB3068-004-Q1-K1-D8
tttctctaagaaggattggtatgacatcaaggcaccgtcggtgttcagtgtgcgcaacatcggggggactctcgtatcggggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaac

SEQ ID NO: 54506 - DNA, 396 bp, Zea mays
  Clone ID: LIB3068-004-Q1-K1-D9
cccacgcgtccgcggacgcgtgggctaccctcgtcgtcgtctcactcaccccgccgtcacgcctccctcgccaaatgaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagct

SEQ ID NO: 54507 - DNA, 165 bp, Zea mays
  Clone ID: LIB3068-004-Q1-K1-E1
ctgtttcatatctctgcaacagtggtacgcgaggaagtgaattcatccaatgagacggaaaacagtgatgagcaggagcagatcatgattgcccgaaccctcctcaactatcgcttgaaggagaagatggcgatggccaattatcctcatgtttcaccattccct

SEQ ID NO: 54508 - DNA, 257 bp, Zea mays
  unsure at all n locations
  Clone ID: LIB3068-004-Q1-K1-E12
ttctaatcncgaaggccgccctttttttttttttttggttgggtaccatggcatgctgattttctgaggggagacgtcctatanactacagtaacaaaaaccaccttcaagccggcaagcttcaacccactttcacaaactattgagcaccaacatttttgatggcaatatatacacacttgtatttacaacttcaacgcttgaatctgaagaatcacaactcaaaaccaccattcaatttaacaaataaccaccgc

SEQ ID NO: 54509 - DNA, 192 bp, Zea mays
  unsure at all n locations
  Clone ID: LIB3068-004-Q1-K1-E2
atgaaatgcttaagttttgtgcatctaacaaaatatatccaaagatcaangtcattgaaatttacactaggagcgaggctctctagaggcctgtaaatcgtgatgtgaaataccgctttgtaatttcagaaataatctattacctttgatgcgtccagccactgaacgagacatatacattgtatgttactt

SEQ ID NO: 54510 - DNA, 158 bp, Zea mays
  unsure at all n locations
  Clone ID: LIB3068-004-Q1-K1-E6
cttgctgttcatctgtccaaaactgctaatatagcttctgaaaatggatgacatgctgggcacttgctcactggggtcttgattttnattttgaaaagttctgttcaatctccttgtcaaatttgaatgtgtatgcgtgcttggtctgtggaaaatat

SEQ ID NO: 54511 - DNA, 329 bp, Zea mays
  unsure at all n locations
  Clone ID: LIB3068-004-Q1-K1-E7
cgctcatccgcccgcccccgcccgcgtagaaggaaccctagcctagccttgctccgggcggtcgccgcggcgactgcgacgatnatngactgcgctggaggccgagaccccgtggaggacttcctcctcggcggcgccggcgccggctacgacggagatctcgtcgccgtcttctgcgacggcggggccggcgacggaggacttgggattgaaggtatccatggagatgcttgtggatttgagcaatctaatttggggaaaaagggtagagatgaaccatgttcatctggcccaacatccaaagcttgtcgtgaaaaaatgaagaagga

SEQ ID NO: 54512 - DNA, 146 bp, Zea mays
  Clone ID: LIB3068-004-Q1-K1-B3
cccacgcgtccgaaggaccaagggatcaccgtggttgctggtgttgaagctagagggttcatttttggtgctggtatggctttatccattggcgcaaaatttgtgcctttgaggaagccgaagaagttgccaggcgaggtgatctc

SEQ ID NO: 54513 - DNA, 338 bp, Zea mays
  Clone ID: LIB3068-004-Q1-K1-E9
cccacgcgtccgctcgtctcccttctcgtctacagcgacggcgaaggcgaagcgggggagcgggagcagaaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctccaccacctctaaatgatgtggttgcgggtgtcaccggcaagaaaaagtagtgaacttgcattggtttctcatgtcgatgctgtcccacattttcttccccatgtttt

SEQ ID NO: 54514 - DNA, 143 bp, Zea mays
  Clone ID: LIB3068-004-Q1-K1-F3
ggctctcaggagagtgatatcaagtgtgctcctccctgctacacctactctgtaatgatacatgatcaagggcgactggttttctattgataactctctcatgatcgtactcttcttatctgggatgacggcaatgattatgc

SEQ ID NO: 54515 - DNA, 224 bp, Zea mays
  Clone ID: LIB3068-004-Q1-K1-F9
aaaaaaaaaaaattaaaaaaacgatttattatataaaaaaaaaaaaaaaaaaaaattgtaaatttaaaaaaaaaaaaaaacaaaacattccaataaataaaacaatataaaatatctcttaaaaataaaaaaaatatactttctctttccccttctataattccctattttcttttcccctttttttcccccctctcatctcctcttctttccctctttctcta

SEQ ID NO: 54516 - DNA, 356 bp, Zea mays
  Clone ID: LIB3068-004-Q1-K1-G9
ccacgcgtccgtccactcctccttccacacttccgctttcttttattccacacgagatttctcttctggttgagctcattggaggacaccttcggtatcttttaacaaattttcccccccaatcaaactccccaccttacaatttcttctctcctgatcttcccatctagtcctttccttttatcctaaatgattttctttaccctcatttctaccctttttttattttaaatctcttttataatatttttttccactttcttccttatctttcctattaattctacaatcttttatctcatattcaatattctattttctttcttctttcctttcttttttttttttcttctttt

SEQ ID NO: 54517 - DNA, 335 bp, Zea mays
  Clone ID: LIB3068-004-Q1-K1-H9
cgtacgccaccaccaccgcctgaccgccccgacgcttctcccctctggcgctatggcccaaactggtgtgctcaaggttggcgtgtgctgtgaggactgtgttggagctgtcaagcgggtcctgggcaagatggaaggcgttgagtcctacgacgtagacatcatggaacagaaggtcaccgtgaaaggcaatgtgacacctgacgccgtcctgcaaactgtttccaagactggcaagaagacttcgttctgggaggctgaagccgtgacaagtgaatcctccacaccttccggtgccaccgcctgacaagttccatgatcacgaagttccccgc

SEQ ID NO: 54518 - DNA, 430 bp, Zea mays
  Clone ID: LIB3068-005-Q1-K1-A1
cccacgcgtccggcaggtcgtagcaacacctcgatggctcgatccatgtcgtgtcgtcgtcgctgttgcccaccctcctatttctccattcgttgctccgctagttacagtggtcgcctcttaggtgttacagtaaaaaaaatattattggtggtgatatggttatttattgattcgttggggtaattaataagaaccctcaagcttggggtcttcacggagaggttgaatcgatgcggtgaaaacggcacgtgaagggtaataagagatcgatcgagcggttaaagagaacaaggagacagagacaggtggcagatgacgcagtggatgtttttcactgttactgcggtaatttttgtgcatgcggctactactgtacagtggggtagtttggtacaagagaggagtaaaaaaatggaaagagaggact

SEQ ID NO: 54519 - DNA, 377 bp, Zea mays
  unsure at all n locations
  Clone ID: LIB3068-005-Q1-K1-A11
gncgtttatgttccacaccgagaaatttctggttctcgtctgagcctctatcttagggacgaccttngcgttatctttgaacgggatgtgctcgncccagcgcaaagcgtccccacctgaccaatgtcttctcgcnctcggatcggcnctcggcgaggcccgggcccttggagcccaaaaggaaggggcggtgctcccgacttacgactccacggaagtatgtcaaataacacttcaaaagtagttggtatttcactttgtcgcccggaaggctctccacttatctctacancctctcaaagtcatattcacnacaagtcggactatgagtcaagcctcaacaagggtgcttctttcctccgctgattcccgccaag

SEQ ID NO: 54520 - DNA, 394 bp, Zea mays
  Clone ID: LIB3068-001-Q1-K1-A1
tttcaagatccaaccagtccattctaaaggagatcagtcctgggtgttttggagggactgatgctaaagctcaaagtccaatactttggccacctcatgcgaagagttgactcattggaaaagaccctgatgctgggagggtttgggggcaggaggagaaggggacgacagaggatgagatggctggatggcatcaccgactcaatgggcgtgggtttgggtgaactcggggagttggtgatggacaggcaggcctggcgtgctgcgattcatggggtcgcaaagagtcagccatgactgagcgactgaactgaaccgagcctcagtttgcaaagttagacagttggaaatgcaagtttagatcccagggtttctgactggaaacttgatatct

SEQ ID NO: 54521 - DNA, 421 bp, Zea mays
  Clone ID: LIB3068-001-Q1-K1-A10
ggcaggcgcgttttggcctgccacatggaacagccctctacgccaggaagttccggctctcctgctcagaaatgaatggtcgttacttcagcaatgaattcatcgtggaggtcagcgttctgcacagcgtgaaccgggtggcccaccccagccacatgctcagctcccagcagttcctgcaccgaggtcaccagccaccgtctgagatggctggacacagcctggccagctcccaccgcaactccatggttcccagtgcggcgaccctcatgatcgaggagtgcgtgggctatctggtgctcatggtcatgctgggtctcgtgcgcattcactgactgcaccgccgcgtctcggaggccagtgggcctgccggagccttcagcgaccccaaggatcccgatctcttctgggatgactcagc

SEQ ID NO: 54522 - DNA, 418 bp, Zea mays
  Clone ID: LIB3068-001-Q1-K1-A12
cggacgcgtgggtctagatcgcgagcggcctcccttactttccttttgtcttttctcagctgcgtccagtctactcttgggcctgttgaataaatttctcatcgccaagaaagtgctttatttttatttttaatttctagcattccttacactctaaccctttcctctgcgccctgttcctcacagccggcctgcagcatccctggcaccaccctacccccaggtacctgaagtttagcatccagcatgggccacatgaccccatcatgtcggtgtgcctgcccagcaacccctgggtcacagacgacgatgcctactgggccatgaacgctcccaggtgagcaggtcggccaagggtgcacgagtgcccaccccattcctgacactcttgacccgtccgtcctttaccaactcggtc

SEQ ID NO: 54523 - DNA, 415 bp, Zea mays
  Clone ID: LIB3068-001-Q1-K1-A3
ccgcggccggacgcgggtcgatcgagcgtgcgagagctcggtggacatctacttccggcggcaggtggagctgagcaccatgtaccggcatatggagaagcacaactacgagagcgcggcggaggccatccaggccgtgcgcgacaacaagctgcacgctttcatctgggactcggcggtgctggagttcgaggcctcgcagaaatgcgacctggtgaccacgggcgagctcttcttccgctcgggctttggcatcggcatgcgcaaggacagcccctggaagcagaacgtctccctgtccatcctcaagtcccacgagaacggcttcatggaagacctggacaagacgtgggttcggtaccaggagtgcgattcgcgcagcaacgcccctgctaccctcaccttcgagaatatg

SEQ ID NO: 54524 - DNA, 422 bp, Zea mays
  Clone ID: LIB3068-001-Q1-K1-A4
ggactttgaggttaaaaacagttagatttgtaaagaatttttttcatttaaaattgaaaatactgatgatatagtcccagaacacactggggggtaaatgggtgtgacaggtaatgttagttttcatctcatttagtttgaggtcccctaagagctgcttcctttttttcttcccgtcttgttctctttgtgagagactttgaaggccaagttctaaggaaataaagagtaatttagatttaaagatgtttaggaggcggttacacaaagaaaaagtatatgagctacaaacaaactctgccccatatgtgcggtcttttattttctgagagactgctgtgaatcccatggtactccagctcacattctgttgacatgtatgtcagcaggactgggttttgtcgtcacgcgtgcctggcgtc

SEQ ID NO: 54525 - DNA, 417 bp, Zea mays
  Clone ID: LIB3068-001-Q1-K1-A5
ttatactgtaaattcactttgcccttgattattcagaagttcagaagtaagtgaatcctctccatgaccctaactgagcctttgcttagttttcaggaagaattgctatcctttaaatactaccctacaaaactgaacaaatcactgtccatatctttgggacagtctcctttccagataggccaggacaaggatacatacatttcactcatttatcacatgaagcagtatgtcataccagaaaaacatggcttaagaatcaaaggagacctgaattgtagttttgccaccgggtcccattatctcttcaggcaatttcctcagtttctctggatgcagattccgcatttataaaagggatagtcagaccctattggtaagattctgtaacttggtaaaaatcatatgccaaacacc

SEQ ID NO: 54526 - DNA, 423 bp, Zea mays
  Clone ID: LIB3068-001-Q1-K1-A6
gtatactgcgacatcaagtccggcctgagccattcacaagggcataacaccctcagggctgttcatgatcgtaagatgaacacttgctacagctgtcaagcataatcgctgtcctgtacttactaagttagacatgtcagcagatgagctcgctatatctgtccctacaacctgcctttcagatcgaacgggacagagatgcatacattgaagtcatttatgagatcaagcagtatgtcatacgagaacaacatgcttaaccaatcacaggacacctgaattgaagttttgccaccggttcccattatctcttcaggcaatttcctcagtttctatggatgcatattccgtattgataaaagggatagtcaaaccctattggtaagattctgtaactggttaaaattcatatgccaaacaccc

SEQ ID NO: 54527 - DNA, 423 bp, Zea mays
  unsure at all n locations
  Clone ID: LIB3068-001-Q1-K1-A7
gttcctgcagccctgcctcctctctctgctggaatcaagggggggcgcttctatcctggccaagggacccaaggccctggcccacccgcccacccccctgccccccagctgacatggaaaccccagccctctgggccccagccaggcagggtgagggggcatctctgccaatctacctcacgggcccacactctgccggccatgccatggatcatgggccgggaaggctctgggggcagaaacaccactccctggtcaccctctcaccccacactggcccacagcagccagagggtcccgggagaagagggggcagggaggagggcttggccccttcatggggaaggaaaccagcacgcctncattctccaggaggtgtccaagaagtgccttaaatggtttgcacagaccaggtggttggga

SEQ ID NO: 54528 - DNA, 456 bp, Zea mays
  Clone ID: LIB3068-049-Q1-K1-B3
cccacgcgtccggtccagatcccggcaccccaaccgatctgccggcctccagcatggcggcggcggcgggggcgagggcgagggcgaaggcagcgggagccctggcgctggcgctcgtgctcgcgctagcgggggccaactccgagggcgacgcgctctcaagcgctgcgccgcagcctcagggaccccggcggcgtgctgcagagctgggaccccacgctcgtcaacccctgcacctggttccacgtcacctgcgaccgcgacaaccgcgtcacccgactagatcttggtaattcgaacttatctggtcatctggtgcctgagcttgggaaattggagcatctgcagtacctggaactctacaagaacagcattcaaggaacaatcccttctgagcttaggaatttgaagaatctaataagcttggacttgtacaagaacaacatgttggggaca

SEQ ID NO: 54529 - DNA, 73 bp, Zea mays
  Clone ID: LIB3068-049-Q1-K1-B4
cccacgcgtccgtttttgtgcccttaccatactctgctgttgcttgagaatatgttattagtctgtcctagct

SEQ ID NO: 54530 - DNA, 461 bp, Zea mays
  Clone ID: LIB3068-049-Q1-K1-B5
gccgggcgttgatgttgaagaggtcgtccctggtcatgccgggcttcctgggcactcctgcggggatgatgacgatgtcggagccctccagcgcctccccgagctggtcgtcccccatgaaccccttcaccagggcgggggagttgatgtgggagacgtcggccgcgacgccgggggtgccggcgatatcgtagagggagagggaggaaacgagcgggttgagcttcatgaggagcgagagcggctgcccgatgccacccgccgcgcccaggatggccaccttccgctccggattggccgaagacgcgtagccgcggctgcagcggaggagctcggccgtggacttcagcagcgacggcctcatggcggcggctgggtcggggatcactcgctcgggcgtgtctcgctgtggattggtggggggagcggcagtgggcggcggcgagaagtgaggggagcac

SEQ ID NO: 54531 - DNA, 78 bp, Zea mays
  Clone ID: LIB3068-049-Q1-K1-B6
tccggtctctgaattcccggagtcgacgccgacgcgtctcggttcgacacctagcgtctcttgatcctacatactaca

SEQ ID NO: 54532 - DNA, 380 bp, Zea mays
  Clone ID: LIB3068-049-Q1-K1-B7
cggacgcgtgggaaaaaaaaaaaataaaaaataaaaaaaaaaaaaaaaaaaaaaaaaagaaggcgaaaatataaaaaaaaaaaaaaaaaaaaaaaaaaatactaaaaaaaaaaatatactataaaaaaaaataaatataataaaaataaactacaattaaaaaactacttgactattaaaaactttcaatttttgaaatcaatccttttatagaacatattttttaatgcgcatcccaaattaaatgaagatggctcgacttttaaaaccttctgaactttaaaacatcatgaatcactaatttaactcgctttggatcaaatcattttttgcggagttgcagtattttcaacaagaccagaccggttaacttttcaaaa

SEQ ID NO: 54533 - DNA, 348 bp, Zea mays
  Clone ID: LIB3068-049-Q1-K1-B8
gagccatcaagatcgcagaggagctgcctcattgcaattaggagtacatatatattgccttgatcttatgcttagtagaacaaactgaacatatcatatatcatctattgtgttttttctcttaacatacctctggtcacattccatacttttactccttatatattacatataactatgcaatatataactttattaattcctacctatgcttatcatcaggttgaactctgaactttgacttccaaaactgcacaatcatcacacgcatgtgcacaggaccgaagtttccagccagccaatgctgagccgcactcatggaattcgcgtgcccttttaacaattacc

SEQ ID NO: 54534 - DNA, 418 bp, Zea mays
  Clone ID: LIB3068-049-Q1-K1-B9
gagcataccagagctctcaaggaaattcttcagagaattatcccaacaatacaacagtggttgtaggtgggttagattccaatgtaaatgaggagtatctaaggcaaatttttactctgtatggagaaatttcttatgtgaagattcctgtaggcaagcattgtggatttgttcaatttaccagcaggtcatgtgctgaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgctttcagtgcacaagaaccaagcatacaaaactactacggatactc

SEQ ID NO: 54535 - DNA, 445 bp, Zea mays
  Clone ID: LIB3068-049-Q1-K1-C12
atgaaagacggaaaaaaatcattggcttatcaaattctctatcgagccgtgaaaaagatgcaacagaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaa

SEQ ID NO: 54536 - DNA, 444 bp, Zea mays
  Clone ID: LIB3068-049-Q1-K1-C2
aacactgcatgtgttccgtattgtgaggccattttaaggaatgcagaaagatgtgtttgagtgaaaaagatttctgctctgaagaggagcacatttctccaataaatttcaaatcgctaataattcttgatgagcgaggatttcaagcacacattagacgcatagtagaaaatagctgtgatgcaactgatgtcagaagaaatatcgcaatgctatgtcatataatttctgaagacggctgaagttctctctttaccgacttgtcgtcctacgagttcctacaatcagttggtagcaggtgtctatatatataatatgatggaagcagagaagaatggaaacattcttatgcaaaagtatgaggttggaaaattattggggcaaggaacatttgccaaggtataccatgctaggaacatagagacctctcaaagtgttgctatc

SEQ ID NO: 54537 - DNA, 399 bp, Zea mays
  Clone ID: LIB3068-049-Q1-K1-C3
aacactgcatgtgttccgtattgtgaggccattttaaggaatgcagaaagatgtgtctgagtgaggaagatttctgctctgaagaggagcacatttctccaataaatttcaaatcgctaataattcttgatgagcgaggatttcaagcacacattagacgcatagtagaaaatagctgtgatgcaactgatgtcagaagaaatatcgcaatgctatgtcatataatttctgaagacggctgaagttctctctttaccgacttgtcgtcctacgagttcctacaatcagttggtagcacgtgtctatatatataatatgatggaagcacagaagaatggaaacattcttatgcaaaagtatgatgttggaaaattattgcggcaaggaacattttccaag

SEQ ID NO: 54538 - DNA, 395 bp, Zea mays
  Clone ID: LIB3068-049-Q1-K1-C6
gtccgccaccgcgcccgcgctgagcgacgccatcgacgtgacgctgaccgccaggaaccccaacaagaagctggtgtacgtctacgacgacttcgccgtgacggccgccacggccgccaacgccgtgccgctgggcgcggccaccgcgcccgggttcgcgcacgaggccggcaacgtcaccgtcatccgggccaccgtctccgcgtccgcgctcgcggtcgaccccgccgcggccggctccgacgtcaagaggtccggcgagttccccatcgtcctggacctggagaccagggccggcgtccgggttggcgcgctcaggaccaagaagatcggcatcctggtgcactgcgacggcgtcaaggtggccgcgcccgcgcccgcgccggccaaggaga

SEQ ID NO: 54539 - DNA, 460 bp, Zea mays
  Clone ID: LIB3068-049-Q1-K1-C7
gctgcaacctgcagcagacgcatatgtccgtcgccgccgccttgggccgcgccgatgagctgcgcgcgctggacgacaccctcgccggcgtccgcggccttgtagcgtctggtgcgaagcaagttcctcgcatctttcgcgtcccctacccggaggagctactccaccatgaacaaccgccagcggcggcgaccgtcccggtgatcgatctcagcggcgaccgcgcagccgtgatcgacgccgtccgtggggcggcggcggggtgggggttcttccaggtcacgggccacgcggtgcccgagcaggtgatgtcagcagccgtggcggcgatgcgggcgttccacgaagccgacggcggggagggcagcgacaaggcgcggctctactcgcgagagcccgggagggcggtcaagtaccactgcaacttcgacctgtaccagtctcccgtggccaactggcg

SEQ ID NO: 54540 - DNA, 409 bp, Zea mays
  Clone ID: LIB3068-049-Q1-K1-C8
caaggtcgttgcaccgcctgagaggaagtacagtgtctggataggagggtcgatcctagcctcgctcagcactttccaacagatgtggatatcgaaggaggagtacgacgagtctggcccgacaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaacttgattggttaggtgtgcgtggctggaagagctgatagttatata

SEQ ID NO: 54541 - DNA, 308 bp, Zea mays
  Clone ID: LIB3068-049-Q1-K1-D1
cggacgcgtgggtttcctaggggcgccacggataacaaagacatctctctagtcctgaactgcagcgcgtacagcatactacagcagccacaggtctgtctgtcactccactctgtctactctctactctgaagtctgaactcaatctcacacggatgatacacgaactagggagatgtctttgttttcctaggggcgccacggattagcctgttcgcagctgaattttttcttgtttttttttttctgttttcgctatctgtattgtagtcactgtgcaaaaaaaatcgttttgattgattggctgc

SEQ ID NO: 54542 - DNA, 450 bp, Zea mays
  unsure at all n locations
  Clone ID: LIB3068-049-Q1-K1-D10
gaaggcgaaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttncgncttcacccaatcagggatgaggatgctaagttcaagctttgcagggttaggtctg

SEQ ID NO: 54543 - DNA, 298 bp, Zea mays
  Clone ID: LIB3068-049-Q1-K1-B12
gaactcgtacagctactcatgcaatgcttgaccacatcatccactcactacaacagcggtttggggtcggtcagaggaccttgcctatgatcatcctctagctcactatcatactcttcaccctgaaacggctgatgcaaagattccagctgctgcccacgcggagctggacaagataccacaccactgataagctcaggcagctaagcaaccacatcatcgaacataccaccatcgtctgcaagcccctctatgcctagacctcaatgcgtcgaatcctgcacgcgccctcagcata

SEQ ID NO: 54544 - DNA, 465 bp, Zea mays
  Clone ID: LIB3068-049-Q1-K1-D3
cggacgcgtgggtttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggt

SEQ ID NO: 54545 - DNA, 464 bp, Zea mays
  Clone ID: LIB3068-048-Q1-K1-H6
ggccgccctttttttttttttttcgtacagtcgtctcgtcatgctatttgtgcatgccgatgtctttctttttttgcttttgtttccgtctcttcctcaatagtgtcacgcagtccgcagagctcgtggacaccacaaaagccacacgtttcgctcagagataaacaacagacaggcaaaagattacatacattactgcgcgtacgctgtgcacatatcgatcgtatttctccaaatactgaagctgctgccgctcgtggggacctcacagcacgctcctggggacgaagctgctgccgccagcgatggtggtggtggtctcgtcggccagcccaagcccaccgttgttggtgaagcagtactccggggcctgccacgccgcgttctccagcaccgctcccaccttaaagctcataacgtaggctgtcctacctgtgtagaagacccacttgacgggtcgcttg

SEQ ID NO: 54546 - DNA, 481 bp, Zea mays
  Clone ID: LIB3068-048-Q1-K1-H7
gggtgaccctacatttcgcgaagagcttcttaactttacacaaagggggcgtattctgcaacgtttcaaactttaaggatgactcaagtccaattgcttgggattgttctgcctgggtgcgcacatatggattgtttttggaagaaaggttggagtgcttcatagttctgaagtatgatgttgaagctgagcgtttgtccaaacaaggtcaaggtcctgaaaagggtcacagtagaaccagagagttggattcacaggatctgttagagcagctgccagcattgcagcagttactataccgactcgttggatgtcggcctgaaggagctgcaaataataactacctggtgcaatacgctttagctttggtgctaatagaaagctttaaaatttattgtgctataaatgatggaattatcaaccttgttgataagttttttgagatgccaagacatgaagcacataaagctcttgaaatata

SEQ ID NO: 54547 - DNA, 494 bp, Zea mays
  Clone ID: LIB3068-048-Q1-K1-H8
gctgcagctagtgtggactggagatccaccactccaccagtccggtccatctgctggacctcgattggtttcttcttacctaggaacatccggggatgtcgactcctgcgaggaagaggctgatgagggatttcaagcggttgatgcaggaccctgcggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagcccgccgcatgttcagcgagaac

SEQ ID NO: 54548 - DNA, 369 bp, Zea mays
  Clone ID: LIB3068-048-Q1-K1-H9
ctcactctacgctggtcgctcactcttgcagctccacccttcactcagtcttggtctcggattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgc

SEQ ID NO: 54549 - DNA, 425 bp, Zea mays
  unsure at all n locations
  Clone ID: LIB3068-049-Q1-K1-A10
cccacgcgtccggtcgcggtctctgtctctctgaagggaaagctctgtttccccttcccggtgccggagtcggggaaggtcaccgcgggcgcgagccgatggacagcaacaacctcctggcggcgtggccggtcctggggccgggcgtcgccggcgccgtattcggcgcaggctggtggttttgggtcgacgccgtcgtctgcagcgccgccgccgtgccattcctccactacctcccagggttcttcgcctcgttcgccgcgctcatgttcaactgcgtcaaccgggaggacatcggcgatggctactactcaccgtacgacgactccgagtggaaggtgaagctctggctntttatttcgtacgtggtgtcgtttgtttcgctggccggngcagtgggtttcttggttcaagatgcgcttacg

SEQ ID NO: 54550 - DNA, 283 bp, Zea mays
  Clone ID: LIB3068-049-Q1-K1-A11
cccacgcgtccgaaaaaaaaatatgtatatataaaaaaaaaaaatataaataaaattaagaggaaaaaaaaaaaaaaaaagtaaaaaaaaaaaaaaaaaaaataaaaaaaaaaaagggtgctggttttataggttctaattttactcacccttgtttgcaaccgtatacatctcatattggtggatttaaatcgaattcattggctgaagttttaaaaccttgaaattggtaaaatatgttcgatagttattttaattgttttgcatgctaatgtttttttgc

SEQ ID NO: 54551 - DNA, 447 bp, Zea mays
  unsure at all n locations
  Clone ID: LIB3068-049-Q1-K1-A12
cccacgcgtccgtttgatattgggctgaagattggcaaccttgaagatactcggaatcgtactctgcatggtattttaagggttcaaagctgtttcagggggcatcaagcccgtcatcatgcaagagaacgaacaagaggagttttgactcttcaatcattcattcgtggtgagaatgcacggcaaatttactcctctttgttgaggaaacatagagccgcagttgttttgcagagaaatgtgagatgttggcttgcaagaaggtatttcataaatgtccggaaggcctcagtgataatacagtctggtattcgtggcagtcttgttcgaagatgtaatggcaatattgatctaataaatgtgctaagagagtttgaatcanaacaggtacaataactgtgtgtgcgcgcgcgccccttatacggtgctgctggcagctatattcat

SEQ ID NO: 54552 - DNA, 352 bp, Zea mays
  Clone ID: LIB3068-049-Q1-K1-A2
cttctacgagaggatatagagaggaagaacagttcgtccgagaccatgaagagcagcccacagctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctactacttgggcaacaacaagttcaggtgcaccgacaccttcctcggtatgtgctgccccaagtgct

SEQ ID NO: 54553 - DNA, 465 bp, Zea mays
  Clone ID: LIB3068-049-Q1-K1-A3
cccacgcgtccgcccacgcgtccgcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatctgtacagtggatccaagtattctataaagcatgtatcctccaatttcccacaagcgagaatggcatgatatgatggatgaaatggctgttgcggtcaattgtctttcaaggatcaattgtctttcaagaaccacacttatgtattggtttgtgtgcagttcaagctctgcaaggtgaggtctgttcagtttggccagaaagtcatcccctacctgaacacctacgacgaccgtaccatccgctaccccgaccctctcatcaaggccaacgacaccatcaagatcgatctggagac

SEQ ID NO: 54554 - DNA, 405 bp, Zea mays
  Clone ID: LIB3068-049-Q1-K1-A4
gagatgccaagacatgaagcacataaagctcttgaaatatacagaagggctggccaacaggctggaaatctatctgatttctacgagaattgccggggtttagaacttgcgaggaattttcagtttcccactctgagggagccgccacaaacatttcttgcaactatggaggagtatgtgaaggaggctccacgcatggtcccagttcgagaacccctggaacttcctgagaggcttcttcttacatacaaacctgaagaatcggaggacattcgtgagcctgcttctgttgaagaggaaaatgcaccagttgaagagcctgttctggtaccacctgttactgaagttggttcaccttccaagtccgaggtggccgatactggtgacttactgggcttagatgat

SEQ ID NO: 54555 - DNA, 401 bp, Zea mays
  unsure at all n locations
  Clone ID: LIB3068-049-Q1-K1-A5
cccacgcgtccgcccgccggcgggacctcatgttcagcgtcgtgaagccgtccgtgatccagctgcgggggcccaccaaggtcagcgtcttcctcgccagcaacgacgccgagcaggcctgcgacttcaggatcaccggcagctaccacgacggcgcctgcgctgtctccctcggcgactccgacaccgtcatcgccaagatcgaccggcggttcagcgtggtcagcgcgctgctggggaagaactcgtacagcgtcaccgtcaacccggggatcgactacgccttcgtcgtcgcgctcgtcgtcatcctcgacgagatgcattaccagcgatgacacgcacgcttcagttttggttccaagccgngcgccttcccttctgctgatgcgtggaatcaacgc

SEQ ID NO: 54556 - DNA, 460 bp, Zea mays
  Clone ID: LIB3068-049-Q1-K1-A8
cttgtgcagccgcccctctctctctaggtttggaggacgcccctctcactcctccacccatgggcagccgccaccccacctcccccatcaaaccatagccgccccctcctcaagcccttctctccaaggtgccattcctttcccgctcggatctacgtcgcgttggtgcatgtctccaattggattttggtggagggaagaagaagggaggaaagggggaggattcaaggtgattttgagattgtaccttgtttaattgtgttgtaatccaattgattatatgtttacctatccgaatcggtagaggtgctgtcctgaaattttgtgggtgggcgaacagcagtagttctagggatttctgggaatttttcgtgggtaattagtggggatcagtgggtgaatcatgtagagctttgtcatacctttccaacgggtacttatgcgctcgattcggagttat

SEQ ID NO: 54557 - DNA, 383 bp, Zea mays
  Clone ID: LIB3068-049-Q1-K1-B10
cccacgcgtacgcccactcttgcggtggatgcccacagcatcgactcacgactcgagcggtttggggtcggccagccggagctggcctaggatcatcctcgcgctgcctatcatcggcatcaccctgggccggctgatgcaaaacttccagctgctgccgacggcggatctggacaagatcgacaccactgataagcccaggcagttcagcaaccacatcgccaaacatgccaccatcgtctgcaagcccctctaggcctagaaatcaatgcgtgtttcctgcacgcgccctcgcatattaaccactatgtattttctctttaacatgtatgatgggtacttatctactaagatgagatggatatcttgatcgtaaaatgcac

SEQ ID NO: 54558 - DNA, 414 bp, Zea mays
  Clone ID: LIB3068-049-Q1-K1-B11
cccacgcgtccgcccacgcgtccggtggaggcccacggcaacgacttccgattcgtgccctttggggtcggccgccggagctgccctgggatcatcctcgcgctgcctatcatcggcatcaccctgggccggctggtgcagaacttccagctgctgccgccgccggggctggacaagatcgacaccacggagaagcccggccagttcagcaaccagatcgccaagcatgccaccatcgtctgcaagcccctcgaggcctagaaatcaatgcgtgtttcctgcacgcgcccccgcagatgaagcactatgtattttctcttttttttgtgtgttgtgttttttttactaagaggagatgtatttcttgttcgtaaaatgcacttagtcaaatggatcgagattatgttgatcatt

SEQ ID NO: 54559 - DNA, 401 bp, Zea mays
  Clone ID: LIB3068-048-Q1-K1-H2
gctgaacatggagaaagaattttagaggaccttgttatttccttagctgatgtgattgctagtatttatctggagcttatgtcagtggatggtgatatgtctgctgaagttgttggttccagcttggttctatgttctctgtcaaccagagaaactcaaaaagctgcgcaatgaggtgggcattaattggtggttgcaccaatacttcaagtcagttggtttcaatgtatgaggacaggttcgagttatatgttctatgcagcaaaaaatacgaaaaaacagccgacaatcaagctgagagggcaaattggtggaggattgcatctgggcagcctaatgtccttactcttgattatgttaacatcagtccattttcccttcagcaagaaggacaaaggaat

SEQ ID NO: 54560 - DNA, 485 bp, Zea mays
  Clone ID: LIB3068-048-Q1-K1-E8
cgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaacgggagcaccctgtccgtgcaggggcccctgctcgggttcacgggcaccatcgagcgcgccgtggtcggcggcaccggcaagttcaggctggcgcgcgggtacatgcttttcaagatgataagcaagccgacgccggagacggacgtcaacgagatcaacctgttcgtgctcatgcactccgctggcaagtactagcgcacacaccttg

SEQ ID NO: 54561 - DNA, 414 bp, Zea mays
  Clone ID: LIB3068-048-Q1-K1-E9
cccacgcgtccggtccagatcccgccaccccaaccgatctgccggcctccagcatggcggcggcggcgggggcgagggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaattggagcatctgcagtacctggaactttacaagaacagcattcaaggaacaatcccttctgagcttggtaattggagaatct

SEQ ID NO: 54562 - DNA, 76 bp, Zea mays
  unsure at all n locations
  Clone ID: LIB3068-048-Q1-K1-F10
cgnntccggagtctanntcttctgcatggatggggatggtgannaaaaaaactnnncaaattgtgnnaatcgcaac

SEQ ID NO: 54563 - DNA, 197 bp, Zea mays
  Clone ID: LIB3068-048-Q1-K1-F11
cggacgcgtggggttaaataagagagcgcaggagttttgtttcttctcctgatgtgtaccaaagaattttactgtgtacaagctagtgtcaagtgttgtgcatctttgactgtagtgtcgctcaattctgaacatctattaagccacttttgttgctatgctaataccagtctgagagacactgatgtttttaacag

SEQ ID NO: 54564 - DNA, 343 bp, Zea mays
  Clone ID: LIB3068-048-Q1-K1-F3
cccacgcgtccgaaaaaaaaaacaaacagaaaaaaaaaaaaaaaaaaaaaaaaaaaaaaaaaggaaaagggaaaaaaaaaaaaaaaaaaaaaaaaaaaaaaataaaaaacaaaaatttttataacacaaaaaaaaaaaaacaaaaaaaaaagggcgccccccctaaaaaacccaacctaaccaacccaaacatccaaccacaaaccaccccaatagggcccccaaaatcaaatccaaggcccgccagattaaaaacgcctaaacgggaaaaacccgggagaaccccaactaaaacgcaggccaaaacaaccccctatccccaacgggggtaaaaccaaaaagc

SEQ ID NO: 54565 - DNA, 98 bp, Zea mays
  Clone ID: LIB3068-048-Q1-K1-F5
cccacgcgtccgcccacgcgtccgcccacgcgtccgcccacgcgtccgcccacgcgtccgggcacgcgtccgcccacgcgtccggttctagatcgcga

SEQ ID NO: 54566 - DNA, 398 bp, Zea mays
  Clone ID: LIB3068-048-Q1-K1-F9
cggacgcgtgggcggacgcgtgggcggacgcgtgggcggacgcgtgggatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctcttcaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttccttgcgcaca

SEQ ID NO: 54567 - DNA, 474 bp, Zea mays
  unsure at all n locations
  Clone ID: LIB3068-048-Q1-K1-G1
atgaaaggcgtctgcttgcggaaacaagaaaacttgaagatactttgacagaagaagagaaattcaggaataggactatgcttgacataatttacgttagagatactcatccattgatcactcagattatcttcctgtatcagaactattaccatctatcaagaacagacccttatgttattcccattgagcctgctgctagtggtggaatgaatggattcctatgtttatctgaaaggaactggtatagtgtcactgtcacttctccagttaaggggttcaatggcattgctcagaacagagttttgaatgctgcctatctcaatcctcagtatcacaaacacatcccagagcctncagcggnggtcatcatacctgcgaagatactgaagcctagtgatttcaaaccctttcctgtgttgtggcatcaagataatagtcgtcgacaagtaagagaaaggcctcaggtttctg

SEQ ID NO: 54568 - DNA, 391 bp, Zea mays
  Clone ID: LIB3068-048-Q1-K1-G11
ggccgtccggagctgcctgccagtagcagcaacagcaaaacatgaagcagccgtaagcggcagagagcatggcgagatcagggcgggaagcggatcccggagaggaggaacggaagctggtgctgggcaagtacgagctgggccgactgctggggcagggcaccttcgccaaggtttactacgcgagggacctgagcgccggcgccggcacggtccacagctgcagcgtagccatcaaggtgatcgacaaggcgcggctgcggcgtacggaggggatggtggagcagctgcgccgggagatctccatcatgcggatggtgctgcaccccaacgtggtgggcatccgggatgtgctcgacagccggttccgcgtctttcaagtcatggagta

SEQ ID NO: 54569 - DNA, 331 bp, Zea mays
  Clone ID: LIB3068-048-Q1-K1-G12
cgtccacccgatcccctgacccgtcgccttgacccgtacgcgttctagatctacaagcgggaccggctccatctatcacaaactcacgctacacgtacgctgcgaatgcgatagctatatctatagcgatacgctacatctcaaattactggcactgcgccgtacaactacaacgactgtgacaaccataaccctaccgatatcaatcttaatggactagatgcacatttcgccatctgccgctatcgcaataacgcccacacccataatcattgccaacagtaacacattctcaatcgcgaatgggactcgcactctcgctgtacattaa

SEQ ID NO: 54570 - DNA, 70 bp, Zea mays
  Clone ID: LIB3068-048-Q1-K1-G3
gcgaagcgaatccagatgcaactccgagggatgctcgaaacgcttctgacgtgcaaatcgtgcgtctgac

SEQ ID NO: 54571 - DNA, 431 bp, Zea mays
  Clone ID: LIB3068-048-Q1-K1-G4
cccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatcatcatcaaccttgacctcaagaaaggcggcaacgggcgctaccttaagacggcggcctacggccactttggaagggacgaccctgact

SEQ ID NO: 54572 - DNA, 492 bp, Zea mays
  Clone ID: LIB3068-048-Q1-K1-G7
cccacgcgtccggcctcattcatctccattcgaaacaccctcgcacccacactctgccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgcccttccagcgcctggtccgcgagatcgcgcaggacttcaagaccgacctccgcttccagtcctccgacgtcgccgcgctgcatgaggccgccgaggcctacctcgtcggcctgttctaggacaccaacctttgcgccatccacgccaagcgcgtcaccatcatgcccaaggacatccagctcggccggcgcatccgcggggagcgcg

SEQ ID NO: 54573 - DNA, 488 bp, Zea mays
  Clone ID: LIB3068-048-Q1-K1-G8
ccaagaacggaatgggcgtccttctgaagtaggtccttctgcaaaaagcagtagtaaatcggcctcacattctgatggacctgcttccggttctcttgctgagtccaatgaaataaatcaaggtcttactcgcggtagcagtctgacaggagcaactggtaatggtgtgcttggagaagctatcttagatcagtctgatgagcatgttagcagtgccttgaatcacaggaaagggaaccttgtattggaacatgatggtagaaatggttcggtagcgtcttataggggagttctttcagaagaggaccgtgattcttatcccggccatgctcggaaggactctgctgaaagtattgggagtgatttgagttctttaagaggaagtgaattatctgttccaggggctagtaattccctttgggatggtgctgtggtggatggacatgttagtcaaacagaacatcttactggtttagatatgccatctt

SEQ ID NO: 54574 - DNA, 285 bp, Zea mays
  Clone ID: LIB3068-048-Q1-K1-G9
tcccgcgtccgggcggatccgatccgtgcgcctgctgtgtgtgtgtcggtggagatgggcacagcttacgctcccatggcgagccaggtgatgaagagcagcctcgtcgtgcactcgaggccgagtggcctgtcaggcgctgctgcgctcacgatgcggcccctgttcaccgtcaaggccatccagcccgagaaggctacgtaccaggtggtgcagtctatcaactgctaccccttcatcggcagcctggagactcctgtcacctcgagcccgctcgtggcgtgg

SEQ ID NO: 54575 - DNA, 459 bp, Zea mays
  unsure at all n locations
  Clone ID: LIB3068-048-Q1-K1-H1
gtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcanatgccatcgtttgagagcttggtggaatgtgttagacttgagtatgatcatc

SEQ ID NO: 54576 - DNA, 489 bp, Zea mays
  Clone ID: LIB3068-048-Q1-K1-E6
caggaacctgctaatgggaagcccaatccgtccgtaccagatggtgtcacggcagaggtgaaggcggtgaaggctcccgcagagaacggcatcactgctcctgttgtttcctatgcagcaaaggtggcccagacagcaccagagaaacccgtcctctccaacggagtcgccaagaccggttaactcgaccgtgcaaccagagctccatagccagggtggggtgggtgtcctgaagactcagatgcggtgcaagggaactggtgaccaaccaaggcaggctgtggaactggcagcatggccccataagcgttgctcgatctcctcatcgctactggatggagagcagttggctagttgttagcggtttccctagtttctcttcctcttgtgttccccggttcagtttgcttatagccccgaagactcttttctcccgtagtgtcggaatgccagggtctgtccctgtgggtgtgttgcgtaactgggatc

SEQ ID NO: 54577 - DNA, 403 bp, Zea mays
  Clone ID: LIB3068-048-Q1-K1-H10
ggagttgtcacgaagtacttgcttcagagtggtcttcaagaatacctcaacgggcaaggattccatatcgttggctatggctgtaccacttgcattggaaactctggtgatctcgatgaatccgtatcaactgccattacagaaaatgatgttgttgctgctgctgttttgtcgggtaaccgtaacttcgagggtcgtgtgcaccctttaactcgggctaactatcttgcctcaacacctcttggtgttgcttatgcacttgctggaacatgtgatattgattttgagaaagagcccattggatttggaaaggatggcaatgaagtcttacttcagggatatatggcccttgacagaagaaattgcgcaggttgtccaatccagtgtgctgtctgacatgttc

SEQ ID NO: 54578 - DNA, 388 bp, Zea mays
  unsure at all n locations
  Clone ID: LIB3068-011-Q1-K1-F4
cgcacactggcatccacccgtcaccccacgcattcgatccgaggtggtgccatacagagcgagcgagaacctcgcgacgacgaangccngcggcgaggtcgagactgagcctaccgggccacttgccgtgctcaagggcttcaaggacctgcctcccgggatgccgtccgtgctcctcgtgactgccatcacctggctctcgtggttcccgttcatcctctacgacaccgactggatgggccgggagatctaccacggcgaccccaaggggagcaacgcccagatctcggcgttcaacgaacgtgtccgagtccgcgcgttcgggctgctactcaactcggttattctagggttcagctcgttcctgatcgagcccatgtgccggaag

SEQ ID NO: 54579 - DNA, 297 bp, Zea mays
  unsure at all n locations
  Clone ID: LIB3068-011-Q1-K1-F5
caaatcaatactaaacctaccattccactttcctttctcanattcttcaaatacctacctccacctattccttccaatctcctcttaactgccatcacctctctctcttgattcccattcatcctctaccacacctactttattttctctttagatctaccactactaccccaattttaccaacgcccatatctcgtctttcaactaaactattccaatccccactttcatacttctactcaactcccttattctatcattcaactctcttccttattaaacccattttcctcaaat

SEQ ID NO: 54580 - DNA, 240 bp, Zea mays
  Clone ID: LIB3068-011-Q1-K1-F6
ggaaggttttggcatcctgactacagttactacatcaagcggagttccttcagcttgttcatgtcacacggacactactctacactacagggatatgttagtatttcttttttatatgtattttttttgtggtgctcttgatttgaggatctcggtataactgtaaccacacgcactggttacggttgcttctgcttcacaatcgctggcgacggttggattctttggatgttatagatc

SEQ ID NO: 54581 - DNA, 337 bp, Zea mays
  unsure at all n locations
  Clone ID: LIB3068-011-Q1-K1-F7
aacccaccgcaacccacgagagacnngaaaatttttncatcctcactttantactacatcaancnnanttccttcggctcgtttattttaaacagacgctactctacactacanntatatnttanaatttcttttttatatctattttttttcacctactctttatttgacgatctncttataactgtaaccacactcactcattactttttcttctgcttcacaatcactctcaacctttccattcttttcatcttatagatcatacaaaatatctactatttcttttatatatactttatccatactatcaacattataataaattttttccatt

SEQ ID NO: 54582 - DNA, 362 bp, Zea mays
  unsure at all n locations
  Clone ID: LIB3068-011-Q1-K1-F9
gcgcccacncgtccgcccacgcgttcgatgcagcccaaatcgggcggtaaactccggccggggctaaatacaggcgagagaccgatagcgaacaagtaccgcgagggaaagatgaaaaggactttgaaaagagagtcaaagagtgcttgaaattgccgggagggaagcggatgggggctggcgacgcgcaccggccgtatgcggaacggctcctgctggtccgccgatcggctcggggcgtggaccgttgtcgcccgcgccggcggccaaagcccgggggccctaggcgcccccggcagccgtcgtcggcgcggacggtatccgcgcgcctctggcgcgcccctcggggcgctgcgccgcaa

SEQ ID NO: 54583 - DNA, 308 bp, Zea mays
  unsure at all n locations
  Clone ID: LIB3068-011-Q1-K1-G11
agagaagtaataattcggatttaattttaccttttaatgtacataaaaacggctatgttattattctaatggcggccaggcaccctaaaaaacnnttaccacatccaantaaggcaccatgctcgcaaattacccaatccttacactggtatgtacttacaataaataacaataccgctcgcattagtgtctggtaattggaatgaatacaatctaaatcccttaaccaggatccattatattgcaattcttgttccagcaaccgccgtaattccaactccaataacgtatatttaagtttttgcaat

SEQ ID NO: 54584 - DNA, 380 bp, Zea mays
  unsure at all n locations
  Clone ID: LIB3068-011-Q1-K1-G12
cccggtcgacccagcgtgcgctaaactcctgcgtcgcatcaccgagccgagcccggcacaaacactactggcgcgcacgcacgcaggaggaccagcaccacaccacatgcatggtggagcctagcacgggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgccgcccgccttcgcgtnctgggacaccgccagccaccgctccttgtcgtcgtccgacgaccagcagtacatga

SEQ ID NO: 54585 - DNA, 371 bp, Zea mays
  unsure at all n locations
  Clone ID: LIB3068-011-Q1-K1-G4
ccgacacgtacgcccacgcgtacgcctacgcgtccgcgccaaggaggtgccgtacagggcgagcganaacctcccgacgacgaacgccnnctgcaaggtcgagactgagcctaccgggccacttgccgtgctcaagggcttcaaggacctgcctcccgggatgccgtccgtgctcctcgtgactgccatcacctggctctcgtggttcccgttcatcctctacgacaccgactggatgggccgggagatctaccacggcgaccccaaggggagcaacgcccagatctcggcgttcaacgaaggtgtccgagtcggcgcgttcgggctgctactcaactcggttattctagggttcagctcgttcctgatcg

SEQ ID NO: 54586 - DNA, 237 bp, Zea mays
  Clone ID: LIB3068-011-Q1-K1-G6
acgcgcgcacgcgtacgtccacgcgttcgattacgcgttcgaaaaaaaaaaaaaaaaaaaaggaaaggttaaaaaaaaaggaggtataaaaaaaaaaaaaaaaaaaaaaaaaaaaatgaaaaggaaaaaatatatatattgtgagagataaaaaaaataaatatgtaaatttatataaaatgaaatgtgtgataaaaataatatttttattaaataaatttttttggttgatatttt

SEQ ID NO: 54587 - DNA, 180 bp, Zea mays
  Clone ID: LIB3068-011-Q1-K1-G9
ggcggtttcctgttctgggctgagccatccacctgtttcctacatttcgttgtagcgttggaatttaaggggctaggaaattgaactaagagtttggtactgtgaactaagagtttggtactgtttcgtgggagtgtgacttcactccaatatttgatatctatctgtgacacttgctat

SEQ ID NO: 54588 - DNA, 223 bp, Zea mays
  unsure at all n locations
  Clone ID: LIB3068-011-Q1-K1-H10
tgactgtttaataattatttcaaagaaaccatctatagtacgtgtggtctgagcaactcaaccttctgatcgtnacccatggccactgccgaagtccaaaccccgatnaactgnatttaccgtcacaggatcaatcacttccatccattgaacctatttaatatctccccaagaggctgtccccaactccaaagcctatgaatcagcacaatcttgccaacaa

SEQ ID NO: 54589 - DNA, 387 bp, Zea mays
  Clone ID: LIB3068-011-Q1-K1-H11
gcgtccgagttccctgactcgctggcaccagagcagtgcaaagctctcgagacagtacttccaccaagggcttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcgtgggagtgatctctggttttgctgtcgccgagctgggaaataagaagctgaatcgacctcttaagcggggaatgtatccttttttgctgcaacat

SEQ ID NO: 54590 - DNA, 341 bp, Zea mays
  Clone ID: LIB3068-011-Q1-K1-H12
gaagaacctggaagagaggagcttgatgagttgaggagatggcgagcgccgagggcgagaggtgggtgggactggcgacggacttctcgcaggggagccgagcggcgctgcagtgggcggcgaccaacctgctccgcgccggtgaccacctgctgctgctgcacgtcatcaaggagcccgactacgagcagagcgaggccatcctctgggaatccaccggctccccgttgattcctctctcggaattctctgaccctatcatcgcgaagaaatatggagcaaaacccgacatggaaaccttggacctcctgaacactacagctacccagaaggaaattatg

SEQ ID NO: 54591 - DNA, 384 bp, Zea mays
  unsure at all n locations
  Clone ID: LIB3068-011-Q1-K1-H3
cccacgcgtncgcccacgcgtccgggaaaaggcagagaggattgttggtctcaactgtcaagtcagtaccagcagcaaagttgaatgtttggtaatttggtgggagaagcctggagagtacgtgttgtatgagcaacaacagcagaaacgacttttgcttcaacaacaccaacaagatctctatacatcaactgcattcaccgccacaggatcaatcacttccatccatggaacctattcaatagcttccctaggcagaaagacaaacacaaatgaatatgaaacaacagattctggcaaacaattgtagcttggctggaggcgggcatcagcggcgacttcccactcgattcgctgtataataaatactatgagaggatactg

SEQ ID NO: 54592 - DNA, 293 bp, Zea mays
  Clone ID: LIB3068-011-Q1-K1-H4
acgcgcacgcgtaaactccctcgtccgcattcaccgagccgagcccggcacatacactacgggcgggcacgcacgcaccaggaccagcaccacaccacatgcatggtggaacctatcacgggcagctggctcccgaccaacatacattacaaccacctattgcttcaacaacaccaacgagatccccttacctcaactgcatttacgccaccgccatccatcaacctcctccacgacaactactcgcaatgtctaggtaaccacgttccgcgacatccaccctttgacacccg

SEQ ID NO: 54593 - DNA, 344 bp, Zea mays
  Clone ID: LIB3068-011-Q1-K1-H5
cggacgcgtgggcggacgcgtgggtcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcg

SEQ ID NO: 54594 - DNA, 358 bp, Zea mays
  Clone ID: LIB3068-011-Q1-K1-F10
cggacgcgtgggcgcctcgcgccggagcacccgctgccggcaggctacgaggactcgttccgcgcgctggagtgggtggcggcctccggcggggacccctggctgtcgcgccatggcgacctgcgccgcgtcttcctggccggcgacagcgccggcggcaacatcgtccacaacgtcgccatgatggccgccgcgtcggggccgcgggtcgagggcgccgtcctcctgcacgccgggttcgggggcaaggagcccgtccacggcgaggcgccggcgtctgtggcgctgatggagaggctctggggcgtcgtgtgccccggggcgacggacggcgtggacgacccgcgggtgaatccct

SEQ ID NO: 54595 - DNA, 198 bp, Zea mays
  unsure at all n locations
  Clone ID: LIB3068-011-Q1-K1-H6
agagtgcgaagagcagtacaaaagattccattctcggttcttggagtggccgcgatcgactccggaaagagagagagaanacaagcaatggcgacagcagggaaggtgatcaagtgcagagccgccgtggcgtgggaagccggcaaaccgctgtccatcgaggaagtggaagtagcgccgccgcaggccatggaggtt

SEQ ID NO: 54596 - DNA, 396 bp, Zea mays
  unsure at all n locations
  Clone ID: LIB3068-011-Q1-K1-H9
cccacccctccgggcataaattcctttatgatacaatcaataattcnattcagttggattaagccttgctctggcttccttacgggttattacttccttagtagctcaacatatgtactctttacctgcttatgcattcatagcacaagactttactactcaagctgctttatatactcatcaccaatacattgcagggttcatcatgacaggggcttttgctcatggagctatttttttcattagggattacaatccggaacagaatgaagataatgtattggcaagaatgttagaccataaggaagctatcatatctcatttaagttgggctagcctcttcctaggattccataccttgggcctttatgttcataacgacgttatgcttgcttt

SEQ ID NO: 54597 - DNA, 290 bp, Zea mays
  Clone ID: LIB3068-012-Q1-K1-A1
cctgatgcaagattggagagtgaattgtgatgcccagcttcgtattctggtcttgtagcgttagtggaagaaaaggacaatcaaatgcagaagatagagaaagaaattaaggaactaaaggtatggcgtgatttcgtaggccgagttcctcatggacatcgtcagcaacgaagagatggcgctcatcgacaccgctaggagaagaaacttatcagtgatgggtctttataaccaaacaattttatgagcttaaaatgactttcttagcctcttttatacttagcacatgc

SEQ ID NO: 54598 - DNA, 360 bp, Zea mays
  Clone ID: LIB3068-011-Q1-K1-B6
cggacgcgtggggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccgggtccccc

SEQ ID NO: 54599 - DNA, 184 bp, Zea mays
  Clone ID: LIB3068-011-Q1-K1-B7
cgcacatatcagcaaggtgattttattttggcgaaggtgaactctctcactgccatgtttacataactacccttcaggtactacaaccttccatactgtcaacccagagatggcgttaaaaagagttctgaaaacttatgcttgcttcttattgttgatcaaataaataattcttcctaccgtt

SEQ ID NO: 54600 - DNA, 365 bp, Zea mays
  unsure at all n locations
  Clone ID: LIB3068-011-Q1-K1-B8
gcgggaggactcgcacagatcggtgagcgagcaagcgagagatggctgggaggcgaacggcggcaaggtcccgcatcctgggcggcngcngcccacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctggtgtgaacgacaaggcctccaatataccatatactcccaaa

SEQ ID NO: 54601 - DNA, 363 bp, Zea mays
  Clone ID: LIB3068-011-Q1-K1-B9
gcgactcggcaaagaaaagaggcaacgactatggctgctgcggcggcgatgatgggctgcggaggacgggcggcgctggcggtggcggccgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggccttctgcgggcccgccgggcagaagggccaggccgcctgcggcaagtgcataagggtgaagaaccgtgcgacgggcgcgtccatcgtggcgaggatc

SEQ ID NO: 54602 - DNA, 132 bp, Zea mays
  Clone ID: LIB3068-011-Q1-K1-C10
ctacatcaactacattcacctctacaacaaaatcaacaatttcaatcttacatttcccttctacccttacaatctctcctacaagctactctacattccctccaatatcatcaaacacatccacatcttcta

SEQ ID NO: 54603 - DNA, 389 bp, Zea mays
  unsure at all n locations
  Clone ID: LIB3068-011-Q1-K1-C11
cggacgcgtgggcccgatcagcagctgatcgctcactcttgcagctcgatcgttctgtagctgctctagctctagcctctanccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccgg

SEQ ID NO: 54604 - DNA, 207 bp, Zea mays
  unsure at all n locations
  Clone ID: LIB3068-011-Q1-K1-C12
cctcactcttcacacnacgcccgtttttttaaagcttgcccgccacccaactaatactaaccactcttcctctatcatcaaccttctaatctccccatgccacttcctatctccataccctaccttcatcctacctataatctccattatatataccccatctccacccaccatcctccctattatcttcccccatctcctactcca

SEQ ID NO: 54605 - DNA, 254 bp, Zea mays
  unsure at all n locations
  Clone ID: LIB3068-011-Q1-K1-C3
gcgctggttgacttaaacctacctaaccaccgggattccgaacccatccccttcaaaggcccaacggggcggaagagtacaaggaacttgggaacaaaaacctgtgcaccgtatacacccagcanatacttagcggcaagggcgccgagtcgttcctgggcgagaagtactgcaccgacatcgggtcaagcacgagcagcatgggttcgctggagcggatggcgcacactgccgtgcacgtctgggtcggcaag

SEQ ID NO: 54606 - DNA, 309 bp, Zea mays
  unsure at all n locations
  Clone ID: LIB3068-011-Q1-K1-C5
gtgccattcccctcccgctgtggaggttctgttagcccgctagaaaatatgactgtggatcgcttttgtgcctctgcccttctgtttttgggccccaaggacctatattttgcttgaaatgatactaccatagcttttcctgcccgaagtgctatgtggtgtttctgtgcgtttgggtgcaatgataggacgggatgagatgagaccctcaaattaggttgtttggttctgggtcaaagattgagacaagaatatcctagtattgtttnaaaaaaaaaaaaacaaanncaaactaaaaaaaaactcaac

SEQ ID NO: 54607 - DNA, 392 bp, Zea mays
  unsure at all n locations
  Clone ID: LIB3068-011-Q1-K1-C6
cgcacgcgtncgcacgaaagtacacttaatctatgcaaatgtcacgtatgangatatgcttgtganagaagaacttgacggcatggccaaaaactatcccgatcgtttcaagatctactatgtcttgaatcagcctcctgaagtctgggacggtggcgtcgggttcgtgtcgaaggaacgatccagactcattgcccagcgcctgccgccgacattcaggtattgcgatgtggacctcctccatgaacaaagccatggccgcgcacctggacggccttggctacacgaaggagatgcagtttcagttctaagcgttgcattctctctaccagtaccagaataaacggcggtggaacaaagttctaagctccaaacagacgctcttttgtacc

SEQ ID NO: 54608 - DNA, 380 bp, Zea mays
  Clone ID: LIB3068-011-Q1-K1-C8
tgtctttcttgggacgatatggatgccgccgcggtttcgtcgttgctgtgcgcacggtgggtccgcgccgcggccagagaagggtgagttctgcatcgacgacatcgacctggacgagaagagcaacaaggtgaaggtgacggggcccttcgacccggacaagctcgccgacaagctgtgctgcaaggcgtgcaagatcatcaagcagatcgagatcgtggagccgccgccggagaagcccaagaaggaggaacccgccccgccgccgtcgaagaagaaggaggagccggccccgccgccgccggcgaaggtcgagccgcagaagcctccgccaccgaaggagaagcccccgccaccagcaccgaaggaggagccaaagc

SEQ ID NO: 54609 - DNA, 315 bp, Zea mays
  Clone ID: LIB3068-011-Q1-K1-D10
cccactcttcctaaaaaaaaattatatttaaaaaaaaaaaaaaaaaaaaaaaaagaaaagttttatattaaaaagaaggaaataacaaaaaaaaaaaaaaggtcggtcaatctaaaaatatcctaacttacatacacatacatcaaaccccataactctcctataaacccccccaaacttcaatcatatccccccattttatcatcctgctcccttgctaaacctacccttttccccacttaatctacttgcaccacatcccctattccccatccttcctaataccaaaaagccccttacttattcccccttccc

SEQ ID NO: 54610 - DNA, 387 bp, Zea mays
  Clone ID: LIB3068-011-Q1-K1-D12
cggacgcgtgggcggacgcgtgggcggacgcgtgggcggacgcgtgggcagggctggcccctcgcgtggcctgcctcgaccaccagcgatcgctgctcaccgtcggcaacagccacctcaagcaacgaatcgcggcgctcgcccaagacaagatcttcaaggatgctcatcaagaggcgctgaagaaggagatcgagcggctacgccatgtgtaccagcagcagcagatgaaggtggccaccaccggcggcgccgacatcgccgcggcggcttccatgcaggccaagcaagagctgctcgcgtgcgagggcgctgccattcgatagcggatcgagggcggaggcgttcaactggcagtgccacaacaacaacaccagcaccgaactt

SEQ ID NO: 54611 - DNA, 334 bp, Zea mays
  Clone ID: LIB3068-011-Q1-K1-D5
cttggaaaaaaaaaaaaaattataattataaaaaaaaaaaaaaaaaaaaaagggacgtttaattaaaaaaaaaagaaggcccacaccctacaaaaatcaaaaaatatcttcaccttaaatacccaaaaaaaaaatctgccctcccctcataaaaaaacaaatttaatttccccttctttccaaaattaaaccttttaaaacacccccccaaaacaaaataaactccccgctttaaaaaaccctttccccaaaaaaaacctctttttaacaaatttaaatcttttaacaaaaaatccctttttcacaatttcataaaaaaaaaaaaaccccccca

SEQ ID NO: 54612 - DNA, 367 bp, Zea mays
  Clone ID: LIB3068-011-Q1-K1-D7
cccacgcgtccgctcccgcggcaagtctctctgaattgtgggtctccggcgatggcggctctagctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccagacatcagcgacgagctcgccaagtggtacggtcctgacaggaggatctacctgccggatgggctcttggaccgctcggaggtaccggagtacctcaccggagaggtccctggagactatggctacgacccttttggcctgggcaaga

SEQ ID NO: 54613 - DNA, 374 bp, Zea mays
  unsure at all n locations
  Clone ID: LIB3068-011-Q1-K1-D8
cgcgatgcanctggcgtcgtcgtccatcctgcccatgacgctgaaaaacgcgatcgggctgggcctgctggaggtgctgcanaaggaggccggcggcggcaaggcggcgctggcgcccgaggaggtggtggcgcggatgcccgcggcgcccggcgaccccgccgccgcggcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactacc

SEQ ID NO: 54614 - DNA, 408 bp, Zea mays
  Clone ID: LIB3068-011-Q1-K1-E10
cccacgcgtccgcccacgcgttcggtttctcttcgtgggaaattggttgcttgcggcgactataagaatgagggcgggtgggttgatttcgactgcaccaaccctcgcaaacgaagcaggattccttccttcctgcgacgagcgttgcgcaaccaacttctgtaaatactggctactgtgagactggctatgcttgttcttattacagacgtgctattccgcgtctgaattctgaaactgccatggaaccctcctataatcgtcgctgtaatcgtgtggagggatgtaactacgaggtagtaaaaaagcggttacaggacaggaaatagtggaaaggtagataagcatagatagtatatagtcaaaagaggtcatgtttgctatgttgtagagatctctcacttttta

SEQ ID NO: 54615 - DNA, 398 bp, Zea mays
  Clone ID: LIB3068-011-Q1-K1-B5
gcgtccgcgctagcgtgtgcgtggcgaccagatgtggcggaggcgagtgggcgccctccttctggcgagtccacgaacttcttcctgggcctcctcgtcctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagcgagaaaggggagttgatcctagaaatcataaaagaagggaggattgttccgtctg

SEQ ID NO: 54616 - DNA, 351 bp, Zea mays
  Clone ID: LIB3068-011-Q1-K1-E12
gcggaagagaccgagagggagaagcgtttctcctgggttgttcgggtgagcggctagcgagagcgagacggagcgaggctttgccgctgcagagcagagcgacatgagctaccggcttggaggcgcggcggaccgcgaggagggggacgaggagctgttcgagacggcgccgtccgtctccggcggcgagggctcgtgcgaccaggagcgccgcgcgttcgtgccgccgctgcggaggatgaactcggacagcatctacgacatggcgtccatggtgtcgcagcagctcccagccaagaaagggctatcgcggtactacgagggcaagtcgcagtcgttcgcgtgcatgtc

SEQ ID NO: 54617 - DNA, 116 bp, Zea mays
  unsure at all n locations
  Clone ID: LIB3068-011-Q1-K1-F1
aagaaaaaaaaaaaaaaaaaaattaaataaaaaaaaaaaaaaaaaaaaaaaaaggaaggaaaaaaaaaaaaaaaggaaggaaaaaaaaangggccgccccttttaaagaaccaaac

SEQ ID NO: 54618 - DNA, 417 bp, Zea mays
  Clone ID: LIB3068-010-Q1-K1-H3
cggacgcgtgggctgtccggcgacctaggtctctcggcttgtccgcagcccgccggtcagtaatggcgcatgatgatccggttgtttctgctcagtggctgcacgagcacctaggaatgcctgatgttaaggttttggatgcttcctggtacatgccggtagagaacagggatccatggaaagaatatcaggtggcacacatacccggtgcgctattcttcgacttagatggcatagttgatcggacaactgatttaccacacatgctgccatcagaagaggcttttgcagcagcaatttctgagctggatataaaaaaccaggataaagttattgtctatgatggaaagggattcttcagtgcgcctcgtgtttgggggatgtttagagcgtttgggcacaagacagtctgggtac

SEQ ID NO: 54619 - DNA, 437 bp, Zea mays
  unsure at all n locations
  Clone ID: LIB3068-010-Q1-K1-H4
taccggcttggacgacccacgcggacgcactcgacgctccagctgaccgtgtgctcgcacctttttctcttccccaaccgtgcccgaggcctcgcgctcccgccccctccggggaccgctgcggcgcttgacgcgacgcaggaggaggaggaggaccaggagtgggaggctgcgctgcagaagtggaagaccaagacctacgcgctctcggtgcccctccgggtcgtcgcgctccgcggctccttccctccatcttggattaaggatttcgtcgaagctcaggggaagagactcaaattcagtcctgaactccgtgctaatcttgatgggatcctctctgagatgtcacaatgtatggacaagggtcaagatcagccgaagtctgcaatggcagctcatgttgnttcccttgcngactactggctcggctatgccat

SEQ ID NO: 54620 - DNA, 265 bp, Zea mays
  Clone ID: LIB3068-010-Q1-K1-H5
tcccactcgtcctaaaaataaatatataatataaaaaaaaaaaataaaaaaaaggaaaaaatgaaaaatattaaaaaatagaaataataaaaaaataaaaaaaaaaactaaaaataaaataataataatattttacataatatacttatacatacaagtaaaacaacaatgatccatgtatttattattacgttcatacacttcatctatgtactcttctatatattacatgtaataattcatccgacaattaatttactacaca

SEQ ID NO: 54621 - DNA, 471 bp, Zea mays
  Clone ID: LIB3068-010-Q1-K1-H6
accggtctcggcaagtcccacgcggacccacgcgtccgtgaaactgatgttttcatggagaaatcaaccccgacagtgaagtttgagaggcagctttgcaaaacgagggatgagaggtaccttcttgacctgcaaagggtcagtggatcacatcttctctttctggacttgtgttccgcctttctaactcagctgagagttctttgagcctgacatgattggcttcccaagcactccttgatgcacccagtggagtttcaagttacatttgagatgtacataatgaccatatataatcctccagtagattatattttctggagcatgtaatgtagacgttagaggcttgtcctggtttgccaagatggttgttacctaaggtcctaacaagaggccgcaggcgagcccagtccaattagatgatgtgaaaaatttttggcctttttttagtctttggacatgttatcaaat

SEQ ID NO: 54622 - DNA, 437 bp, Zea mays
  Clone ID: LIB3068-010-Q1-K1-H7
cagcatcccggcggggctggtgcaggggcagttccggtcgctggtcctgtcggacaaccggctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggctgtccacgctgcagaagctggacctgagctacaaccgcctgtgcgggccgctccccaagggacacggcgtcatcaagcacgggtgcaagccgtacgcgcacaaccagtgccgcaaagggaccccgctcgcgg

SEQ ID NO: 54623 - DNA, 454 bp, Zea mays
  Clone ID: LIB3068-010-Q1-K1-H9
ccgtctctccccgccgacgcggctcgatgccatgctcttcccacagttgcggcctcacctgcgccggcgcgtctccgatcgggtagctgcctctggcaccacctggtctcccgccgccaatgactccgaagacagcttcgacggctggtggtttcccgagtacgagaagcatatgaaacaggggaggaggaggatagggtttcagagcgctgtcgtggttgagttgggagcgtctgctgcgatcgcgattgctgggctggcgtggcgcttcccatcctccaggaagcatatacaacaactcattgttgcaccattacactatgttcaagataaattgtcaacaatggagtcgacagagataatcaaggcagatgcaagtgagagggaatctgatgaaatccaagtttctagcgcaacacatgataagatagctgaagcaataactgacgattca

SEQ ID NO: 54624 - DNA, 368 bp, Zea mays
  Clone ID: LIB3068-011-Q1-K1-A11
gcgggcacacgacttggaagaagactttgaatactaccaaaataactaacacttgggaggactcattaatgtaatggagagtgttattgaaattgaacttgcacacatacgcatacacacagacatgggaacacaatatgctagattctattctaaaaaccttattgaacacattaaactacacatcacacgtttcaacatacctaagattattcctactcttaatcaacctcatcactaacaagaactctcctaactactcatacaccttgacatacatgacaatgcatccgacaatattatcaaccatattataaatgcatctgaacatacacaggatcatgatcagtgcaatgaagtttccaatg

SEQ ID NO: 54625 - DNA, 288 bp, Zea mays
  Clone ID: LIB3068-011-Q1-K1-A2
acttctgaccccagaagtcctcaaggaaatgcagctggagcaggagagaatagaagctgagaaaaagcgggtaaaagaagacgctcaacaacttgctcgagtttttgaaaccattggcgctttcaaactccctcgcaaaggtggaaaaggaaaacagatctttgggagtgtcacggcacaggatgttgttgacataataaagtcacaacttaatagggatgtcgacaagaagctggtgacggttccagaaatccgtgaaatcggagagtatgttgcagagatcaagct

SEQ ID NO: 54626 - DNA, 407 bp, Zea mays
  unsure at all n locations
  Clone ID: LIB3068-011-Q1-K1-A3
acgcggacgcgtncgnccagccgtcgtctgctgcggactccgcctccagtttggtctgtggcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtc

SEQ ID NO: 54627 - DNA, 292 bp, Zea mays
  Clone ID: LIB3068-011-Q1-K1-A4
ttattacttccttaataactcaacatatgtactctttacctgcttatgcattcatagcacaaaactttactactcaaactgctttatatactcatcaccaatacattgcagggttcatcattacaattcctattgctcatggaactatttttttcattatcgattacaatcccgaacataatgaaaataatctaattgcaacaatgttaaaccataacgaaactatcatatctcatttaagtttggctaacctctttctaatattccataccttttacctttatattcataa

SEQ ID NO: 54628 - DNA, 386 bp, Zea mays
  unsure at all n locations
  Clone ID: LIB3068-011-Q1-K1-A6
ggggaagcaaggatatcccgcaaggatgagattatgaaggccattgngaagaagctagaccgctacaagaacccatggttagagttgaaaattcagtacggccaaaataaagggaagttctataacgaggaatgtgaccgctttatgctttgcatggtgcacaaacttggatatggaaactgggatgaactgaaagctgccttccgtatgtctcccttgtttcgatttgattggtttgtgaagtccagaactacccaagagttggctaggcggtgtgatacccttatccgactggttgagaaagaaaatcaagaatatgatgagcaagagaggcaagcaaggaaggagaaaaggcttgctaagaacatgactccaacaaagcgagc

SEQ ID NO: 54629 - DNA, 368 bp, Zea mays
  Clone ID: LIB3068-011-Q1-K1-A7
acggacaaaagtggggacaaaactggcaacaaatctggcacacaatttgccgtggcgggcgccgtgctggtcgtggcactgctgctgacaacctcggagaccaccatcaactgcggcctcacctgctcccacataaactcctgcctctcgtactgcctctgctacaagcgcggcacctgctcctgctgctgtaggtgctgctggaacctcaagagcaacctcaagagcgccgccagcaggggcgccgactggaactgcctctagaactgcctcaagaacgtcagcagggtcaacagcggccacaacgccagcaacgcctccaagatccgcgtcaagatccgctacaacatccgctactccatcgactg

SEQ ID NO: 54630 - DNA, 287 bp, Zea mays
  Clone ID: LIB3068-011-Q1-K1-B1
ggctgggctgggctcgtccgtcagcctggcgtgacaggccgtcggcgtcgtccgtttctgccgccccatgctcggctcggctcccatcccatgtggagggaagagaagggtggggggagctggtcgtcggagttggtgcgtgcttcgtttgcttgtgctttggcgccatatcgctgcggagcgctgtacgtagccatttttcgccggggagggatcctcatcctcctcgttggcttgctacgtgttccttgccgccattacgaaaccttaattgctcgctttacacg

SEQ ID NO: 54631 - DNA, 109 bp, Zea mays
  Clone ID: LIB3068-011-Q1-K1-B10
aaaaaaaaaaaaaaaaaaaaaaaaaaaaaaaaaaaaaaaaaaaaaaaaaaactggcggcgcgtaaaaaataaaaaaagggcggacacaaacttcccacccctttaaaat

SEQ ID NO: 54632 - DNA, 409 bp, Zea mays
  unsure at all n locations
  Clone ID: LIB3068-010-Q1-K1-H12
cccacgcgtccgagcccctcctgctggctgccccttgctccctcccatggggcgccccctggatccctctccatggcgtggatcagccccagcttcccatggatgtcgccctcctctccctgatggctggcgtctccactccctgcagcaaggacgctttcctctgctccctgctcttcctcccatggccccccatgtagcagtaaccatggaaacccctctgggacgcgccctcagcatgctcaatgatatgctgcagcgagctccaccttgatctatgccaacccggccgcanatcatcgaaccttggggaacccttgggaccgatggtgaagaggtgaagcccatccaacgtttgttaaatgttcgatagaaggttcgaaccanaagtcatcggcgatcttgtgat

SEQ ID NO: 54633 - DNA, 235 bp, Zea mays
  Clone ID: LIB3068-011-Q1-K1-B11
cccacgcgtccgcttgtcagttatacaagtctaatgcagtcttttcactatcgggggcttgatttatctacgacgtcgatactgattacagattgttttgtattgtattttacgacaattggattttatttgtttctacatttgtatattgtttgtgagatgagagaaacctcttcaaggcgttgaaccaaacgtacttttccaacatttcatatatatcttaataattacattt

SEQ ID NO: 54634 - DNA, 368 bp, Zea mays
  Clone ID: LIB3068-011-Q1-K1-B12
attggtggacctcacggcgatgctggcctcactggccgcaagatcatcattggcacgtacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgcta

SEQ ID NO: 54635 - DNA, 305 bp, Zea mays
  unsure at all n locations
  Clone ID: LIB3068-011-Q1-K1-B2
ccgcacgcgtncggggtgctccttaaaatatcattgcagcccgccatttttggtgatgtggacgcacactaagcttcagacccatttccttctgcggactccacatatttcagcaatgcaccatgacgttaacttctcgtaaaatntntgnggccgnaaaatatgaagaaaacctagagattacaggcacatacttggaggctcagaagctggtcgatgaaatctgtgacattgtggcgacaagagcagcccggctggctgctgcggggcttgcaaggatcctcatgaagatcgggagagatcac

SEQ ID NO: 54636 - DNA, 249 bp, Zea mays
  Clone ID: LIB3068-060-Q1-K1-F6
gcgcccacgcgtccgcccacgcgtttgcctacgcgtccgcccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaagaaagaaaaaaggggtgcttcattaagaatgacaaatt

SEQ ID NO: 54637 - DNA, 263 bp, Zea mays
  Clone ID: LIB3068-060-Q1-K1-F8
ggtggcgccatgggagggctccggcagcacacagtgctcatctctacccagcacgacgagacagtgacgcaacgacgagattggtggtgacctggatgagcacgttatagagcccgacattgccgatcagtaccattactagaagacaatgtgccagctaaacacgtctgggcgcttcatcattggttgacctgacaggcacgcccgcgtcactggacggcagatcattcgagacacctacggtggctgctgagcccactgac

SEQ ID NO: 54638 - DNA, 325 bp, Zea mays
  Clone ID: LIB3068-060-Q1-K1-F9
cccacgcgtccgaaaaaaaaaaataaataaaaaaaaaaaaaaaaaaaaaaaaaaagaagaaaaaaaaaaaaaaaaaaaaaaaaaaaaaaaaaaaaaaaaaaaaaaaaaaaaaaaaaaaaaaaaaaaaaaaaaataaaaaataaaaaaaaaaaacaaaaaaaaaattaaataaaaaaaaaaataaaaaaaaaaaaaaaagtaaaaacaaataacataacaaaacttaaacaaaaataaaacaaaatccctttataaacaaataacaaattatctaataggccttaacatataacgcttcccaacatttgccaatcctaaatgccca

SEQ ID NO: 54639 - DNA, 406 bp, Zea mays
  unsure at all n locations
  Clone ID: LIB3068-060-Q1-K1-G2
tgcctctgtacgactcacgccttattgtaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgccggcctcactggccggaagatcatcatcgacacctacggtggctggggagcccacggcgggggcgccttcttcggcaaggacccgaccaaggtggaccgcagcggggcctacgtcgcgaggcangctgccaagagcatcgtc

SEQ ID NO: 54640 - DNA, 378 bp, Zea mays
  Clone ID: LIB3068-060-Q1-K1-G3
ggcgatttggccaaggttgcttcttgtcgaatcctgctcgagttgggccttgggcgtgccgagggtgcgcccactccctgaggaggctctcgggcgagacgtaacttcgttcgggactacagttcccgcccgaggttgggctcgggtgaggcgagatcgcgccccttgggtagacgaagccttgacctgaatcgcgcccatcagtctctgcagcttgcgctgatggtggttaccagccgtgtttaggagtgttgggggtacccctaattatggtacccgacaaaaagatactagtatctccactatttgggtctattcggtggaccgaatagaccgaaccaaaattgtgagtctattcgggttcggttcctaaaatta

SEQ ID NO: 54641 - DNA, 374 bp, Zea mays
  Clone ID: LIB3068-060-Q1-K1-G4
cccacgcgtccgggcttgacaagagctaggtaaggcaaaattccactgaaagcaggggaaggttaactcatctagagttcaggatgaagtcatagctcccaacaagatctggattgttcattgatgcttggattgcctgatcacgataagaatgtgttgaaatcagcagctatgttttctcggggagattcagctggcattttccatgaagttttgcacgaagtgtatcttgtaccatattgagttcagttgtcggataaagttttgttggtaggtcagaaaggctgctgcaagtcatcggtgtaaattttcttttattagtttcattaatgtcctcaatagtcggtgtttccaagttggagaaaggaaagaac

SEQ ID NO: 54642 - DNA, 328 bp, Zea mays
  Clone ID: LIB3068-060-Q1-K1-G5
aaaaaaaaaaaaaaaaaaaaaaataaaataaaaaaaaaaaaaaaaaaaaaaaaaaggaaagaaaaagtacccacataacgtggtgacgatatctagcaaaaagatgaaactaaaatggaactaccgttcccgcccgatgcaaagctaaggtgcggggagatcgggcccttgggtacgaccaagccttgacctgcatcgcgcccatcaatctctgcagcttgcgctgatggtgggtaccagacgcgtttaggaatgttgggggtacccctaattatggcacccggcacacagatactagtgtctacactatttgggtctattcggttga

SEQ ID NO: 54643 - DNA, 294 bp, Zea mays
  Clone ID: LIB3068-060-Q1-K1-G6
tgcctctgtacgacgccctcgtaggctcgaacaggcagaagttgcagtcctggtccgtgttcatgcctctgtacgacgccctcggagggaccatcagctccagatcgtgggggctgcagagagaggtcgaccaaggcatgaacgaccgggtgccggacttcgtgttcctggcgcacgtggtggacgtggtgtcgtcgatgcacgtgcctttcgccttccgctcctgcagctcgctgccgtgggccatgcgctcggtgctgctcccgctctggcccgtcgccttcgccttcatgc

SEQ ID NO: 54644 - DNA, 369 bp, Zea mays
  Clone ID: LIB3068-060-Q1-K1-G7
cccacgcgtccggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgcccgcaggcgcgcacgcggtgcggctgggcaacgaggcgt

SEQ ID NO: 54645 - DNA, 388 bp, Zea mays
  Clone ID: LIB3068-060-Q1-K1-G8
ggcaaggcgtacgtggcacgctcgcgtccatctccacaacgacgaccttcatggcggtgccggcctccgcctccgcgtgcgcgtgcacgcgcgccggcccgccgcagccccgccaccgcgcgcgtagtgccgccgcgaccgcggcggcgttcttgctccgccgccaccagcgaccgccacggcagataataaacatcgtcgacgaccgccgtgccagctccgatctccgctgccggcgacggctcctcacggcgcgaggcgagcgcccgtcccacgacgacgacgaggacgaggagcagacgtcgtctgctggtggtggttacggctcgttcggcgcggcggtggcgctgttcaaccgcggcgagtaccacgcgtgccacgacgtggt

SEQ ID NO: 54646 - DNA, 429 bp, Zea mays
  unsure at all n locations
  Clone ID: LIB3068-060-Q1-K1-G9
gaacgtcgtacgagaacctttctcccttctccacctttctccttttcttgccacgggggaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgncggcccccccccagcgtctatacctgggcgatcgcgacatcggcgaggtgtttgtgcccatcgacgacctcctggccggcgccgacaagggtggcgatcc

SEQ ID NO: 54647 - DNA, 408 bp, Zea mays
  unsure at all n locations
  Clone ID: LIB3068-060-Q1-K1-H1
agttgacatgaccaatttgatgaagcttcgttctgattataaagatgaatttgtcacaaagcatggtgtaaaattgggtcttatgtcttgctttgtcaaggctgctgtttctgcacttcaaaaccagccaattgtcaatgctgtcattgatggtgatgacatcatatacagagactacgtagacatcagtgttgctgttggcacttccaagggccttgtggttcctgttatccgagatgctgataccatgaactttgctgacattgagaaagggataaacaaccttgcaaagaaagcaactganggggcgctctcaattgatgacatggcaggaggaacattcaccatcttcaacggtggtgtctatggaagcctnctcagcacacctatcatcaacccttcacagtc

SEQ ID NO: 54648 - DNA, 294 bp, Zea mays
  Clone ID: LIB3068-060-Q1-K1-H10
gcggcaaatcccaatctcccagcgtgcgcttaaaccctagcttgcctatcgatggggccggttaagcgcaaggccggtcccgccgagtcccccgccgccgtggaggcagccaccaccaaccaccgccacgagccggcgtcctcggagcccaagccacgcggctccatctacttccccatcactgacgaccctgccgaacccaacgccgccgaagaggacgaggacgagggcgccggcgacgactaggacgacgcggaggacattgtcaagctacttgagccgctgtcgcgggag

SEQ ID NO: 54649 - DNA, 369 bp, Zea mays
  unsure at all n locations
  Clone ID: LIB3068-060-Q1-K1-H11
gcgcggccggccgctgctgctgtttcggcgcgtgagatggatgattgcggcgggggcggctgcaagaggccgttccagctggcgcggtcgctgacgtaccaccaccacccggggcaccggccggcggctgtgtccaggtggcggcggcagcaccagcagcatcagctcgcggacgagccgcgcgctccccggccgcaggcggtggtgctgtacacgacgtcgctgcgcggggtgcggcgcacgttcgcggactgcgccgcggtgcgcgccatcctgcgcggcttccgcgtggccgttgacgagcgggacgtgtccatggacgcggcgctcncccgggggggcgggaggtccaggcgctgctggccgcgc

SEQ ID NO: 54650 - DNA, 319 bp, Zea mays
  Clone ID: LIB3068-060-Q1-K1-H3
cccggtggccaccttgggttccttagatctggacccagagcgcgatcagtaaggtcttataggagtatgggagcgtatgacgccccgtcgcagaagaagaagggcttcgtgctgccgaggcctaagatgtccaacgctgacctgggcaggatcatcaactctgacgaggtgcagtctgtggtgaagccactcaacaaggaggtgaagcgcacggagaagaggaagaacccactcaagaacatggctgctgtgctcaaactcaacccctacctcggcactgcccggaagatggacacccttgctgaggctgctcgtgtga

SEQ ID NO: 54651 - DNA, 411 bp, Zea mays
  unsure at all n locations
  Clone ID: LIB3068-060-Q1-K1-H4
ccaatatccacctcctcctcgccccctgctttctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcngtggcggtgattgaggtagtcgcgtc

SEQ ID NO: 54652 - DNA, 267 bp, Zea mays
  Clone ID: LIB3068-060-Q1-K1-F5
gcgcgcacgcgtacgatcactgtgctttagtacaagcaagccaaatatgcacacgagtgggagtcgacaagctcactccgagaggaaaggatgaagtggtggcgtatgaggccactgcagaagcgaaacatctaatatgtgagcggagatccctgaattgcatggatcgagtgaactagtctctgagaaactatggggagtgaacttgatggctctgtgaaactgtgctatgcgaactagatggctatatgaaacgaccatgtgaag

SEQ ID NO: 54653 - DNA, 61 bp, Zea mays
  Clone ID: LIB3068-060-Q1-K1-H6
cccacgcgtccgataaaaaataaaaataaaaaaaaaaaaaaaaaaaaaaaaagggaggaat

SEQ ID NO: 54654 - DNA, 369 bp, Zea mays
  Clone ID: LIB3068-060-Q1-K1-H7
gcccccggtggccaccttgggctctttttgatctggacccagagcgcgttcaataagctcgaggaggtgtatgggagctatgacgccccgtcgcagaagaagaagggcttcgtgctgccgaggcctaagatgtccaacgctgacctgggcaggatcatcaactctgacgaggtgcagtctgtggtgaagccactcaacaaggaggtgaagcgcagggagaagaggaagaacccactcaagaacatggctgctgtgctcaaactcaacccctacctcggcactgcccggaagatggccacccttgctgaggctgctcgtgtgaaggccaggaaggcgaagctcgactccaagaggaccaagcttaccccg

SEQ ID NO: 54655 - DNA, 418 bp, Zea mays
  unsure at all n locations
  Clone ID: LIB3068-060-Q1-K1-D3
cggacgcgtgggcaagccgacatatgtcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggngatagggctggcggagtggttcaagagggacgtggtcacgttaccgttcgaggagc

SEQ ID NO: 54656 - DNA, 208 bp, Zea mays
  Clone ID: LIB3068-060-Q1-K1-D5
cccacgcgtccgaacaaaaaattagatataataactaataacaactaaaaaaaagcaggaaaaatctccaaaaaaactaggcctccacactatcaacaacccccatctctacatctgcctaaatccatcatcttatcacttctctaactctccctaccactaatctaccgctcctccttctacaacttcgcgattctaaaaaccctgg

SEQ ID NO: 54657 - DNA, 220 bp, Zea mays
  Clone ID: LIB3068-060-Q1-K1-D6
gcgcgggccactcacatcaccgcatttaatgcaaagcatatactaaccacaaaggggcgggggcatgagggacgcagtgatgtacataaagacgggagccaacctctgcccagccgatccgatgattcaagaaaactcgaccgatcgcacgggaccgagcacccaaaggcagcaccaaaaagaatgcccgagaaccaacaggggaaagggcgcataacgc

SEQ ID NO: 54658 - DNA, 126 bp, Zea mays
  Clone ID: LIB3068-060-Q1-K1-D7
cggacgcatgggctgacgcgtgtgagtacagacctaacctgatcaacaaattggggggggcgttcgatgctcatctaggagacctcacgcagaggcaactactagctgccggtgccacaatcaatg

SEQ ID NO: 54659 - DNA, 391 bp, Zea mays
  Clone ID: LIB3068-060-Q1-K1-D8
cttcattcaactggaaccacaatcctttttatttgaagcagagactatggtggaaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaatgcaccgaagaaggcgaatgttgcaggaaagggccctaaaatgggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatg

SEQ ID NO: 54660 - DNA, 233 bp, Zea mays
  Clone ID: LIB3068-060-Q1-K1-D9
cggactcctctcattactcgattcttttctcatctaactcaatcaacaaatgagatgggtaaattacaacgtataaccgcaactttaaactcaaactaatactacaatctatttacacaaacaacatcatccacatttaccgaaaatccttaattccctcaaccaaaacaaccagatccataaccaatacttcaacacataactttcaataaaaataattccccaacacacat

SEQ ID NO: 54661 - DNA, 238 bp, Zea mays
  Clone ID: LIB3068-060-Q1-K1-E10
accactcatccacccactcctctacctacacatacacaagcacccaaataacgagaggattatttaacaaccttgttggcataccacacaccataccacatcaaacctcacgtaacaccaatagcaacaatcacatccactacgccatcatccaactatacaccatacccatcaaataccccccctccttcccacacgaccacccttacccccaactcttcctcttaaaacaccccat

SEQ ID NO: 54662 - DNA, 427 bp, Zea mays
  unsure at all n locations
  Clone ID: LIB3068-060-Q1-K1-E11
cccacgcgtccgcggaagcgagtgtgaataaagggccgcgatggaggctgacagggcaggggcaagatccgaggttgagatgaagaaagagaaattgcgccagttgttgagttcaaccagtagatatgctgataacttatggtacatagaaccgaacacctaccgaagaagggaccgggttagaatggactatcacagaagcttaaggacacttattcattgacacttggaattgggatgcttggaggtaacaccaactggaatgatggactctcaatagctgaaagacttgtcaaatctcatgaaagggaaagtgattggtggtatgcaanaaaaaaaaggtttacattacctgaaagggcattngctgttgattgggtttttgctgatgggccacctgggaatgcaaggaattatgataacaatg

SEQ ID NO: 54663 - DNA, 425 bp, Zea mays
  unsure at all n locations
  Clone ID: LIB3068-060-Q1-K1-E12
agaagtcaaacctgggttcacttggttcccatccccccaagtttcgacctcagtgggtgagccatacaacagtgtcctgtccacccactccctcctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatttgggggcctccagtcatctctgctgagaaggcctaccacgagcagctgtctgtggccgagatcaccaacagcgccttcgagccatcctncatgatg

SEQ ID NO: 54664 - DNA, 278 bp, Zea mays
  Clone ID: LIB3068-060-Q1-K1-E2
cggacgcgtgggcttactggttctgttgctatggttgacggatgtatataggatatgtgccttttgacgcgtgtaagcacaaacgtttagacagaccgagagcagcagccagtgaacctgttatggttttgcagttgttcagtacggcagaatgttgttaaaccgtagctcagagatgtattaccagtggcgctaagctgtactgttacggtgtataatgcggatacaaataaacaatctagcgggtcattaaagcctgaactcagataacatgttct

SEQ ID NO: 54665 - DNA, 421 bp, Zea mays
  Clone ID: LIB3068-060-Q1-K1-E3
aaaggaagttaattctgtaaaccagattcttatatattgctatcgaaaaggttaaagagcctgatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaagaaattgcacgtgccgaatgcatcaaaaagggtagactacccctccaaacaattcgcgctaaaattgattattgctgctatccaattcgaactatctatggagtattaggtgtcaaaatttggatattcgtagaagaagaataactaaccatgtcttcccattccgcccagtgatagaataaaaaagacaagaaccttgttttttc

SEQ ID NO: 54666 - DNA, 428 bp, Zea mays
  Clone ID: LIB3068-060-Q1-K1-E4
cgcacgcgtccgtatttatgtaaaaactgcctgtcaaaatgattaattggaattccagttagtcattgaagaaatgaaaaagggattaaagaaaataaaaaatccaagtcttaaatgaaagggtctggttggaatcataaagtgtggtagaaagaactacatatagttttttctaccacactttagattctttctattatattatcttgaatctacatagaatcgattagtagattgaaatagtagtctaattcaacttcttttttcactgcatccacttaatttcaatcaagtcaaaatcaaaaaaatcgaagataattcttcattgaaagaatccaaagagggggagaaaaataatacgagaatagactagaatagattatagtaaaagaaaaaaagtaaaaagaaaaaacctacgaatctttcat

SEQ ID NO: 54667 - DNA, 427 bp, Zea mays
  unsure at all n locations
  Clone ID: LIB3068-060-Q1-K1-E8
acccgacgcgtgggcggacgcgtttgccttcgcgtgggtccgcatccccaaatgaagcgccgcgcgcaaggcagcaaacgcgccgcgcaccggaaggccccggggagctgcacgaggtggccccattgcggcatggctgctacggccgacgccgctggcgtcgagttcccgctcattggcgttgccgtggccacgctcatcgtgacggtccttgtcgcggccgtgatgcgccggcgacgacgtccctggcaccaggcgcctctggtggaggggaaacccgcaccagaggcaggctgcgcggtcagcgatggcgggacggacgtcatcatcgtcggcgccggggtagctggatctgcgctggcatacacgctncgaaaggatggccgtcnggtgcatgtcatcgaaagggatctgacagaacctgaca

SEQ ID NO: 54668 - DNA, 315 bp, Zea mays
  Clone ID: LIB3068-060-Q1-K1-E9
aaaggtctgaaaccccgtcctctacttttggatatatgagtacttggataactggatggttatgggacatcctttgtagaggtccactaagcatcctatattacacctcatgtatcaggaatagctaatggcacatagtcaatggaaggatcatatgttccctctttcccatgatatatgccctcttttatccgtaagtctaccttggccttctactctgccgctaaaagctctgcattctgcattgtcgacaggagagtgcttgctatatgactgcaacctatactggtggcggatcaccattctgaatagggc

SEQ ID NO: 54669 - DNA, 268 bp, Zea mays
  Clone ID: LIB3068-060-Q1-K1-F1
cccacgcgtccgcacagaacttgagctttattacatcctcacctctaatgcacgcaagtttgagtcgatgatggcactcccaatggaaaggaggaagaggtggcttatgatgcagctaaggaagtgaaacaacttatatgtgaacttagatctctgtattgaactgattgtgtgaacttgtctttgtgaaacttttgtgtgtgaacttgatggctatgtgaaactgttgtgtgcgaacttgatggctttatgaaactactatgtgaag

SEQ ID NO: 54670 - DNA, 268 bp, Zea mays
  Clone ID: LIB3068-060-Q1-K1-F11
cccacgcgtccgcacagaacttgtagcttatgacatcctcacctctaatgcacgcaagtttgagtcgatgatggcactcccaatggaaaggaggaagaggtggcttatgatgcagctaaggaagtgaaacaacttatatgtgaacttagatctctgtattgaactgattgtgtgaacttgtctttgtgaaacttttgtgtgtgaacttgatggctatgtgaaactgttgtgtgcgaacttgatggctttatgaaactactatgtgaag

SEQ ID NO: 54671 - DNA, 405 bp, Zea mays
  Clone ID: LIB3068-060-Q1-K1-F12
ggggacacgatcgccatggccttcacatcgaccgccgccgacgtgctgtgccggccggccgtggccgaactccgcctggcgccgtctaccggccgggcgcgcgtgtcgttccgcgcggcgccggcgccggcgcggaggtccgaggcggcacgcgcggagctgagctcggcgctggtgatcagcctgagcacgggcgtgtcgctattgatgggcacgatacgtcttcttcaacttccagcgggagaacgtggcgaagcaggtgcccgagcagaacggcaagacgcacttcgacgccggcgacgagcgcgccaaggagttcgcggcccttggattttttccaagtctaacgacccagtgggcttgaacctcgtcgacgtcctcgcctggagctcgatcggccacata

SEQ ID NO: 54672 - DNA, 322 bp, Zea mays
  Clone ID: LIB3068-060-Q1-K1-D12
cccacgcgtccgctctcgcggacatactggacagctcacccgattccggcacggaagagattgtgcaggcgatggtcaatgcatcagcctcagttggctcaccatcagaggagaaggttcaggccaggatgcagatgatcacccgggtgttcctcaagagcctccagcccggtgacgtggtcttcaagaaggtatcccgtgcggtctactgcgccttccgtggcatcatcttaggtggcagtggtcctaagggccagaagctggcggacgcggcattgcgccgtatcggcgccaccaaggttgtccacagggtgttaaaggc

SEQ ID NO: 54673 - DNA, 448 bp, Zea mays
  unsure at all n locations
  Clone ID: LIB3068-060-Q1-K1-F2
acccacgcgatgcgggacgcgtgggtggagaacgagcactacattgagatcttcatcagggagatcaaggtcgtcacgggcagcgacagcagcaccgccgtcaccttcggctgcaactcctgggtgcactccaagttcgacaacccggaaagcgcatcttcttcaccctcaagtcctacctgccgtccgacacgcccaagggcctggaggacctgaagaagaaggacctgcaggcgcttcggggcgacggccacggcgagcgcaaggcgtccgagcgcgtctacgactacgacgtgtacaacgacctgtgcgacccggacaagaaccccgnccaccagcggcccgtgctgggcggcagcaagcggtacccgtacccgcgccgctgccgcaccggtcgcccccagaccaggaaggacccccgaggcgatgtgcgccatgggcacaacta

SEQ ID NO: 54674 - DNA, 408 bp, Zea mays
  Clone ID: LIB3068-060-Q1-K1-F3
gtttcacaatttaatgaatcctccacttatttgatgggatggttaagagattacctagtgggtaaactcttcacaacttattaatggatataatccttttgggatgaatagtttatcagtatgggcttggatgttcttatttggacatcttgtttgggctacaggatttatgttcttaatttcctggcgtggatattggcaggaattaattgagactttagcatgggctcatgaacggacacctttggctaatttaattcgctggagagataagcccgtggctctttccattgtgcaagcaagattggtcggattagcccacttttccgtgggttatatattcacttatgcagctttcttgattgcctcaacatcaggcaagtttggttaatttagttattttttttt

SEQ ID NO: 54675 - DNA, 450 bp, Zea mays
  unsure at all n locations
  Clone ID: LIB3068-060-Q1-K1-A9
tctccgacccgaccgctacccgttggcggacgcgtgggcggacgcgtgtgctgtacgcgtgggcggacgcgtgggtggaagcccgaacgtgaactacaccgactggctgaagcagcacagccccttctacaaggacgactggctggtgttctactacacggcggggcaggcggacgtggtgcaggtggacgaggtgggctacaacaagtgcgactccaccaacgccatctacaactacagcaaggggcgcagcttcgccttccagctcaacgagaccaagacctactacttcatctgcagctacggctactgcttcggcgggatgcgcctcgccatcaaggccgagaagctgccgcnnnccccggggcgtcgccgccgccgtccgtcagcgaccgctccgccgncgccatcgccgncttcgccaggtcccacgcgcccgtcatctacgcc

SEQ ID NO: 54676 - DNA, 353 bp, Zea mays
  Clone ID: LIB3068-060-Q1-K1-B10
cccacgcgtccgcccacgcgttttccctctcgtccgcggacgcgtgggcgaacgcgtggtcggacgcgtcgtcggacgcgtgggaagaactgggtaatcatgaccgagtccctgagacgtactagatgataaatgtactacgtcgtatcatggccgtggaaggggccgtggggatcgtggtagttatagaggctgatactgagggggatacagtcgtggtctaactgctgctgctacattcattgaagatcaagctcagttaccaagcctcagtgggaagtgaaaggctcacaaatgatgatgtcacctatcgttgtgttgtctgctagttggtatttatttatatttaaatt

SEQ ID NO: 54677 - DNA, 428 bp, Zea mays
  unsure at all n locations
  Clone ID: LIB3068-060-Q1-K1-B12
gtgctgcccattctacaaatccgtttgtatgatgcgcaatattattcacttcagcacgttggcaaatcaggctgtggagcgggcagctggtactgatggccaaaagataacatacggtgtcataaaacaccgtttgggcgatctattttatcgcctagtatctcaaaagttcgaggatcctgccgaaggtgaagaagctttggtcggcaaatttaagaaactgtatgatgacctcaccactggtttccgcaatctcgaagacgaggcacggtgaactagtgtagattctgtgtaaacaaggactgccaaatgttttataagatacataanaaattttttttgtagattgagatcatctgtaagaattattcccaccgttgcaccatctcttcgccaccactgttttagtcatcggtgcctgatgggca

SEQ ID NO: 54678 - DNA, 386 bp, Zea mays
  Clone ID: LIB3068-060-Q1-K1-B3
caaaaacatggatcaaaatcaacaagataagttgaacatttgcggcggtctaggaaagacagtgaccatcaaaggagtttctcaaatcaggctggtgtttctacagtagatggactagaagattttcccatgggtaagtctcagaatgtgcatacgtttaatgaggaagaatttgagagaagtacggcagcagcggctatgaaagaggctatggataaagctgaggcaaagttcaaacatgccaaggaagtacgagagagagagcgtgatgcaaagcttagaaatagagaacaacaggaacgagataatgtaataaggtcgtatgcccaggatcgtgaggacaaagagagaaaggaaagactagaacaagaaagagagatgaggca

SEQ ID NO: 54679 - DNA, 244 bp, Zea mays
  Clone ID: LIB3068-060-Q1-K1-B4
gaaaaaaaaggtgcagaatgtcctaaaaaaataaaaaaaaaaaaaaaaaaaaaaaaaggaaaaataaaaaaaaaaaaaaaaaaaaaaaaaaaaaaaaaaaaaaaaaaaaaaaaaaaaaaaaaaaaaaaaaaaaaaaaaaaaaaacaaaaaaaaaaaacaataaaaaaaaaacaaaaaaaaagaaaaatgaacaaccactacaaaactaatgaagtcacctacaaaaatgatcaaaagaccaata

SEQ ID NO: 54680 - DNA, 416 bp, Zea mays
  Clone ID: LIB3068-060-Q1-K1-B5
atcgtcacttacagcaatattatcgcttcagcctgtgtagccacggcgatgaccacaatggttgttgggtccgcggtaggctggcgaggcggtgcttggtacgctcgaaggggcttgagaagagagcaacaaaagctggtggggatgggtcacatgaagtcgcacgacagatggcactggcggcccttcaacaggctcaggaacagcaggttagcctccaagaacaagcgcgccgacgcccatccaagcaccgaggccccctcgacgtcaagcaacacggcctctgcggacgttagcagtgcttctcagccggcagcgggcagtgcatgagcttatatatcaacaacaatggactaggatgtgaagctggggccgcgtagtagtccataagacttggtagaacagaccatgtgagt

SEQ ID NO: 54681 - DNA, 333 bp, Zea mays
  Clone ID: LIB3068-060-Q1-K1-B7
gcaagaatggaacctgcccctgtctcttgcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgccggcctcactggccggaagatcatcatcgacacctacggtggctggggagcccacggcg

SEQ ID NO: 54682 - DNA, 355 bp, Zea mays
  Clone ID: LIB3068-060-Q1-K1-B8
cccacgcgtccggggttggcttttccttcccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccg

SEQ ID NO: 54683 - DNA, 224 bp, Zea mays
  Clone ID: LIB3068-060-Q1-K1-C1
cggccttggttccgcgacgtcgcccctctctctctctctagttctgtcgatatgttttttactaactcgctccaccgaatgagttccaataaagccatggagctagctaacccttgctgaactgtggaatggtttctgagcagagcgtggcggagctgaagcagaccctgctggcgaccacgctggagctggaagctgcgagggaagagctgaagcggaaggag

SEQ ID NO: 54684 - DNA, 413 bp, Zea mays
  unsure at all n locations
  Clone ID: LIB3068-060-Q1-K1-C10
gaagtgcttaaagctctgcaagaactgttatgtttactggaaaaagattggacactacgacatgaaatgcagatggagtcctggctgccttgagagtatgatgcataacagtgatagcttcagtgcggagtctgctataattgaaactgatgttttcatggagaaatcaaccccgacagtgaagtttgagattcagctttacaaaacgagggatgagaagtaccttcttgacctgcaaagggtcagtggatcacatcttctctttctggacttgtgttccgcctttctaactcagctgagagttcnttgagcctgacatgattggctttcccccaaaaaaaagcacttccttgatgcacccaggtggagttcaaggtacatttgagatgtacataatgaccatttttaatcct

SEQ ID NO: 54685 - DNA, 401 bp, Zea mays
  Clone ID: LIB3068-060-Q1-K1-C11
gctcgatccatctcactctccgctggtcgctcactcttgcagctccacccttgactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcgtggggggaaaggccgcggctcctgctggtgccgaggagcccgtcgcggccgaaccggccgccgaggcggaggct

SEQ ID NO: 54686 - DNA, 429 bp, Zea mays
  unsure at all n locations
  Clone ID: LIB3068-060-Q1-K1-C12
cccacgcgtccgcccacgcgtccgcttctttgttaaggggatatagtgctcctgtccggctagattctgatctgagtgagggtgacctatttttcttgcttgccagtgactcggatgaatttaacagatgggaagctggccaagttttggcacgtaagttgatgctcagtctcgtagctgatttccagcaacagaaaacactggttctaaatccgaaatttgttgatgggattagatcaattctgcgcaacacaagcttggataaggaattcattgcgaaagcaataactttgcctggtcaaggggagattatggatatgatggaagttttgggnnccccagatcctgatgcagttcatgctgtccgtaactttattaagaaggagcttgccgtgcaacttaaagatgatcttcttgcggctgtgaaaa

SEQ ID NO: 54687 - DNA, 296 bp, Zea mays
  Clone ID: LIB3068-060-Q1-K1-C3
gtcaaggccttcagatttccatacatctgattagggtctgaaattacaggtcttagtgaccagggttggcgggccgttaagcagaaaagataactcttcccgaggcccccgccggcgtctccggacttcctaacgtcgccgtctgccggcacgtcccggctcgggaaatcttaacccgattccctttcgggtgacgcgcgtgatcgcgctatctgccgggtttcccaccgcccttaagatcggcttacccatgtgcaagtgccgttcacatgtgaaccttttgcttttcggccttc

SEQ ID NO: 54688 - DNA, 287 bp, Zea mays
  Clone ID: LIB3068-060-Q1-K1-C5
cggtccggaatacctcgcgcgaccctcgcgtgcagggacgcatacgaccatacattttaatatggtctgaaattacaggtcttagtgccgggtttgtctgaccgtgaggcggaaaatataactctctacgaggcctcagccgtcgtctacggacttcctaacgtcgacgtctgccgccacgtcccggttcgggaaatcttaacccgagctccctttccggtgacacgcgtgatcacgctatctgcctagattcccccgtcccttaagatcggctgacccatgtgcaa

SEQ ID NO: 54689 - DNA, 325 bp, Zea mays
  Clone ID: LIB3068-060-Q1-K1-D1
cccacgcgtccgcccacgcgtccgcgtcgtccctgcagccgcaagaaagctcttcttgcggggcacggccgcgtccaccatgaacgaggcatcggcgagctcgccggacgccgaggagaagaagacgacgactgtcttcgtggccggctcgacggggcgcaccggcaagctcgttgtggagaagctgctggctaagggattcggcgtcgtcgccggtacgacggacgtgagcagggcccgcggcagcctggcccaggaccccaaccttcagctcgtcaggggttacgttacggagggagtcgacaagctggtggaagccgtgcgc

SEQ ID NO: 54690 - DNA, 172 bp, Zea mays
  Clone ID: LIB3068-060-Q1-K1-D10
cccacgcgtccgctcacacgttttcattctccagctcagacacgtgcaccgaggcgcgtatctattagacgaaggccgggccatccaagccaacgtactcactaacagaacagcatagccactacagtatgccgatgattaccaacaccttaagcaccagcctacaaccccg

SEQ ID NO: 54691 - DNA, 420 bp, Zea mays
  unsure at all n locations
  Clone ID: LIB3068-060-Q1-K1-A4
gccgctcgtgccaattcctcggctgtttccttcgcagcctgcatctgctgtagcagagccaccggccaagaaggctaggaagaccaagaaggttgcaagtgttagtctcctggggttgatttgcgttgcaatgctttgtgggtgtttgattcctgcagtaaatcggatgtatgactctgttgatgctggagaaggtgctgcatacggtccatctcatcgtgggagggtgctggctgttgaggggcctcatgataatgtttcagatggtgtcgatccaaagccgccacagcgtgccagtgagacgcttncagcactgttgtatctaccaaagaatgggaagcatgtcaagattaatgggaatcttgttattaagtcgattgttgctagtgagatagcttcattgcaaatgtctggcaatga

SEQ ID NO: 54692 - DNA, 309 bp, Zea mays
  Clone ID: LIB3068-060-Q1-K1-D11
aaaaaaaaaaaaaataaaaaatttttataaaaaaaaaaaaaaaaaaaaaaaaaagaaaagataaattaaaaaaaaaaaaggaaaaaattaaaaaattattaaatttcaaaattttctttcttatttatccttctttccatttttttctattgttctttcctttttcaatttaattctttcattttttttaattttttcctcattttaatacctttgctttacttatttttttctcttttctgtttattcccttttggcctcttttctttttttcttacatgcctttatttttcctctttcccatttttt

SEQ ID NO: 54693 - DNA, 426 bp, Zea mays
  Clone ID: LIB3068-017-Q1-K1-F5
gctgatcgtcctgggcatcatcatcgcgctcatcctcatcatcatcctgtcggtgtgccagggcttcaagtgcggcagcaagtgaggagggggacttacagatggccgtgccctgccctgccctgccctggcacctgcgagaaggaggagactacatgtggagttttttttttttgcttctttagtcgtcgtgttaagtcgtcctgcgccgataattcttggtggtcaccagataagagtcattcctgatgtcggtgttgattgctgttgggttggtcgggaaatgactgggtgaaccggggggcgaagtgggaggggggttgtgtcgtgtaattttggatgccactattgtgcatgtatagccccgtgtgctgtgctaccctgatccgtgttgctactcctatgtcagtagatgttacgtactac

SEQ ID NO: 54694 - DNA, 366 bp, Zea mays
  Clone ID: LIB3068-017-Q1-K1-F6
ggatcttcctaagatcgagaaagaacttgaattggagattgccaaaagtgagctgactgagcttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattgtttttcttttggttttggtttcaagttgatcggtgctgtaagctacacctatgaatgctgctccttcctttctttgtaataaaaaaaactgcaccgaggtacacaaacacagtcaaccgttgagttgagttgaatttctct

SEQ ID NO: 54695 - DNA, 379 bp, Zea mays
  Clone ID: LIB3068-017-Q1-K1-F7
gatgtttcttggccccgtgcccagcgctcctaaacccaagcgccgccgcgagtgccatggggtgagcatcgacatgggcatggcatttacgcggctcttctagacggacttcttcaaccgcgaggctatcattctcgtcctcagactggacattgctggctagaccaccatactatatacactgcacatgggagaagtcctcttcacgatcccgacaattggattcaacgattatactgtgcagtacaacaacatcaaggctcaagtatgggatcttgaaggccaaacatgcattaagccatactggcagtgctactttccaaacactcaggctatcatatatcgttgatgatgcaagcgatacatataggcttgtaac

SEQ ID NO: 54696 - DNA, 420 bp, Zea mays
  Clone ID: LIB3068-017-Q1-K1-F9
aaaagaaaaaaaaaaaaaaaaaaaaaaaaaataaaaaaaaaaaaaaaaaaaaaaagagaaaaagaaaaaataaaaaaaaaaaaaaaaaaaaaaaaaaaaaaaaaaaaaaaaaaaaaaaaaaaaaaaaagggcaacctttttaaagaatcaaagtttacttactcagacatccaacttaaaagcttttatataggataactaaatttaaattcactggcacgattttaaaaacttcggaattgaaaaaaccttggctttaacaaacttaatggccttgaaaaaaatcccttttttgcaaattggctttttttccaaaaagcccaatacgaatggcctttccaaattttgccaaacccaaattggaaaaggaaaccccccttttagggcccattaaatcccggggtttttggggttaccccc

SEQ ID NO: 54697 - DNA, 66 bp, Zea mays
  Clone ID: LIB3068-017-Q1-K1-G1
gctaagcctctgccacaagacagcaacatgtctgaggaggaggccaagaacgtggaggtggaggtc

SEQ ID NO: 54698 - DNA, 442 bp, Zea mays
  Clone ID: LIB3068-017-Q1-K1-G10
gcgctgcgtggcgctgcgacgctgagaggacggcgcagcggcagcggcgggcacggccaggacgagagggcggagcacgcggggccggctctgtctcaggacgacctcgacttcgacttcaaccacgcgaggtccagggcggcgctggccaagggcgacgagatgttcgtcgcgatgccggacgggaagtggaagctccacacggtgtcggcggcgtcgaacaagcgcggcgagatcgtgctgcggatcaagaagacgaacctcgtcatggccttctcccacgcaaaagaaagcgtgatccacgacgtgcagccgtgctccccggagaagccgagcccccacgagggcgcgacatacccagtggaggtctccacgaacaagggcaaggtggagctccgcacggacgactacggcgtctacaagcggtgggttgcgacgctga

SEQ ID NO: 54699 - DNA, 441 bp, Zea mays
  unsure at all n locations
  Clone ID: LIB3068-017-Q1-K1-G11
gttggcttcaagttaactgggaagttacggagtggtgtcacggccactgatcttgttcttggagtaacacaaatgctaaggaaacatggtgttgttggcaaatttgttgaattctatggtgaaggtatgggtaagctgtctttagctgacagggccacaattgcgaacatgtcaccagaatatggagctaccatgggcttctttcctgtggaccatgtgacattggattaccttaaactgacaggccgcagtgatgaaactgtgtcaatgattgaagcatacctgcgagccaataaaatgtttgtggactacaatgagccttcaacagagagaatatactcatcttgagctgaaccttgatgaggtggagcctagcatgtctggcccanagaggcctcatgatcgtgtccctttgaaggaaatgaaatcagattggcatgc

SEQ ID NO: 54700 - DNA, 117 bp, Zea mays
  Clone ID: LIB3068-017-Q1-K1-G2
cctactcgtgggaaaaaaaaaaacaacatttcaaaataaaaaaaacaaaaaaaaaaaaaaagaaaaaacaaaaattaaaaaaaaaaaaaaaaaaaaaaaaacaaaacctataacaaa

SEQ ID NO: 54701 - DNA, 460 bp, Zea mays
  unsure at all n locations
  Clone ID: LIB3068-017-Q1-K1-G3
gaattctccgggtccgactccacgccgtcncgagccagggcatggttttggcgaagccaaaagcccactgagcacatggaatgaggatgcgtgccgcggtccggcatcgggcgatctgcgcccgagcgtgctgtgagtggtgcctgcatcctgctcactgctaactggtnngggcgtctgcgccgggcgcccgtgtaccataggtaggcgaacctggaacgcctggggccgtgccgtcgccgtccaaagcccgacgtctacnaagcgctgggccaaatccatccacttcgcgctcggcgactccatctggttcctgtacccgccgagccaggactcggtgctgcagctagcgccggcggccttcgcgtcctgcgacctgtcgcgccccgtggccaggctcgccgacggcaactccttattcaacctcaccgcgcccggccgcgcctactacgccagcggc

SEQ ID NO: 54702 - DNA, 432 bp, Zea mays
  unsure at all n locations
  Clone ID: LIB3068-017-Q1-K1-G4
cccacgcgtncgcccacgcgtncgcccacgcgtncgcgtcggttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggccggcgttctcaggaagataaggtcggctggtacgcacacttgacagaagaaatagagagcctttcaagttcatgg

SEQ ID NO: 54703 - DNA, 396 bp, Zea mays
  Clone ID: LIB3068-017-Q1-K1-G5
gtcctcagcgaggaggagaaggccgcggagaaagtgtacatcaagaaaatggaacaagaggggctggagaagctcgcacgcaagggccccagctcaggagagcaagcttcgtcgactacagtctctgcagcaagtgatgtgaaggctggggctgggccaacggagtcagcgtctgcaaacgtgtcaaccgacaagaacaggaactacgctgtcctggcaggcacaattgctgctctgagtggcctgggttggtatctattgtcaaagcctaagaagtcggaggaggttgtggactgaagagggggttacgaatgcgagctgtggatggttggccttatatttcaccatggtttactttctgcgcacgccttctggaaataaattgtgaaacatacg

SEQ ID NO: 54704 - DNA, 433 bp, Zea mays
  Clone ID: LIB3068-017-Q1-K1-G9
cccacgcgtccgcttgtttgtgtctgtgcatggcgcttggatgcgttggtccaggtccgggtatgtgaacaaagtgtcgtatgcagtatgcaaatgttcaggatccaggaaccacatataatggatgtaaatgttgggtttggtgccgtatgttgggtgtggagtatatttcttcgccaggtatttgctgtaatcctgtccctttactgttcgtgcactgcaatgagaataacataaaaatgagtgtcgttcaaaaaaaaactgagtcaatgattgaaacatacctgcgaaccaataaaaatgtttgtggactacaatgagcactacatcagagagaatatactcatattgagctgaaccttgatgaagtggagcctatcatgtctggcccaaagaggcctcatgatcgtgtcccttttaatgaaatgaaatc

SEQ ID NO: 54705 - DNA, 441 bp, Zea mays
  Clone ID: LIB3068-017-Q1-K1-H10
gcgattcctagggcctgagatcttcttcaacccagagatatataacaacgacttcaccaggcctttgcaagttgttattgacaagtgcatccaatcatctccaatcgacacaaggagggctctttataagaatattgtcctgtctggaggctcgactatgttcaaagatttccacaggaggttacagcgggacctaaagaagatagtggatgcacgggtccgtgcatctaatagccggcttattagtggggatgctaaggcccagcctatagaagtgaacgtggtcagtcatccaatccagagatatgcggtatggtttggtggctctgtgcttgcttcaactgccgaattctacgaggcttgccacacaaaggcagagtacgaggagtacggtgccagcatctgccgaacgaatcctgtcttcaaagggatgtactgact

SEQ ID NO: 54706 - DNA, 436 bp, Zea mays
  Clone ID: LIB3068-017-Q1-K1-H11
aatattttcaatccttttgcagttaatccaattaattttatgttgaatccggtagagagggcttctaagttagtagtacactctgtggctatttcactaaatttcttatgtgcttaagcttccgtcaaatccatggagtttttcttagtaagaccatattaaccttgtctatctatatcctctaagatcaacggtgttttcatacaagatttaccgatgtactgctaatgtcctatgccaatgaaatatgggaagcctgtagatatatggattttcattgctttgcagtcttttttgtgttttgtttctaatttttaaataggtcttgacctgccacctccaccttctaatatttaaataggtcatgacaatacacatgagtaagactataggatgatgacttggactactaatatttctgagatttatgtgagaa

SEQ ID NO: 54707 - DNA, 247 bp, Zea mays
  Clone ID: LIB3068-017-Q1-K1-F4
aaggacgacggtgcctggtttaggagtttagctatagacgaaagcacgtacggccgcgtgggtggggtagctacgcggcctggttgatcttgagcagttaagcgtgtacgaaacgacagctgtgtacgtgtgtactgtctgatggagtgtgagaagtactgtgtgtatttggtatggatccgatcggcctgatgtatgaaaaggatgtttacgtactatatatagatggaaaatcgtatttgcctcc

SEQ ID NO: 54708 - DNA, 198 bp, Zea mays
  Clone ID: LIB3068-017-Q1-K1-H2
acacttcacaccacacttactttttcgttcacctcttcacataacgaaaggggtatctctcaaaacacctgcgcgtccaaactcactcctcttctttcacatcaacaaaggtcatatcgtcacccatctccaactaccttcacccccttgccacctctaatgccaaatttaccaacaaagtatctattaacatagccc

SEQ ID NO: 54709 - DNA, 349 bp, Zea mays
  Clone ID: LIB3068-017-Q1-K1-H4
cggaagaaagaagaacctgtaaaggcattatcagatatgtggaaggattttgattcccgagttcgtcgatataaagttcttcctcctctttgtgctgagttacgcaacatggttatgcagccaatgattttgcctatggttctaacaatagcagaatctcaggataaaggggattttgaacttgcaacactgcctgcgcttgttccagtgtttacttcagcatcaggtgaaactctacttttgcttgtgaagcatgcagatctcatcattaacaaggccacacaggaacatttgatatcacatattcttccaatgctggttcgggcttatgatgacaatgatccccggt

SEQ ID NO: 54710 - DNA, 252 bp, Zea mays
  Clone ID: LIB3068-017-Q1-K1-H6
aaagaaaaaaaaaaaattaaaaaaaaaaatttaaaaaaaaaaaaaaaaaaaaaaaaaaaaagaaaaaaataaaaaaaaaaaaaaaaaaaaacaaccatatctttaattccaaacttacatactcttccttgcaacatcttacctttttttttttgtcccctaatttcaattcactgaccttattttcacaccgtcttctctcttaaaccccttccgttacccatcttactccccttccaacacttccccttt

SEQ ID NO: 54711 - DNA, 269 bp, Zea mays
  Clone ID: LIB3068-017-Q1-K1-C4
gcacacagctcgcacctaaagcagcgatctcttgatttttacaatccaacctaacgaccaggtcccgtaccattttcaaatatcactagagctaactaccttgacatatctatcttacaactcctaatttctaaaagatccataagacagactttcactgcttctattcccacttcaaatcaaaatcaaacgaacttttaccctcaagttccacactatatttctcttcctcttgatctcattttaccacaccttctttatcttttaac

SEQ ID NO: 54712 - DNA, 450 bp, Zea mays
  unsure at all n locations
  Clone ID: LIB3068-017-Q1-K1-C6
cccacgcgtccggggagcgccgccgctgcagttgccgccgccaccagagcagtccacctgggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatgccgcggggggtggtgccggcgccggcgatgtcatgggcctcctnctccgggagcgcatagtcttcctcggcaacgagatcgaggacttcctcgcggacgccgtcgtcagccagcttctnctncttgacgccatcgacccggactctgacatacgnctcttcgtcaactcaccagggggatccc

SEQ ID NO: 54713 - DNA, 153 bp, Zea mays
  Clone ID: LIB3068-017-Q1-K1-C8
taaaagaaaaaaaaaaaaaaaaaaaaaaaaattaaaaaaaaaaaaaaaaaaaaaaaaaaaatagaaaaaatataaaaaaaaaaaaaaaaaaaaaaaaaaaaaataaaaaaacaaacaaataaaaacaattatacaaaaattcaaaaaattcaa

SEQ ID NO: 54714 - DNA, 439 bp, Zea mays
  Clone ID: LIB3068-017-Q1-K1-D10
gttaattctttctgaagtttgttgttgaagtacaacatggtatttcgattgacattccaagctattgttagtgcttggaccaaatagttctgcattattcttgcgatgcttgtgccgttgataaaaaggagaacaaatgccgttgataaaaaggagaacaaactgttcctccaggttctgcttgcattttctccatcaaagaatatcaaaacatttgctgttgtattcccaggtattggtggaagcatgtttaaccaatccgcagacgcgaagagtccatctacctctgataatagaaatcaaaacgacatgcttcctccgaccaaagcggccgagaagccactaaacggtactgcgacagagcagcagcctcgcctacggacgcttgggtccctcacgacacggacgggcagcaccagtgacatcagaaagctcatga

SEQ ID NO: 54715 - DNA, 437 bp, Zea mays
  Clone ID: LIB3068-017-Q1-K1-D11
cccacgcgttcgcggacgcgtgggcaagcacaagcgctctctagcaatggctcgtgagggggtccgccctagcgacgcccagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctacactaagctgccgttcctccgccgtctgctgctgctcctcgccgcgtcgggcgtgttcaccgtcgacaagcagagcacggacgaggagcggtaccgcatcagccacgtgtcctacctactggtggacggcatccctcacgaggaccacatgaaccacaccgatctggtgctcacctgcacctcgacgcgctacatcg

SEQ ID NO: 54716 - DNA, 143 bp, Zea mays
  Clone ID: LIB3068-017-Q1-K1-D12
cagtcagactgtgttgtgttgtgctgtgtgggccgagtgtgcagtacagcatcaggccatgccccctgttccatctcatctgtgtgcgacttttgtttgtgctgtgtcatctatctatctaatccatctatgctatcctctat

SEQ ID NO: 54717 - DNA, 419 bp, Zea mays
  Clone ID: LIB3068-017-Q1-K1-D2
cccacgcgtccgggaggtgagccaccggaagcggagacgtgagtagtcgaccaaccccgtgggtccggcgactccggctgcggcgcggcgtgctagatcgctaccgaccatggtggtggaggagatcgccgagggggtgaaaaacctcaccgttaccggagatgcggcggcttcaggcggagaggggcagaggaggggcggcggcggcagcagcaaccgcatccaggtgtccaacaccaagaagcccctcttcttctacgtcaacctcgccaagaagtatatgcaacagcacgacgatgtagagctatccgctcttgggatggccatagcaacagttgtgaccgtggcagaaattctgaagaacaatggatttgccggtgaaaagaaaattaagacctctactggtgaaataaacgacg

SEQ ID NO: 54718 - DNA, 223 bp, Zea mays
  Clone ID: LIB3068-017-Q1-K1-D3
cacttacactcctttaaccataatcccccacaccctatcttcccaccactcaattctaaccaaccacaattaccaattatatcaatcaatccatcctctaatcctctgcttaattaccatctacactcaatcatcactatcctacaactaacctttctcacaactctctaatcccatatcacattccctatattttaacgaacaatccaacacttccttaatt

SEQ ID NO: 54719 - DNA, 438 bp, Zea mays
  Clone ID: LIB3068-017-Q1-K1-E10
tgacgctgtctggtggcggtgccggtgccgacggcctctctcacgcaacaaagcggcatggacggggtagcagctgatgtccgctgtccctcacctcgctccccaacggacggatgacggattggtgacattcttcttttccctcccagccaacggggaggctgtacattgtgtgctgtgcttggtgacaagctgagacctccggcgtattctttgattcgatcacccccctcgctcgccatcccattgtttacgtagagaagaggaaccgtggagctttccatcgcggattgtgaagccgctcttgtacacaggcttccattcaatgtgagaagcttcccccctccttgacagatctccgtgttgtagacctgtagccacctgtaagatatgtgatgatgtccaacaaacaactctgccagaccactggctagtcga

SEQ ID NO: 54720 - DNA, 442 bp, Zea mays
  Clone ID: LIB3068-017-Q1-K1-E11
gaatcgccttgtgtctcaggtgatctcatctctgactgcttccctgaggttcgatggtgcgctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccatgcgccaacagtggtgccgggtgccgacctcgccaaggtgcatcgtgcc

SEQ ID NO: 54721 - DNA, 399 bp, Zea mays
  Clone ID: LIB3068-017-Q1-K1-E3
ctgctccctctccgcttctctccactatcctaccaggcaccactcgcatcgtgtgctcagtgagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaatatcggaagagtgtggcccgcaagggcttcccattgatctcagaggtaaaagggcattcattgctggagttgctgatgataatggctatggatg

SEQ ID NO: 54722 - DNA, 319 bp, Zea mays
  unsure at all n locations
  Clone ID: LIB3068-017-Q1-K1-E4
cccacgcgtccgcccacgcgtccgggaggagggctttagcgatggtcctgttcatggctggcgccgggctgctcggcggggcttgccgggcccggcgcgcagcaaggcgtgtggagcatcatcacccgggccatgttccagagcatgctgagccaccgcggcgacagcgggtgccagggcgccttctacacctacgacgccttcatcgaggccgncagcaagttccccggcttcggcaccaccggcgacgagcagacgcgcangcgggagctcgccgncttcttcggccagacgtcccacgaaaccaccggtggatggg

SEQ ID NO: 54723 - DNA, 421 bp, Zea mays
  unsure at all n locations
  Clone ID: LIB3068-017-Q1-K1-E5
ctcactctccgctggtcgctcactcttgcagctccacccttcactcagtcttagtgctcttgttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaagccgaggctgctgctcctgctgatcccgaggagcttcccgcggccgagcagcaggcagccgccgaggcggaggccgcggctcctgctggtgccgaggagcccgtcgcggccgaaccggccgncgaggcggaggctgctgctcctgctggtcccgaggagactcctgcggtcga

SEQ ID NO: 54724 - DNA, 413 bp, Zea mays
  Clone ID: LIB3068-017-Q1-K1-E7
gggaaagaagggtggcaagaaaaagaccgtcgaccctttctctaagaaggattggtatgagatcaaggcaccgtcggtgttcagtgtgcgcaacatcgggaagactctcgtatccaggacacagggtaccaggattgcttctgagggtctgaagcacagagtctttgaggtttgcctagctgatcttcagggtgacgaggatcaagcttacaggaaaatcaggctccgtgctgaagatgtgcagggcaggaatgtgctcacaaacttttggggtatgaattttaccactgataaattgagatccctagtgaagaagtggcagacattaatcgaagcccatgttgatgtcaagacaaccgacaactacatgttgcgtttgttctgcatcggcttcaccaagaggcgcccaaacc

SEQ ID NO: 54725 - DNA, 441 bp, Zea mays
  Clone ID: LIB3068-017-Q1-K1-F10
acaccgtgtacgccaccgccgccgaccccaagaagggctcgctcggcaccatcgcgcccagcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcatcggcggctcctaccagcaggtcgcggaccaggactacgcctaatttattcaccacaccatcgtctccgctttggatgaatggattcaaacccatcgtcgtttgcttttgctcctcgccacgttcaattaatgcttgtgtatgcatgtatgtgccaatatgatgtgccgttgccctggtccattcatttcccttt

SEQ ID NO: 54726 - DNA, 266 bp, Zea mays
  Clone ID: LIB3068-017-Q1-K1-C2
acgcgtacgtcctgtcgttcgcacacgacattactcgcctcgttgatctcatcttaggacacctacattagctcttgcacatattccggccgagccaggctccccacctgacaatgtcttccgtccggatcggcccggctagtcctttccttgtaaccaaaacgacgctcggtgccccgcttgcgacccactgaataagtcccataccgttaaaagtagtgatatttcacttgcgcccttacgctcccacttatcctacacctctc

SEQ ID NO: 54727 - DNA, 393 bp, Zea mays
  unsure at all n locations
  Clone ID: LIB3068-017-Q1-K1-F2
cggacgcgtgggaccgcggcgacagcgggtgccagggctttctacacctacgacgccttcgtcnagggcgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggtggcgagagaccccgtggtagccttcaagacgggcatctggttctggatg

SEQ ID NO: 54728 - DNA, 207 bp, Zea mays
  unsure at all n locations
  Clone ID: LIB3068-017-Q1-K1-F3
accacgcgtccgaccacgcgtacgtccaatatcaagcgcctcccgacttcagcactcttaagtcancgtacactatcgccatggccgtgacatcgaccgccgtagtcgtgctatgcccgccgtccgtgtccggtcttctactggcaccggcttcaagacaagcgcgcgtgtcgttccactcggcgccatcgacagcacggctgtcca

SEQ ID NO: 54729 - DNA, 437 bp, Zea mays
  Clone ID: LIB3068-017-Q1-K1-A11
gcaactgcaaagcagcaagctctactcttcttctgtactgaacgtgtgactagagaacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaacaagtccggagacgacggctacgacagcgggtacaacagatcgggcaccaccaacgacgacgaata

SEQ ID NO: 54730 - DNA, 427 bp, Zea mays
  Clone ID: LIB3068-017-Q1-K1-A12
cccacgcgtccgcccacgcgtccggaaaaagtttcgagaaagctgtaacgcactatgtgtacaaacctaagagatccacattgaaactctatgatttcatgtgtggttctcttaggtttctacacatagtgtctcacaactttctccaaacattctaaattttttatcacagactctacatatgatatcatgacatgtggacaagtttcatgattttctaagtttgtttgtgttttataaattttttaaacagttgtatggcaagttcacggccatgttgagtgagcatggtgctcgaagtttccggtccgctcctgaaatcggtcgtaacttgtgctatgtagcatggatatcatttttgcattcacggttttccaagtttcgagtgacctgcaattcaaatctgaattttccgaagaaattcaaa

SEQ ID NO: 54731 - DNA, 372 bp, Zea mays
  Clone ID: LIB3068-017-Q1-K1-A2
gtgcctccggcggaaaatcggtatcgagctcgctttgttcgagtgagtaacgcgcagcgaggcctcgcccaaccagattttgatggatttcgggcacgcgtggcacagatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagc

SEQ ID NO: 54732 - DNA, 449 bp, Zea mays
  Clone ID: LIB3068-017-Q1-K1-A3
gctgtcctgcttaacctggcattgataaattatgggctagcctttctgagaaaacggggatgaaaccaatgcaaactccctttttcatgagaaaggaaactatggcaaaatgtgcccagttggcccagtttgatgaggagctttacaaagttacaggtgatggtgaagacaaatatctcatagctacatcagagcagcctttatgtgcttatcacttaggtgatagaatataccctgctgaacttccaatcaaatatgctgggtactccacatgcttccggaaggaagctggttcgcatggaagggacacagctggtatcttcagagtccaccagtttgaaaaaatcgaacaattctgcattacaagcccaaatgacaatgattcttgggagatgcatgaagagatgctaaaaaactcagaagattactataaggagaatgggctacca

SEQ ID NO: 54733 - DNA, 188 bp, Zea mays
  Clone ID: LIB3068-017-Q1-K1-A4
atttgtgtgcttgtcccatgtttgcctggggacgatgacgttttacaattttggcccccatcgcgcgcactcgtctgtttctctcatggaagccgtgtgaacctgtgcgtgtgtgtgacgaatgaacggaactttatatggaccagtgcttaagagtctttgcaacataattatgaaggtttgtttgc

SEQ ID NO: 54734 - DNA, 404 bp, Zea mays
  Clone ID: LIB3068-017-Q1-K1-A7
gcttgctgcaggatggcactcctgcttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtgcttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggctcgcgcctgctccggctcagcgagaaagactacttcgag

SEQ ID NO: 54735 - DNA, 361 bp, Zea mays
  unsure at all n locations
  Clone ID: LIB3068-017-Q1-K1-A8
caaacagagctccaactctaaaagcatccgtcccttggcagcagcaacaagctactagctatgtgtgtttagagcgagcgagggaaaaaagaaaacatctaagatatactccaacatcttcgtttgattaacccgcccagtaaagccatgggtactaattatagagcggtcatttctctagtactcctcgtgtgcatcgctagccgctcgtccttgggtgccgctgaaactgacgttgagcagaagcgctcgtcagtccctttgatgtttgtgttcggtgattcgctggtcgatgtcggaaacaataacttcctgccgncgactgcaccccgtgctgcatcttcgtacggcatcgactttc

SEQ ID NO: 54736 - DNA, 374 bp, Zea mays
  Clone ID: LIB3068-017-Q1-K1-B1
cctgaccatcctttgcctgctggtgtttcggatgaaccaaaatatctaggcagagacaccgagcctggtgggcactatctatattcaagtggttttcgtacatcggatgacacgattccttctgacagctatgcaagttatggcggctcccaggcacctggaagaggatatggggcttacagcgggtacagtgctcgctcctctaatagtgggttatctggtcatagttctcttcactatggaaagcgtcatggttattaggatttagattgcttgataaagcagctatctgatggacctgttattttcacctttgccacccctgctcccctcacgtactataaaaacagccaagacattgaagtttggagcct

SEQ ID NO: 54737 - DNA, 351 bp, Zea mays
  Clone ID: LIB3068-017-Q1-K1-B10
tgctccagccgccgtcggatcggatccgatccaaagcaagcagcagcagccgggtccgcctggcgcagcagccacaccccgtccgtcaccagaggaagaggaagaggaggatgtcggggtcgaaggtgtacacccttgaggaggtggccatgcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccggccgtgcaatgatggacgagtacctcgtcggtgagattgatg

SEQ ID NO: 54738 - DNA, 418 bp, Zea mays
  Clone ID: LIB3068-017-Q1-K1-B11
cccacgcgtccgcccacgcgtccgaggcactttcatctgtggcctctgcgttcgagatcgatctgagctggcaccgtcccacttcgccatggcggaagaccggagccccaagcccatccactgcaaagcggcggtgtgcagagccgccggcgagccactcaccatcgaggagatcgtcgtcgacccgccgaaagcgtacgagatccgcatccgggtcgtctgcacctcactatgccacaccgatatcaccttctggaaagctaaggaggcaccggagtatccaagaatactagggcatgaggcgtacggcgtagcggagagcgaggaggagcacgtggagggcttcgaggcgggggacaccgcggtgccgacgttcctggggcagtgcgagcgctgcgactactgcgcgtatgagcac

SEQ ID NO: 54739 - DNA, 223 bp, Zea mays
  Clone ID: LIB3068-017-Q1-K1-B12
cggactcgtgggtcgaaaaaaaaaaaaaaataaaaaaaaaaaaaaaaaaaaaaaaaaaaagggaaaaaaaaaaaaaaaaaaaaggaaaaaatatataaaaaaataaaaaaataataaaaaataaatgcgacgccatattttttatatctggtcaactaaatttaattaactgacagatgttttaaaacgtggtgactggaaacaaaatgactttacccatctt

SEQ ID NO: 54740 - DNA, 386 bp, Zea mays
  Clone ID: LIB3068-017-Q1-K1-B2
tcgcctgaccatcctttgcactgctgatgtttcattatgaactaaaatatctaggcagatacaccaggcctggtatgcactatctatattcaagtggttttcgtacatcggatgacacgattccttctgacagctatgcatgttatggcggctcccatgcacctgaaagaggatatggggcttacagcgggtacagagctcgctcctctaataatgagttatcttgtcatacttctcttcactatggaaagcgtcatggttattaggatctagattgcttgatatagcagctatcttatggacctgttattttcaacattgtcacccttgctactttaacgtactataaaaacatccaagactttgaagtttggagcctgcttata

SEQ ID NO: 54741 - DNA, 222 bp, Zea mays
  Clone ID: LIB3068-017-Q1-K1-B3
ggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtaccggcgtcaggaacctcaaaagcgccgccagcaccgccgc

SEQ ID NO: 54742 - DNA, 308 bp, Zea mays
  Clone ID: LIB3068-017-Q1-K1-B4
cccacgcgtccgcttaatccagtgcatctttgagccgccgccgccgtgaggagctccgccgatccggggtcatccgtcaaatcagttgatacgaagacattagaggatataatcggcccttcaacttcaatgaagtctcatacacatccagtgaagcctcgctttcaagtcagcaatcggcctaaatgcaatttgctaaataaaagttctattgattctgagcaaactatccaatcttctatagcctccaagataacaactttgattgacccgcggcaccggtatgaccacaaccttcactgctacta

SEQ ID NO: 54743 - DNA, 410 bp, Zea mays
  unsure at all n locations
  Clone ID: LIB3068-017-Q1-K1-B7
cccacgcgtccggagtcctacgagcagtcgcacgcaagtgtcaagagacgaaacggtcgagatggctcgcacgcaatctgccgtagcggtcgccgtggtggccgcggtgctgctgctggcagcggcggcgacgacctcggaggccggcatcacctgcgggcaggtgagctccgccatcgcgccctgcctctcctacgcccgcggcacggggtccggcccctccgcgtcctgctgtagcggcgtcaggaacctcaagagcgccgccagcaccgccgtcgacaggcgcgccgcctgcaactgcctcaagaacgccgccaggggcgtcagcggcctcaacgccggcaacgccgncagcatcccctccaagtgcggcgtcagcatcccctacaccatcagcaccttcaccgact

SEQ ID NO: 54744 - DNA, 444 bp, Zea mays
  Clone ID: LIB3068-017-Q1-K1-C11
ctcggtggtcgacgactctgggatggacgccgtccagaagcgcctcatgttcgaagacgagtgcattttggtggacgagcaggacaatgttgttggccatgagtcaaagtacaactgccatttgatggaaaagattgattctgagaatctgctacatagggcatttagtgtgttccttttcaactcaaaatatgagctgctacttcagcaaaggtccgcgacaaaggttacctttcctttagtttggaccaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagca

SEQ ID NO: 54745 - DNA, 451 bp, Zea mays
  Clone ID: LIB3068-017-Q1-K1-A1
cccacgcgtccgcggacgcgtgggtcaaggccggctcccagatcttcagcgagggcgggcgggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccagcaactaagctcaacggctatgctatgc

SEQ ID NO: 54746 - DNA, 274 bp, Zea mays
  Clone ID: LIB3068-017-Q1-K1-C12
cccacgcgtccgcggacgcgtgctctcgcacatacggactctaaccatggctcctgacggggggcatagtagctacaacaggctacgacaggcacattcagtcatatgagcattcatgccattatacatgaagcaattgacattgacgtgcgctttgcaaattgtgatggccaagactatgtaacagaagccccaatctaagctatcacgatctgctaagaatcagtactgaatgatggttgcagtaacttaactgtactccgctatctgctaa

SEQ ID NO: 54747 - DNA, 425 bp, Zea mays
  Clone ID: LIB3068-047-Q1-K1-B4
accggagcagcggcgctcgcgcgggcggagccatggcggacgacgattacaacgggatcgggatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgaaggagaaactgaccctcttgagattgcgatgaaagagcttagagcgcgcaagataccctttacgatcagacggtacctacctgatggaagttatgaagactggggagtagacgagctcattgtg

SEQ ID NO: 54748 - DNA, 423 bp, Zea mays
  Clone ID: LIB3068-047-Q1-K1-B5
ggtcgatatcccagtagacaaatatccaacattcaatttcgttggccgcatccttggtccaagaggaaattccttgaagcgggtggaggcaaatacggactgccgtgtgctaataagaggtcgtggcagcatcaaagatccagcacgggaggaaatgatgcgagggaagccaggatatgaacacctgaatgaacccctccatatattggttgaggcagagctacctgttgaaatcattgatgcgcgcctgatgcaagcccgcgagatccttgaagatctgctaaagcctgtggatgaatcccaggactacttcaagaagcagcagctacgggagctcgcaatgcttaatggcacccttcgtgaggaagggatgcagagatccggttcaacgtcccctttccacaacagccttgggatgaagag

SEQ ID NO: 54749 - DNA, 423 bp, Zea mays
  Clone ID: LIB3068-047-Q1-K1-B6
cacccgtgcctgtgtctcaccagcccactttccccagtactctactcacccacccactcacggactcatctactgagcagcgcggtgggcatccgagcgagagggcgagcgcggaaggatcggaattccgaaggttgggcatggaggcgagcggcgagaaggctgcggtggtgcgacggctgatggaagcgaaagaagtgttcgggaagaccttctcgggaatcgccgccgagacgggtctcaccaacgtctacgtggcgcagctgctgcggcgccaggcgcagctcaaggccgacacggtgcccgcgctgagggcggccctgcccacgctcacggacgacctcatcgaactcatgatgcagccgcccttacggtcctaccaccccaacatcgtccacgagcccgccatttacagattgaatg

SEQ ID NO: 54750 - DNA, 421 bp, Zea mays
  Clone ID: LIB3068-047-Q1-K1-B8
accggagcagcggcgctcgcgcgggcggagccatggcggacgacgattacaacgaaatcgacatgggctatgaggatgagccttcagaacctgagattgaggaaggggccgaagaagagcttgagaacaacgaagatgcccctgatgatgtcataggtggagagggtgaagataagggaccaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaggagcttagagcgcgcaagataccctttacgatcagacggtacctacctgatggaagttatgaagactggggagtagacgagctca

SEQ ID NO: 54751 - DNA, 323 bp, Zea mays
  Clone ID: LIB3068-047-Q1-K1-C10
cccacgcgtccgtccacgcgttcgcccacgcgtccgcccacgcgttcgctgacgacgggactggggctcacagatactggaagctaattgatcgatgtatagaattcaatctgacttgatcatattacctaggtgcatcctttggtatatgcttatatacgtcgaatcttgtagaggcttactttaaaatcattcaattgtataatgattttggcacatgaatcaatagaatatataaacatccaagctgactcaagggcaattgcaactttgatgctgataacaaatattcttactaacagtttttcatgctgggtaatatt

SEQ ID NO: 54752 - DNA, 164 bp, Zea mays
  Clone ID: LIB3068-047-Q1-K1-C11
ctgactcgtgggaaaaaaaaaaaattttaaaataaaaaaaaaaaaaaaaaaaaaaagggaataatttataaaaaaataaaaatattaaatacataaaaataataaattattaactattatataatttaacaatatattaaatttattatcctatctttttataa

SEQ ID NO: 54753 - DNA, 66 bp, Zea mays
  Clone ID: LIB3068-047-Q1-K1-C12
aaaaaaaaaaaaaaaaaaaaaaaaaaaaaaaaaaaaaaaaaaaaaaaaggacaaacgcgggtatgt

SEQ ID NO: 54754 - DNA, 383 bp, Zea mays
  Clone ID: LIB3068-047-Q1-K1-C7
gcaggatcacgctggcctgcgacgcggcggtcatggagtacgccatgtgtttgctcaggagaggagcctctgccgagctagagcaggcgttccttagcaccatggccatgtcatgccactgtgccagctacatggcgccgtatgttggacgagccaggcagcatcagatcgttgtttagttagttgctgttccgtgtatgtagacgtgtagtgtagagcgatgattttaactaggtgggtgctattcaaagccttctgatccagcaacccatcaaatgaggtgttgtaagtacaagagaataaagagacgtgattcttgctttgaaaaaaaaaaacttaactgaggaaaagctggaaaaaagtatatggacagtaagaatatt

SEQ ID NO: 54755 - DNA, 131 bp, Zea mays
  Clone ID: LIB3068-047-Q1-K1-C8
ggaggatcacgctgacactgagacgcttcggttatggaatacgacatgaggacacgggggatgagagcctatagctagcccgagcaagcctaacttaacaccatggacatgttatgccactgatccagcta

SEQ ID NO: 54756 - DNA, 284 bp, Zea mays
  Clone ID: LIB3068-047-Q1-K1-D1
ccacgcgtccgaaaaaaaaaaaaaaaaaattaaaaaaaaaaaaaaaaaaaaaaaaaaaaatgaaaaatataaaaaaattaacaaacataaaaattatttaaaaaattataaaaaaaatcacacctttctataaccataaagatatttaattatacaataaactgtattaaataaactaaaaaaattggttcacttttttaaattatactgttttgtacatctcttgtctatacttgatttttttttttattgactcttaaaacaattttttgactcggtttttt

SEQ ID NO: 54757 - DNA, 242 bp, Zea mays
  unsure at all n locations
  Clone ID: LIB3068-047-Q1-K1-D2
cggacgcgtccgcccacgcgtccgcacatacacatgcacaagcgcactctagcaatggctgatgaggttgtccgccctagcgacgccgagctactaaaggcacaagccgacatatggcggctcagcctctgctacctaacgcncctgtcactgaggtgcgccgtggagcttggcatccccacggcgatctaccgccatggcggggctgcctcagccgctgaagctgtcacggcgctgtctct

SEQ ID NO: 54758 - DNA, 421 bp, Zea mays
  Clone ID: LIB3068-047-Q1-K1-D4
ctgcgagctacagtccaacatcagcaagctgcagtactacatgaccaaggtacagccctagagatgctagctatagcacgacatgaacaagctacagcgccaccttaccagttgatagcccaacgttaccagctatacaggcccacatcaaccgcttacagccgcacatcgccgtcctacagtgcaacttgaccatgttataggcctacattaccttcatacagccgtacgtgccctttatacagccctacgtaccgctgatacagacctacctagcgctgctacagcccgacatgacctgcttacagcccgacattaccaggatacagcccaacgggaccgaactacagtcctacatctccgagctacaggcctacatttccgagctacaatccttcatcagtcaagtacaggcctttac

SEQ ID NO: 54759 - DNA, 290 bp, Zea mays
  Clone ID: LIB3068-047-Q1-K1-D7
cggacgcgtgggcggacgcgtgggaaaaaattaaagaagaaacaacaaaaaacgggagacgggaaaactgaaacaataggacagaaaacttggggcacctaacgccctaccgtgggtcgttgcgggtgtctagcataggctccccttgcttgcttggatcctgactttaaatgccttcactaatattcccgcacacggtagcttttaaccactggctgttcaaccaaacgcgatgaccaactgtgtgaatcaaccgttcctctcgtactaaggttaaaatgctactcgcg

SEQ ID NO: 54760 - DNA, 62 bp, Zea mays
  Clone ID: LIB3068-047-Q1-K1-D8
cccacgcgtccgtttttttttttttttttttttttttttatcggtctttttataggatcggg

SEQ ID NO: 54761 - DNA, 449 bp, Zea mays
  Clone ID: LIB3068-047-Q1-K1-E11
gagagaaacaatcaggggtccatccatttttgtcagccatgacgaacggctatctggtccgcgagtacatcggcgcgcagtccaccggcgtccagttctccgacgtgcccatcaacgccttcgttagcttccacttcatcctctccttcgccatcgactacacgcccgtggggcagcagccgaagccggtgccgaccaacggggtgttcagcccgttctgggacacgggcaacctgtcccccgccgccgtggccgctataaaggcctcgcaccctaacgtcgccgtcatggcggggctcggcggcgacagcgtgcaggacatcgtcaaggccttcttcaccccgacctccgtcgacacgtgggtggccaacgccgtgacgtcgctcacgggcatcattaacaggtacgggctggacggcgtggacgtggactacgagcacttcgccgac

SEQ ID NO: 54762 - DNA, 184 bp, Zea mays
  Clone ID: LIB3068-047-Q1-K1-E12
gtgagacacaatacgaggtccatgcattcgcttcagtcatgactaacggctatcgggtcctggagtacattgtcgcgcagtccatcatcttccagatctacgacgtgcccatcaacgcacttgttagcttacacttcatcctgtacttcgacatagactacacgctcatgtttcatcatctgaa

SEQ ID NO: 54763 - DNA, 375 bp, Zea mays
  Clone ID: LIB3068-047-Q1-K1-E4
cccacgcgtccgcttaagttgttgtcgtaaaaaaaaaaaaataaaaacctacaataaaaagtgacaaataacaaaataaaataaaaaacaaatacaataaaaataacctacaaaatcaactaccacatacaaataaagcaacaaacaacacaaaataaccaggcctgactctttaaaggtacccactttaaataacagtacctcacacttaaaaaccttcttaaaggtaatcattacaatattaatccctcaactattatacaacgtatggcttgtaaaaaccctgcattacccaaaattaaatctctaatagcaaatcccctttttgctgcctttaaaaaacccaaaaatcccccaccctatcgccttttcaaa

SEQ ID NO: 54764 - DNA, 277 bp, Zea mays
  Clone ID: LIB3068-047-Q1-K1-B12
tcgcgctgtcgaaccgtaagttcgtaattgtataatgcagccgcgttggcgacgcgttcggtgagggtatcgtgcacggtttcggcctgtacggcctgaaacgtgccggcgtcgtcctccttctgagaggcccggctgacgatgcgcaagacggtatgccaacgtcaagtcgtcagccgcgtcagggagcctacggtacggatgctaccgagtgctgtacctgggcccactgtgcggctagacgtctagctacctgacaggcgagtttcctttcgac

SEQ ID NO: 54765 - DNA, 415 bp, Zea mays
  unsure at all n locations
  Clone ID: LIB3068-047-Q1-K1-E7
cggacgcgtgggcggcaaccctcagaacctggtcatcgccgtgcagagcggcatctccttcggcggcttcgtcttcggcatcctcccggccacgctcgtcggctccgtagtcaacgccgccatcctgctcgccctctactggaaccagctggacggcggatgcaagcccgccgccggagcccaggaggtggtcgccgtgcccaccgaggtcgtcgaggaggaggacgtcacgtcgcaccgcttctcgcccggcaacatgtcgcaccttctncttcgacgcgcccagtcccagcaggtgccggccggctacgacgacgcggcgaatcaagaccccgtcaagccgcccaacggcgtccaccacagaaggaaagcagcggtgaacggcgattgcgacggcgacggcgaccgctactac

SEQ ID NO: 54766 - DNA, 284 bp, Zea mays
  Clone ID: LIB3068-047-Q1-K1-E8
cccacgcgtccgaaacatctgtggtttgtgtgtcatgaatcgtggttgtggcttcgttggtttaatggacctgttgtgtcctctgtgttgtacccaaaactcttctgcagcagtatggcttgaatccttgtgaagttacgatgtttgaacttaaaagtctgctcattatgttctttttctggttatatctcctaataactgcctgggatcaaatttgattcactggtgtttattggaccaataataacccgacaacatgtcgcacctactactacaacgcgcac

SEQ ID NO: 54767 - DNA, 406 bp, Zea mays
  Clone ID: LIB3068-046-Q1-K1-H11
tctaccgcagcctcagaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccctacccgccaccggggtacgtgcggaacccagtggccgtggccgagccggagtcgaccgctaaggtttgttgaaccttcggatttacacacgcacgtgccagatcgtttgttcaatctgtaggttttgcgcggatctgtggtttgcgcgtgcgtgatgtgggtattgcccgtgccttgaaagctaaccgagctgaggaagtgtatggatc

SEQ ID NO: 54768 - DNA, 331 bp, Zea mays
  Clone ID: LIB3068-046-Q1-K1-H3
cccacgcgtccggtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtaccccggcgtcgcgtccggcgcggatgcggtgtgcaccaag

SEQ ID NO: 54769 - DNA, 410 bp, Zea mays
  unsure at all n locations
  Clone ID: LIB3068-046-Q1-K1-H4
atccttctccctcctaggctccgtcggtctctctctttccttatccccggcccgtggcccgtgctgacggcgattagggttccgaatcgtgtttaagcgctgcgaaatcaccgctggggcttcgtcctcgagtcgtcgtcctgctggatgtcacctcgtgtcccgcgccgacgccagtgcccgtcctcggagccgcctctctccgacgatcgccggagacggatacggtcgaagccgtcactgcaggccgcgctcgtgcgccgtagcagatgtctagtagctccaacggccattatcctgctaatggtgcaaagattcttcatagaaaagaaaagaatatagagaaagtacagctcgacaaanattcagccacttgggtgtgccagaaggacaggcattatgttgaaaat

SEQ ID NO: 54770 - DNA, 440 bp, Zea mays
  Clone ID: LIB3068-046-Q1-K1-H5
cccgatcagcagctgatcgctcactcttgcagctcgatcattctttagctgctctagctgtagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggtccccgtggcggcggaggaagagacgccaaaagaagaagagacggcaaaggaagcggaaccggagccggagccggcggcggctgaaaaagtgaaagaggaagcggcagcgcccgctgccgagacagaagcag

SEQ ID NO: 54771 - DNA, 426 bp, Zea mays
  Clone ID: LIB3068-047-Q1-K1-A11
cccacgcgtccgcccacgcgtccgcagcatcggccactaccacctagctagcgaacgagaacgaccatggcgtcccaggccatcgagagccaccgtgcaggcgctgaggtcgtcaccggaggagacgcaatctgcaggaagaagtcaatcgagctgctggaggagctcggcctccccaagggcttcctgcctcttgaggacatccaggagttcgggtacaaccgcgtgacagggttcatgtggctggtgcaggggaagaaggtggagcacaccttcaaaaagatcaagcagactgtgtcgtacgccactgaggtgacggcattcgccgagaagggcaagctgaggaagatcaccggcgtgaagacataggagctgatgctctggctcagcgtcgtcgaggtctacgttcccgaggcctcaccagag

SEQ ID NO: 54772 - DNA, 315 bp, Zea mays
  unsure at all n locations
  Clone ID: LIB3068-047-Q1-K1-A2
cttgaagagatcgagcttcttttgcaccacaaggtcgaggatgtcttgcaactgcggatcaagctgcggctgcngctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggcccgccacggctgcagctgcggtggcaacttgcagtgcgacccctgcaactgctgatcacatcgatcgacgaccatggatatgattattatctatctaac

SEQ ID NO: 54773 - DNA, 374 bp, Zea mays
  unsure at all n locations
  Clone ID: LIB3068-047-Q1-K1-A3
cagaatatcgctttcgaggtgatgaaaaacggatatattgcaactgtcaccctcttccaatcatgagtgtgccactacatgtgctgctgctctgagctctggctgcaacaatggtggttaacctgcagaaaggaagtatgccgtacttttgtgcttcagcagcagcaatttcgagtcgaagccaactctatggggcctggtgacggtgcttggtttatggaatgggatgcagctgcgcagtcgatatggatcagcaccgtgacttgtatttgtgctgtacatnnccgccgttgtacatgaactaactgtaccctgtgacctcaccttgtgtacantaaatgtctttatttaatgggaaaaaanaaaaannanaa

SEQ ID NO: 54774 - DNA, 171 bp, Zea mays
  Clone ID: LIB3068-047-Q1-K1-A4
agaagatggaattaagtttgggaaaaggcggcccaaacagaggctccttttcgacgccgtggacgaagcgctcatcgagcttgcttcgatggcggaactggctgcgtacccctggggtagatcatgctcttcggagcacggggattgcaagaacggttccagcagtaattc

SEQ ID NO: 54775 - DNA, 357 bp, Zea mays
  Clone ID: LIB3068-047-Q1-K1-A5
caaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccactttcacaagacctccgaccgcgagtggttcgagaccgacgcggtgctc

SEQ ID NO: 54776 - DNA, 405 bp, Zea mays
  Clone ID: LIB3068-047-Q1-K1-A6
actgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgggcttcgcaagctgcctttgaccaaggctaagcgataccttgaggatgttattgctcacaagcaggcaattcccttccggagatacttgggaagtgttggtcggacctgacaagcaaagtctcgccactccaatgggcaaggtcgctggcctgttaagtcagccaggttcatattggatttgctgaaaaatgctgagagtaacgctgatgtgaaaggcttggacgtggacaacctctatgtttcacacattca

SEQ ID NO: 54777 - DNA, 228 bp, Zea mays
  Clone ID: LIB3068-047-Q1-K1-A7
cggacgcgtgggcggacgcgtgggcggacgtttgtgcttgagcgccgttcatcggaatcggtcctactagccagtcgactctatctgatcggccaatgccatgcaccaggctctatatgtgcagtataataactcaagttatactgctcttgcaattcgtacgatgcattccaccaattctaaaccatactttaacgctgttattgtcacatcgcctacagttccctt

SEQ ID NO: 54778 - DNA, 419 bp, Zea mays
  Clone ID: LIB3068-047-Q1-K1-A8
cccacgcgtccgagcgatcccactcccgatcagcagctgatcgctcactcttgcagctcgagcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggctgaag

SEQ ID NO: 54779 - DNA, 228 bp, Zea mays
  Clone ID: LIB3068-047-Q1-K1-A9
acgccgcgaatcacagacgcgtctatgtcagcttgctgcgctgtactaccctgccctgggatcatatggcacgtgagcccggacgagcgagagcgagggagaggcatggctgctccgaagctcgcgacgctggcgctggccgtgctcctggcggagaccgtgttggctcccccagcacgcggagcgcgcggccatgtcgtgttccaccgcgtacagcacgctgatgcc

SEQ ID NO: 54780 - DNA, 214 bp, Zea mays
  Clone ID: LIB3068-047-Q1-K1-B1
cggacgcgtgggcggacgcgtgggcggactcttgggaaaaaaaaaaaaaaaaaaaaaaaaagaaaaagaaaaaaaaaaaaaatgaaaaaaatatatataaatacaaaacttacgtaaacttatattaaaaattatataatattatatatacataactaaaatgaaaaaaaatggtggtagttttaaaatttccaagcttattaaaacccttttt

SEQ ID NO: 54781 - DNA, 341 bp, Zea mays
  Clone ID: LIB3068-047-Q1-K1-B10
cccacgcgtccgcggacgcgtgggttggattattgtaaggggattttttctttttctattttggtgctcgaaaagatcccacgttttttttactgatataaagacaagctaggagaggatcatgatgaggaagagagagagtgaaaggagtgggagactgggcatctccccccaccattcttggcgagatcctcatcgatgttactggttggtttcaaataacatcctgtaataaaatttcttctccaaaaaaaaagacaaaaaaaaaaacaaatacagatagaacaacaaaaaagataaaaaaaaacccagagacaaatagacaataaacaggaacttga

SEQ ID NO: 54782 - DNA, 455 bp, Zea mays
  Clone ID: LIB3068-046-Q1-K1-H10
cgctcctcctggtgatcccgcaccgtgctgtgtccgctccatcttcctccgccaccatgctgatcgccggtgcgagggcatgtctacctacccgaggacctacgatctcatccatgcggactcggtattcaccctgtacaggaacagggagaagatcctcctggttgtcaagacgtattggactacccatgaggccatgaccaagatcagtagcaggactgtcaagtaaaattctcaatgttgataagcatttttcatgtttggatttgtaccaccgtttctagctccttgagctagtgatctcttgacggtttgtgcttgctgttctttctggacagtacttgctcggataggaaatttaacatgtgggggaaggaagggtaggtagtaagacccctggcccctgcaaagttttcttcaattccgaattgtgtccaaatggtaaatagaagtca

SEQ ID NO: 54783 - DNA, 457 bp, Zea mays
  Clone ID: LIB3068-047-Q1-K1-B11
cgctgtcgaacctccagttcctcagcgcctcccacaccaacgtgtccggcgccatcccggagtcgctggcgcggctgcgcggcctcgactccgtggacctctccagcaaccggctgacgggcggcatcccggcggcgttcgccgacctgcccagcctccggtcgctggacctgcggcacaaccagctgacgggccccatcccggcggggctggtgcaggggcagttccggtcgctggtcctgtcctacaaccagctcacgggccccatcccgcgcgacgacgcgcgcgacgagatcaacaccgtcgacctctcccacaacaggctcaccggcgacgcctaccacctgttcgtcgccggccggcccatcggcaaggtagacctgtcgtggaactacctcaacttcgacctcagcaggctggtgttcccgccggagctcacgtacctggacctgtccca

SEQ ID NO: 54784 - DNA, 351 bp, Zea mays
  Clone ID: LIB3068-046-Q1-K1-E1
gtggagaccttttctgaatatcctcctcttggtcgctttgctgtccgtgacatgaggcaaacggtggctgtcggagtcatcaagagtgtggagaagaaggatccaactggagccaaggtgaccaaggctgccgcaaagaagaaatgatgtgtctggctggttctgtgtttgcttgagggaaacctagtggaaacataaaatatctcgtcttgttcacgtcattgtctgaactatgctcgcaacgtttgcctggtcgatttagaatggttattttcgttaaaaccagagtgttatttaagacttatccgaacatctggtgagccatatatggttactagttttgttactacc

SEQ ID NO: 54785 - DNA, 243 bp, Zea mays
  Clone ID: LIB3068-046-Q1-K1-E10
cggacgcgtgggttcctgcaggatggcactcctccttggcttgctgctgctagtagtagcttgggccgcgatcgctgatgaacgactccggtatctactaccagctggctcttatgtggccaggagcatactgcgagcagaccagcgctgggtgctgcaagccgaccaccggcgtctcggcggcgcgcgacttctacataacgggcttcaccgtccttaacgcgaccaccgacgctgcagtga

SEQ ID NO: 54786 - DNA, 366 bp, Zea mays
  Clone ID: LIB3068-046-Q1-K1-E2
ggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattttttttcttttggttttggtttcaagttgatcggtgctgtaagctacacctatgaatgctgctccttcctttttttgtaataaaaaaaactgcaccgaggtacacaaacacagtcaacccgtgaattgaagtgaatttcttt

SEQ ID NO: 54787 - DNA, 446 bp, Zea mays
  Clone ID: LIB3068-046-Q1-K1-E3
cccacgcgtccgcccacgcgtccgggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccgggtagtgaaggaccagagaagctttctagttatgaatcgggtatagaacccatgggggggggctgggtacaattccgaatacgctattacatgtttgcgcctagttttggtggttttgatggg

SEQ ID NO: 54788 - DNA, 267 bp, Zea mays
  Clone ID: LIB3068-046-Q1-K1-E7
ggcgaggtcatggcctccggcaccggctccggccagccgcaacccgcagcagctgatgctgacccgggagccggcgacaacaagctcgtcttcgagacgccgctgcagccgcagcccgtgagggaggactacgtcgagaacgccgtcaagttcctgtcccacccaaaggtcaggggctcccccgtcgtctacagacgatccttcctcgagaagaagggcctgaccacacaggagatcgacgaggccctacggagagtcctgatcctg

SEQ ID NO: 54789 - DNA, 454 bp, Zea mays
  Clone ID: LIB3068-046-Q1-K1-E8
gtcgctgcatctggccgctcgaagcgggaacctggactgcatccggaaactgctcgcctggggcgcggatcgtctccagagggactcagcagggaggattccttacgccgtggcgctgaagcgcaaccacggggcgtgcgcggcgctgctgaacccgtcagcggcggagcccatggtgtggccttccccgctcaagttcatcagcgagctggacccggaggcgaaggctctactggaagcggcactgatggacgccaatagggagagggaggagaagatcctcaagggcatcaccaagtatccgcaggcatcgcctacttcgccttgcgagcacgatgccattgacgaagcgtcctcggaggccagcgacgcggagctgtgctgcatctgcttcgagcatgcgttcagcatcgacgtgcatgactgcaggcaccaaatgtgcgcggcgtgcacg

SEQ ID NO: 54790 - DNA, 170 bp, Zea mays
  unsure at all n locations
  Clone ID: LIB3068-046-Q1-K1-E9
agatatgccanacttcacacccctgaactatcttttgctatgacgtggatctacccttctcggtgccattgccttctaattattttgaactttccgatagggagcaaactacacttcttccacttaatcgggctgcaacataagcaccttttacctagttctgacactga

SEQ ID NO: 54791 - DNA, 404 bp, Zea mays
  Clone ID: LIB3068-046-Q1-K1-F1
ctccttgtgagtctgagctgaagaggaggaggatgaggacgagaagcagcagcgcaaccggatgagggagagcgaagatgcgccgcgtcgcgctgttgctcgtcgccgccgagtgcgcgctggcggcgccggatgacgcggtcgtcactgacgggcttctcccgaacggcaacttcgaggatggcccgcccaagtcggcgctggtgaacggcacggtggtgtccggcgcccacgccatcccgcggtgggagacgtccggcttcgtggagtacatcgagtcggggcacatgcagggggacatgctgctggtggtgccgcacggcgcgcacgcagtgcggctgagcaacgaggcgtcgatccggcagagcctggccgaggcgcgcggcgcctactacggcatcacg

SEQ ID NO: 54792 - DNA, 406 bp, Zea mays
  unsure at all n locations
  Clone ID: LIB3068-046-Q1-K1-F11
cagcaccagctaagcctttccaacaggacagcaccatggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgngaagagaatgagaaggacaaagctgagaacaaggctgctaagaaagtatccgctattctttcatgggaaaacacaaagaaagcaaa

SEQ ID NO: 54793 - DNA, 211 bp, Zea mays
  Clone ID: LIB3068-046-Q1-K1-F7
ggttccctactaaatttcactcatcatatttgtagcccacacgatttatatcgggtcaaggcaaagcttataggcatccgtgtcccaacgccctcgacctattctcaaactctaaataggtttgacggctcacttgcttcagtgagccgtgccaaccaatctgcagctccaaaatcgccatttcttacaagcacatctggctattcattat

SEQ ID NO: 54794 - DNA, 241 bp, Zea mays
  Clone ID: LIB3068-046-Q1-K1-G1
ttctacgagaggatatagagatttagaacagctcgttcgagaccatgaataggatcccacacctggtgctgatcctgtacctccaggccgctctggtcatgggcatcttcgccgctttggctaaagaaaatgccctggttgagagcaaggccatcgacatcaacccgtggcagctcaagtcctgcaccaactgcaactttttcttttcgggcttctacacctgcaactactttaaaaagac

SEQ ID NO: 54795 - DNA, 347 bp, Zea mays
  Clone ID: LIB3068-046-Q1-K1-G3
ttcactctgtgcgctcctcggcgcgtgcccacgtctcccacgcctccctccctgcattcgccccttcagatccggtctgccccgccgccgccgatgtccgaaggtcccgtgggatcccgccgctggcggtgcgacctcggcggcgacgagcgctggctctcgggggccgctggcgacgaccaattcgaccgcctcccggacgcgctcctcctcgtcatcttcaaccgcatcggcgacgtcaaggcgctcggccgctgctccctcgtctcccgccgcttccacgagctcgtgccccttgtctactccgtcctcgtccgcgtcgactgcgttatccccgacgagccccc

SEQ ID NO: 54796 - DNA, 332 bp, Zea mays
  Clone ID: LIB3068-046-Q1-K1-G5
gcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttcttcttctcggggctctacacctgcgacgacgtcaaaaaggactgcgaccccgtctgcaagaagtgcctcgtcgccgtgcacgccttctacttgggcaacaaccagttcaagtgcaccgacaactttcttg

SEQ ID NO: 54797 - DNA, 449 bp, Zea mays
  Clone ID: LIB3068-046-Q1-K1-G7
aacgcgctcccggtccgaaaggcaaaccagccaccagtcccaccaccaccctctgtcttcgcctccgctgccgattcgaaagcacccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctacgccttcttcgtcttcatgtctgaattcaggcaggagtatcaggcgctgcaccctggcaacaagagcgttgcgaccgtgagcaaggcagcaagggaaaagtggcgtgctatgtcagatcaagagaagcaaccatatgtggaccaagctgggcagaagaagcaggactatgagaagactaaggcgaactttgattagaaggagagcacaagctc

SEQ ID NO: 54798 - DNA, 168 bp, Zea mays
  Clone ID: LIB3068-046-Q1-K1-G8
aattctatcaaaggatataaagtttaccatcatctagtccgacaacatgaatggcatttgacatcttgtgccgatcctaaaccactagtcctctctcatcatagaactctatctatcatcaccataaagaacatgccttacaccataaacaaggactagaccaaactc

SEQ ID NO: 54799 - DNA, 451 bp, Zea mays
  Clone ID: LIB3068-046-Q1-K1-G9
ctcgcctcttgttttctcccgagccccatccttccctcccggtctctccttgcgagctagtaccctacttgctccacagtgccacaccgctcgcgctggagtatgggttcgagcccgatgtggtggtcaggaccaccaccgtcgccgtggagccgcggtttagggaaatggtgggcgctggtagggccattcgtggtgaaggccgtcgggttcctgctgctcgcgggcctcttgttccgggtgctctggtcctttccgtcctctccggcgccggcgttgcagatcacaaaaggaaaatgcagtcttttcaatggggaatggataccaaacccctctggtccagcctatacaaatgcaagctgtcgatttattgacgatcaccagaactgcatgatgaatggtagacctgataaggaatatctacattggaagtggaaaccttatggatgtg

SEQ ID NO: 54800 - DNA, 423 bp, Zea mays
  unsure at all n locations
  Clone ID: LIB3068-046-Q1-K1-D9
ctgagttctctgttgccgggccaatcttcggtgttcgggccattgcaaaaacctggggaccgaaactggatgctgaggcctatgcttgcagcaacatggttgagcaggtgctgccgtttggtggcttgctcatctatcagagcttcactgttacggccgaaacgacccatgggtcgccgaggtcagtcctgcatgacttcgctggtgacattgtcaagaatcgctcagagagtgatgctccctgngaagctgatgctgtggatgagagcgaggaaagagatgtaaagaagatgaaatgctgatgtggtcgacgatagatcagattcagagttgctgccactggttatcttgtgaagcagccaagcctaattatttatgccacataacctgtgctattgtaatatgtcacatgcttatatttgc

SEQ ID NO: 54801 - DNA, 415 bp, Zea mays
  Clone ID: LIB3068-013-Q1-K1-D2
cccacgcgtccgcccacgcgtccgccctccagaacttcaggtggttttgatctctgcagctcgtcctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggct

SEQ ID NO: 54802 - DNA, 423 bp, Zea mays
  Clone ID: LIB3068-013-Q1-K1-D3
gtcaccgtcatcatcatgaacaagtggatcttccagaaactggatttcaagttccctcgcaccgtgtcctgcgtccacttcatctgctcttccattggagcttacattgcaatccatgtcctcaaggcgaaacccctgattcaagttgaaccggaggaccgctggaaaaggatatttccaatgtccttcgtcttctgcataaacattgtgctgggaaatgtcagcttgcgctacatcccagtctccttcatgcagacaatcaaatctttcactcctgcaaccacagttattctgcagtggctagtctggagcaagcatttcgagtggcgcatatgggcttcgctggtccctatagttggcggaatactcctgacttcggtgacagagcttagcttcaacattttcggtttctgtgctgccatg

SEQ ID NO: 54803 - DNA, 415 bp, Zea mays
  unsure at all n locations
  Clone ID: LIB3068-013-Q1-K1-D4
acgaaacggtcgacatggctcgcacgcaatctgccgtagcggtcgccgtggtggccggggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgncagcatcccctccaagtgcggcgtcagcatcccctacaccatcagcaccttcaccgactgctccagggtgaactaaaacctagaccacgcgcgacgacngnccgctgatcg

SEQ ID NO: 54804 - DNA, 426 bp, Zea mays
  unsure at all n locations
  Clone ID: LIB3068-013-Q1-K1-D5
ccctctccgccttgactcactcacttgaccactcttcttcctcctcatcaatccggtcgccagcacttgttcggaagaaaaagaaggtagaacacgctaacaagacaacaaggatcatggggcgcgggcgcggccacctcctgctgccggcagcagccgcctgcctgtgggcgctgtcgtgcgcgctgctgctgcacgcgtcccctcacggcgccggcgccggcggcctgctgagggtcgggctcagcaggcgccgcggcgggctcgaccagcgcgcgctggcggcggccaaggccgcgaggcagcaggaggcaagccgtctcggagcctccggcggcggcgacgtccctctcgtcgactacctcaacacccagtactatggggtcgtcggcatcggcacaccgncgcagaacttcaccgtcatct

SEQ ID NO: 54805 - DNA, 318 bp, Zea mays
  Clone ID: LIB3068-013-Q1-K1-D6
cggacgcgtgggaaaaaaaaacaataaaaaaaaaaaaaaaaaaaaaaaaaaaaaaggtgggaataataaaaaaaagaggaaaaaaactgaaaagcaatcttaaactacaaccaggataaactaagccatggcgccctttctttcttcctgcctttgcacgtcgttctctctatacgctttcttctgcactggtgctataaacctaaataatggggccagtatcttcaaatccagtcacgctaaatcccattgcgttactaactttactaggggagtgcgcgctctcaatttccgtaacgccgacttcatcatatgcaa

SEQ ID NO: 54806 - DNA, 426 bp, Zea mays
  unsure at all n locations
  Clone ID: LIB3068-013-Q1-K1-D7
ctggcgttcgacaagatggggagctacggcaacaacggcggcggtaataccaacgacgacagcaacggcgtggaggtgaagagctacttcaacaagtccgccgggagggcggcgagcaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcgtgctatnccgccgggacttgccctcttcctctacaactac

SEQ ID NO: 54807 - DNA, 345 bp, Zea mays
  Clone ID: LIB3068-013-Q1-K1-D8
cacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaaagacaagtactacatata

SEQ ID NO: 54808 - DNA, 280 bp, Zea mays
  Clone ID: LIB3068-013-Q1-K1-D9
cccactcgtcctcgtctacttcgtttttttacctctcacatatgctaatatcacggtcagcgctacttccaccatcgagaatcataactaaacactctctactaacatcgctcatcacacacactgtacacacatacttatttactccatcaccacgtcaatgatcatccattatattatatactctgttaccttcatctcaaccatttccaatcctgctctataagaacattcaaattccatctaaacaaactacgatcttttctagatcttccctcac

SEQ ID NO: 54809 - DNA, 342 bp, Zea mays
  Clone ID: LIB3068-013-Q1-K1-E1
gcttgcttgattgctccaggtacctccattcgcagtcggccgtgtcctcggagccgcggtagatggcggatcaggagaccgtagctgtggttgaggcacctaccccggttcttggggaaccgatggacctgatgactgccctgcagctcgtcatgaagaagtcaggtgctcatgatggccttgtgaagggtcttcgtgaggctgccaaagccatcgagaagcatgccgctcagctctgcgtgcttgccgaggactgctactagcctgattatgtcaagctggtgtaggctctttgcgctgaacacaatgtccatttgtttactgtgtctagttccaatactt

SEQ ID NO: 54810 - DNA, 263 bp, Zea mays
  Clone ID: LIB3068-013-Q1-K1-E10
cggacgcgtgggcgcgaatcacagacgcgtctatctcagcttgctgcgctgcacgacccgtccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgaagtcgtgttccaccgcgtacagtacgctgataccgtgcctgctgatcgcacagattggcggg

SEQ ID NO: 54811 - DNA, 414 bp, Zea mays
  Clone ID: LIB3068-013-Q1-K1-E12
attcccgacccgacccacccttcccacgacccttcatcccacccctctttttcttactatcctcgaccattctcacacaaggcgatgtcttcccaaaactctgaatgtcaaattcaataaattcaaccaaactcaataaacttctcaattaactattactctcttaacatacccaaattccatttcatttaattattgactcccataaatgacttaactacattacaactatacttctatactatacatccaaaccacatccacattaactaacttaacccaatcactcatcaaataataccctaataatctttactctataccaacttttctaaattacttcatacttttattataatttacatcctccaaccacatttcaaataccactacttttaacgttattttacttat

SEQ ID NO: 54812 - DNA, 379 bp, Zea mays
  unsure at all n locations
  Clone ID: LIB3068-013-Q1-K1-E2
gcagaccacaacaagaagaagcgtagtcgtcgccggaaggaaaggcgcggagcaagatgtcggggcaggcgtacgtcgaggagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaaaggcactgggggcattactatcaagaaaaccggcatgtccttgattatnggtgtctacgacga

SEQ ID NO: 54813 - DNA, 360 bp, Zea mays
  Clone ID: LIB3068-013-Q1-K1-E4
cgggcgcgtggcgaaatttccatttataagaccttctcgattgtgcccaatatttgatgtcgggtaattcctacggcctggggggaaaaaagggcattaacttattatagagattgagcgatttgactatttttttttttaaccgtacctatatctcattcttacaaaacttacacagggttcagcctagagagaacagctgttatcataggagactctgactagcctaaggctatgggaactactggtcttttctgtggaggatcctagttcgttgtgatccaaggtgtacctgtagttgatatactaagaaagataggcgctgcgggcattactatcgataagaccgccatgtacttg

SEQ ID NO: 54814 - DNA, 414 bp, Zea mays
  Clone ID: LIB3068-013-Q1-K1-E6
cggacgcgtgggcggacgcgtgggcggacgcgtgggtggaaaataaactgagtgaatggcgagttttcgtattcctgcagtacaggtacagccacaacggctcgggaattccatggctctattggattggatggaaaaattccttttcatctaagtggaaggatcctgtatttttttactaggaattctgctccctcgaaaagtttttctttggggaaaaccaaaataaaaagagaatggaagaattcttcttattccataagaaaataaaggaaccctagaattccatttgcataaggtacattacgccatacaatctaaatataaaaggggtatggggcaattaatgactttgaaaacgcgaaatagctgatgagggaagttgctgttgagaaataggaaagtggaatgaaa

SEQ ID NO: 54815 - DNA, 328 bp, Zea mays
  Clone ID: LIB3068-013-Q1-K1-E7
cccacgcgtccgcccacgcgtcctcggactcgtgggaaaaaaaaaaaaaaaaaagaaaggaaaaaaaaaaaaaaaaaaaaaaaaaaaaaaaaaaaaaaaaaaataaaaaaaaaaaaaaaaaataaaaaaaaaaaaaaaaaaaaaacataaaattttaaatttcaaaaattttaattaaattaaattgaaaatttttttttttttttaagttttcttaaattaaattaattaactttatgttttaaaacttttttaatttaaaaaaccttttttttccccaatttaattacttttaaatttataaactttttgttacctcatattttat

SEQ ID NO: 54816 - DNA, 291 bp, Zea mays
  Clone ID: LIB3068-013-Q1-K1-E8
aaaaaaaaaaaaaaaaaaaaaaataaaataaaaaaaaaaaaaaaaaaaaaaaaaagaaaagaaaaaaaaaaaaaaaagaaaaaaaaaaaaaaaaaaaaaaaaaaaaaaaaaaaaaaaaaaaaaaaaaaagggcgccctttttaaaaaatcaaaatttaattccccttcttttcaaatcaaaattttttttatggggcccccaaaattaaattaattgcccgttttttaaaaacttcataattggaaaaacctttgatttaccaaatttaattacttttgaaaaaatcccct

SEQ ID NO: 54817 - DNA, 423 bp, Zea mays
  Clone ID: LIB3068-013-Q1-K1-D12
cccacgcgtccgattttttctgttaagatgagtcatttgtatgcactgtggcatatattgtaaaattcttgtttcttaataaattgcagccctttgttgtgttcttggccagcttagttgatttgtagttaagcttcttcacccttagttgtgtttatgctctgcttagttgatccattactgcaggtcttggctgaacttccagctccagttctaaatggtacaatgcttacagtcgaagatttgcatcaggaactaaaatgcagtatcaacatcaaacacagggatgagttcgatgaagaaaaggagcctgacagaatggttcttgttgggtggtctggcccagttgataagcaaaccactaataatggtgagactaaatcagttccatcttcatccaatacagaagatgtggatggtact

SEQ ID NO: 54818 - DNA, 244 bp, Zea mays
  Clone ID: LIB3068-013-Q1-K1-E9
tcccgacccaagccacccctcccctgccaacccatctacttcatacatttctcattaccaatcataacattacatctatgagggcttactccatcttacagtcagcacctaccatcttatcttcatctgacctactatccttactactatatttacactgtataacataaaaactatcctacaaaataaatttcaaaatctctacactatcgtttaattcatcacttttcaaatactctctttc

SEQ ID NO: 54819 - DNA, 426 bp, Zea mays
  Clone ID: LIB3068-013-Q1-K1-A9
cccacgcgtccgcccacgcgtacgtttgtagcctccatgctgatgtttgcgacgggcgctgggattctcatggcactcttcttgaacactgctggcggcgcctgggataatgcaaagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccagaccactcatcaagcttgctattaaccctgcggagatgtacctatgcgaccaggtagatgaggtgtgtgtgtgtgtgcgttacctgcatgtgatgatgtaacggtccaatcggtttgtgtcacgacatgct

SEQ ID NO: 54820 - DNA, 429 bp, Zea mays
  Clone ID: LIB3068-013-Q1-K1-B1
cgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttggttttgccaacaagc

SEQ ID NO: 54821 - DNA, 323 bp, Zea mays
  Clone ID: LIB3068-013-Q1-K1-B10
cccacgcgtccgcccacgcgtccgcccactcgtccgcccacgcgtccgaaaaaaagaagggaaaaaaaaaaaaaaaaaaaaaaaaaaaaaagacaaacaatataaaaaaatccagccttacctcttagtgcatccaacctcatatctcttttattgcgacaccttaattcttttcactggccacctatttacaacttactgactgggaaatcccatcctttacccaactaaatccctttgcttcccatcctcatttccccagctgcccttctacctttcagcccctgacctatctcccttcacatcagttccgctcccttttt

SEQ ID NO: 54822 - DNA, 401 bp, Zea mays
  Clone ID: LIB3068-013-Q1-K1-B11
gttggcttctcctccccctgcggttcgggttcgggttcgtgaggttctccggagggcgggttaccgggtgagcggatcgagatggctgcgtccgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacagaggacgcgatgcagaacgccatcgagggcatgaacggcaaggagctggacggccgcaacatcaccgtctactaggcccaatcccgcggcggccgttgaggctgcggcggatgccggtacggtactggccgtggatgcggcagcta

SEQ ID NO: 54823 - DNA, 423 bp, Zea mays
  Clone ID: LIB3068-013-Q1-K1-B2
gggagttggtggcttgccagtcatggacacaagtggagcaaatgccattggtaatattagcatcagagatgtccagtatcttttaactgctcccaagatatacaaagagcacaggtcaatcacgacaaaggatttccttagtgctgttcgacaccacctccaggagcagcgtgaggcctcaccgttgctgcatgatgtcatcacttgcaaaaaggatgatacaatcaaggacatcatactgaagctggactctgagaagatccacaggatctacgttgtggatgacaaagggaacaccgagggagtcatcaccttgagggacataatctccaagctggtgcatgagccacgccattactttggggatttctttgatggtgttgttcccctgcctgcaaacagcaccgtatgacacatcttcgc

SEQ ID NO: 54824 - DNA, 433 bp, Zea mays
  unsure at all n locations
  Clone ID: LIB3068-013-Q1-K1-B3
gatcgatcgaggaagacgagaagcttttcgctgctagctagctaccgcccgtggtgtgtgtcgatctgtgacgaccgccaagccgaagccgaaggcagcagcagtcgtcaagttcatcgatctcggcatcgacgaccgcccgtccatggcgcggggcaaggtgcagctgcggcgcatcgagaacccagtgcaccggcaggtgaccttctgcaagcgccgcgccgggctgctcaagaaggcccgggagctctccgtcctctgcgacgcccacgtcggcatcatcgtcttctccgcgcacggcaagctctacgacctcgccaccaccgggaccatggaagagctgatcgagaggtacagggctgccagcaacggngaagcagccgacggctgcggcgacaataacagaatggacccaaagcaagaaaccatggtg

SEQ ID NO: 54825 - DNA, 402 bp, Zea mays
  Clone ID: LIB3068-013-Q1-K1-B9
cagctagccagttgttacgccatatcagggtgtttgaagatgggtacgagagcttggaggggatggtgccagtttccagcagagtgtccagaataaagaacaagtgaggttctacttcgaagcgtgaaaccttttgctcaccttgcgagtaatcgtacaaaggataaacagttttggagtgcggtccaaccgtgccgtagaagcccgtcctatgatccgaaggcaagttggcatcttgccatcgaatagttccattattttctcaaataagttgggatgtttgaagcgattttagtttttttttggtcatattctttaggtgtggtgtatagatatattgcttattcttgttgtaaattagttcatatctggtactggtataatgacaactattaataccac

SEQ ID NO: 54826 - DNA, 431 bp, Zea mays
  Clone ID: LIB3068-013-Q1-K1-C10
cccacgcgtccgcccacgcgtccgcggacgcgtgggaaaaaatctcgccgcacgggggctgcgagtatctggcaacgctccggtgaattacagcaactggaggtgaggcgaccgctgcggtgccgtgcatcaccaccctgccccggtgcccccccgctccacgacgacgcggcacccgcacgtagtccggacggcgagcacttgagctgagtcggccgcgcttcggctttctcgcccgagttgctcggtgccgcgtcttccctctttcggcggcgtgatctgcgtctcggcgctaagagagctgtcgtctcccggctccggcacttgcacaagaccttgagctgatcggccggccttctgcgcgacggtgaatctccgcttctcattttgataatttcccgcaagtcccctcacttcggatttgactgaag

SEQ ID NO: 54827 - DNA, 376 bp, Zea mays
  Clone ID: LIB3068-013-Q1-K1-C11
cccacgcgtccgcatgtttgggcttattacatgaaacgacaacaatattagaaagcttagcaagcacgttagggccaggatgaccaagacgttggtgccatagggacgcaggagcagcaacagcagcaagagcgtagtgtgtagtggctggaggagcacgcgcagtaggaagactgatggtgtacagtgacccagagttgttgcacctaaggattgtgttcctggaattgagatccttcacagaaaggccaaacaggtcaaattccatggaacaattattatcagtcgtaaactgacgaacagaaagaagattcttaatgatatcaggtgtaacaagaacattgctaagataaaactggccagaaagcaccatatc

SEQ ID NO: 54828 - DNA, 302 bp, Zea mays
  Clone ID: LIB3068-013-Q1-K1-C2
gagacacgcgtccaaacatacagctagatagcctctgcatgcctacgtacagcatggcgaagggccaactgctcctgggccttgtggcttcgcttggcgtgctggcattcttcttccttggcgggtaccaagacttctggattggcgacctattcggcggcggcacgccgggcgggtacccgtgcaagcccccgaaggacctgaccggcgaccactttcactatggggggcttggcaaccccggcaccgggcttaaacccttcaagaacttcctgggcttgggcgtcgtcaacacgtttccc

SEQ ID NO: 54829 - DNA, 190 bp, Zea mays
  Clone ID: LIB3068-013-Q1-K1-C3
aaaaaaaaaaaaaaaaaataaaaaaaaaataaaaaaaaaaaaaaaaaaaaaaaaaaaaaaagaaagaataaaaaaaaatgaagagataaaaaaaaaaataaatcaactaaactattattttaaaattttttatttttaatactattaaattacttattttttcaactttacaaattttaaaaaccttata

SEQ ID NO: 54830 - DNA, 241 bp, Zea mays
  Clone ID: LIB3068-013-Q1-K1-C6
acaaaaaaaaactacaaaaaaataaaaaaaaaaaaaaataaaaacaaaagggggagggtaaactggtactggcttaaggacttaaatttacaacctgcattattctatccttagccaggtacaagaatttctcattccccaacttttcaacggccgcactgccaaacgcttccccttccaaaccccaaaagacctgaaccgcatccaatttcaataatggggccttatcaaccccaggccc

SEQ ID NO: 54831 - DNA, 424 bp, Zea mays
  Clone ID: LIB3068-013-Q1-K1-C7
ggagaagggccacttgggagtgtgtattggggacaagtttgggatggttctcagatcgctgtcaagaggttgaagagtgcaaagaatggcacagaagcagaatttgcttcagaagtcgagatattgggaagaataagacacaaaaacctcctgagttttcgtggatattgtgcggatggacccgaacggattctggtgtatgactttatggcaaactcaagtctctatgcacatcttcatggaccacattctgctgagtgtctccttgactggcggaggagaatatctattgccatcaacactgctcgggctctcttgtaccttcaccactatgcaacacctaagataatccatggaagcatcaagaccaccaatgtgttactggattcagacttccaggcacatgttggcgatttcggtctga

SEQ ID NO: 54832 - DNA, 256 bp, Zea mays
  Clone ID: LIB3068-013-Q1-K1-C8
cccacgcgtccaccctgcaactgctacattccacctgcagtcgtcacacgtactgacagttattatatagggcggcgctcgatcagtagcacatcaaacatggctatcatgataaatcgactagtcactgaagtacccaacaaatgacggtagtgcctctacttgacctatcgcagtacatttccctgtcgtacaagatctcatccttcccattcttctaccaactgtatcactgcctccacacacgcgccatcta

SEQ ID NO: 54833 - DNA, 427 bp, Zea mays
  Clone ID: LIB3068-013-Q1-K1-A8
cgattctaaaatttacaatttacaatttacagctgtgcggaggcgggagcagggggcagcgagcacctagcagcgcgcggccggcgactccaccgagacacctcagccggccgcgcggtcgcggttgcctccggctggctcctcgcctcgatggtggggatgtaccagcaccaactccgcgacgaccccttcgacaccctaagcggcggccactgcgaggtacatggcggcggacagccgcggcagcgggtcgaggcgcttgccgacggaagaagcatgttgcgcggcgggggaagcggtatagttggcgccgcgggtggagatctaggggtgctagcgcggtggatgcgggaactcgcagcggatcccgtgggtccacttcccgcgccatcagagcacacggtgaggaagcggcacgtgctggcat

SEQ ID NO: 54834 - DNA, 307 bp, Zea mays
  Clone ID: LIB3068-013-Q1-K1-D1
cccacgcgtccgaccactcatacacgtattcttcagaaaatatatttaaaataacttggcaccgtttcattcattcacgggatatactatttcatacaaacttacattacaactacatattctcaatcccatacccctaactttactttaaccacataacccctttaaaagcatattctcaatctccttctaatactgcataaacattcatcatgcaaatatcactttttgctacatcccattatccttaatgcatacaatcaaatctttcacttctacaaccacacttattataaaattactattc

SEQ ID NO: 54835 - DNA, 390 bp, Zea mays
  Clone ID: LIB3068-013-Q1-K1-D11
cggactcgtggtaaaaataaaacataaaacaaaaacaaaaaaaaattaaacataaagggaaggctaactaaatataccagaaaatacatacacaaacattcaatgatatcacgcaaaaaacctttacctcaacttttacatctctcaccttcacaatcccctttcacctttggttgtaccgctacaaaccatattttaatgcattacttttcaatggcactctttccagcacttgaaaattccctataacatgctccatcctgccttcctacatcttcaacccatatgaagacatctgtagaacaaccacacatagagcaatcttcccatgatcattttctctttccaaaacttactaattctcaattccatattttattagatttcatt

SEQ ID NO: 54836 - DNA, 335 bp, Zea mays
  Clone ID: LIB3068-012-Q1-K1-G5
cccacgcgtccgcccacacgtcctaaacataaaaaaaaaaaataaaaaaagaaagggcggagtctattcctgatcctgggaagcaatcgcactccaatgacacaattcttgttctatcatggtagctaacccaaattaacaactctatgattaacaccttgtgcaaatactaagaccacagcttctgtcaacttagttgctatgaatgtaatccctattttttcatctgacatcacatagacccagacaattcaactgaactgaataacatttagaacaactgaaagactaccaagatgcatcttcacaaaggacttttaacacggttgctatga

SEQ ID NO: 54837 - DNA, 454 bp, Zea mays
  Clone ID: LIB3068-012-Q1-K1-G6
gagagacatggcgccccaccaccagcagcgggcgctgctcctgttcccactcgggttggtcctcctcctccttgccccgcccctcgccggcgcgtggggaaaggagggccacatcatggtctgcaagatcgccgagaagtacctgtcggagaaggcggcggcggcggtgaaggcgttgctgccggagtcggcgggcggggagctgtcggcggtgtgcccgtgggcggaccaggtgcgctggcactaccactgggccagcccgctccactacgccaacaccccccaagtctgcaacttcaagttttctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgac

SEQ ID NO: 54838 - DNA, 453 bp, Zea mays
  unsure at all n locations
  Clone ID: LIB3068-012-Q1-K1-G7
cccacgcgtccggcttacttcgcagcaaatgctgctgctcaggcctcgaggaaatgctgaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttntgcgttcactgccaatggctgggtgcagtcttatgggtcaagg

SEQ ID NO: 54839 - DNA, 451 bp, Zea mays
  Clone ID: LIB3068-012-Q1-K1-G8
caacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggtgcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgactgaccccgtggacttcaaggactccatgggcaaccagctgtacgaccccaa

SEQ ID NO: 54840 - DNA, 412 bp, Zea mays
  Clone ID: LIB3068-012-Q1-K1-G9
cagtaaatttgatagttgaagacaagttccatcgtgctactcctggtggtactgggggtgtgaagaccataggaaattatgcttcggtgttgatggcacagaaaattgcaaaggaaaagggttattctgatgtcctctacttggacgctgttcacaagaagtaccttgaagaagtttcttcatgcaatgtttttgttgtcaaggacaatgttatttctaccccagcaataaaaggaacaatattacctggtatcacaaggaaaagtataattgacgttgctttgagtaaaggcttccaggttgaggagcggcttgtttcagtggatgaactgcttgatgctgatgaggtattctgcacaggaactgctgttgtggtgtctcctgttgggagcattacatatcaagggaaaag

SEQ ID NO: 54841 - DNA, 444 bp, Zea mays
  Clone ID: LIB3068-012-Q1-K1-H1
cccacgcgtccgcccacgcgtccgcggacgcgtgggcgcagaaccagaaaacccacggcgtgctgcttgattagaaaaaggagatccacggcctgtgagtaactacgccatgttacgaatcacagcctgacttcctctagatgaaagcataggtagtgacgacctattgttttcttctcagcggacccaatgagtaactacgccatgttacgaataaaagcgagggaaaatcggatgagcaacttttgcagctatatgaaatgcactttggaaaatcaggtcttgaggacgaaaaacacgataaaatggacttgcctacttttgcaccgaagaaactcataagtaatccaatttccgaggacacgaacggaagtaagctgtttttggtattcgtatcggaattagccagaagaagaaaccattttcactgcccttcattctttg

SEQ ID NO: 54842 - DNA, 211 bp, Zea mays
  Clone ID: LIB3068-012-Q1-K1-H10
acccacgcgtccgcggacgcgtgggcgccctcttgttccttatcgacatctctgttctcgttgagctgacggtatattccaacggtaggttgtaacagatgttcctacacccacaaattacctacatgacaatgtctttcgcccggatcgctcctctgtggccggacgttttatccaacacgagcggcactgcaccaatgaggacccacag

SEQ ID NO: 54843 - DNA, 205 bp, Zea mays
  Clone ID: LIB3068-012-Q1-K1-H11
cccacgcgtccgactgataggatcttaaggttttaatgagtacatgtaattcgggatagtagctaactctaacttaagaggcctggttggagttcacacttcacggggtaaaatagcagcccaaattacatgtactgataggatcttaaggttttaatgagttctgctttgtttttcaattattatatagttaatatttgtagtg

SEQ ID NO: 54844 - DNA, 444 bp, Zea mays
  Clone ID: LIB3068-012-Q1-K1-H2
cccgcgcgtccgcccacgcgtccgcggacgcgtgtgcgcataaccagaaaacccactgggctgggcttgattagaaaaaggagagccacggcctgtgagtaactacgccatgttacgaatcacagcctgacttcctctagatgaaagcataggtagtgacgacctattgttttcttctcagcggacccaatgagtaactacgccatgttacgaataaaagcgagggaaaatcggatgagcaacttttgcagctatatgaaatgcactttggaaaatcacgtcttgaggacgaaaaacacgataaaatggacttgcctacttttgcaccgaataaactcataagtaatccaatttccgaggacacgaacggaagtaagctgattttggtattcgtatcggaattagccagaagaagaaaccattttcactgcccttcattctttg

SEQ ID NO: 54845 - DNA, 256 bp, Zea mays
  unsure at all n locations
  Clone ID: LIB3068-012-Q1-K1-H3
aagaaacctagctagctagctagtaagaggcacaggccggcaccatgtcgcaccaccatgcccagcacaattctcattctcacaaccgtacccaccaccactctcactctcactccggaggaggtggaggctgcggcggcngtggcgcctgcggtggaggcggctgcggagtggctatatgccactgcgattgctcacaccatgatcattcacctccaaggcaaccgttcttcccttcaccgcatcttccattttt

SEQ ID NO: 54846 - DNA, 423 bp, Zea mays
  Clone ID: LIB3068-012-Q1-K1-H8
agaaatagtaaatttgaattgagacacatattctatgacagattttaacttaccctctggtttcgtacctttagtaggcttagtatttccggcaattgcaatgacttccttatttctttatgtgcagaaaaataagattgtctagaaacgacggggccaaattttctcaatgtatttccaggatcataatacagatatttttttgcgtaagtactataatatgatagggtatgtagctctttctacacacaaatgaaaaacgtctatggatgcagatataagctacgagcataaatgcatgcatatgcgtagccgactatagcgagtttttctttttttaagtggatccactaattttttttgaatagaaagtcaatgtatctaaccaattatttcacaggagtactagctactgaacgctat

SEQ ID NO: 54847 - DNA, 236 bp, Zea mays
  Clone ID: LIB3068-013-Q1-K1-A1
ctcactcttcactacccacttactatattcatttaactaagctgatgataacaaactggctaggtttcccctattgacgggtatccaaccactagcacaccctctttacaattttacgtcttttcccccccaattataccctctagattcattctcttaaactctaccctcccatattctctataaatacacaccttttaatgttataacccctaacttcccggaccctttctcac

SEQ ID NO: 54848 - DNA, 421 bp, Zea mays
  Clone ID: LIB3068-013-Q1-K1-A4
cttggttgctccatttttttgttaccagaagatatattggaggtgaaccagaagatgaggctgactctgacagcaagcattatgtactggtatttgaaaaggccaacatcacaatcattggactctgaaaacgggagttcatgtgaaacaacctccatcacaacttcagatgattctgcatctgaatcatcgattgatgacaatacaactagataaaagagcagggtcatgaaaataattgatatgacctgtcattttgaaaacttgggattgattgtttgctgtaattttaagggcaaatacattcaagaccgaggcaagggaaatggttaagggctttgggtgtttttttgaggtttaatagtgtgattgggtgaaagatgtttgacatcctgtaaatatatctataactagtgacaat

SEQ ID NO: 54849 - DNA, 187 bp, Zea mays
  unsure at all n locations
  Clone ID: LIB3068-013-Q1-K1-A5
gtactaccctcttagtttaatcatttaaataatcgcatgataataaacttgcnaggattcccctattggcggggagccaacccctatcagcccagcttgataatcttgcgtcctcaccgccccaattgtattctctagatgcgtcctcagctacttactcagcccaagttctctgtaaagagactcc

SEQ ID NO: 54850 - DNA, 422 bp, Zea mays
  Clone ID: LIB3068-013-Q1-K1-A6
cttttgctcgctctcggcgacagctgggcgaccatcgtcgccgccgcccttctgtaggtgcccaggtcttcgtcggtccctttgccgcctcttcgccgccgatgagcaccagccaggaagaaaagaagttgaaccatggggaagagaaagtcagctgctaagccacctcctaaggaagcggatggacaagcttgacactgtcttttcctgtccattctgcaaccacgggagtagtgttgagtgccgaattgacatgaagaatctgattggcgaagcatcttgtagaatctgtcaggaaaacttcagcacaactgttaatgcactcactgagcctattgatattgaatggattgacgagtgtgagtgtgtcaacactgttgaaggcgacgatgatgcgtgagcttgccccatgcgatgaaact

SEQ ID NO: 54851 - DNA, 415 bp, Zea mays
  Clone ID: LIB3068-013-Q1-K1-A7
cgtccccgcattcagcgcaccgcatgtgtgacggatgggtgacgctgaggaagatcgggctcgcgttcgggaagctcttcaggcgggtcggcgccacgaaggagatgcggatcctcatggtcggcctcgacgccgccggtaaaaccaccatcctctacaagctcaagctcggcgagatcgtcaccaccatccccaccatcggtttcaatgttgaaactgttgactacaagaacattagcttcactgtctgggatgtctggggtcatgacaagatcagacctctttggaggcattacttccagaacacccagggtcttatttttgttgtggacagcaatgaccgtgaccgtgttgttgaaaccagagatgagctccacaggatgctgaacgaagatgagctacgtgatgctgtgct

SEQ ID NO: 54852 - DNA, 406 bp, Zea mays
  Clone ID: LIB3068-012-Q1-K1-G3
attcccgacccgaccgcacgcgtccgcccgctcgtcctcacaaactacctactcttatcatcttgcactagatatctatatactgcaactcagaaaggttttatttcgacaatggcgacatacctcttcctactaatccgtccatcaaaatcatcatctgctactccgttctttatgtctctcaaaccagtactgatcactctcccttgcgctcctgctgacaataagcaacctctatccatctcttactctgtttattccaatgctaacgaccatgccttcaacatctctcccattccccttgtacattccaacattcacccaacttctactcctctatgggagatcaatgaatatggcaatgaaatcatgcttacattcttcaacttgtctgactctactacaa

SEQ ID NO: 54853 - DNA, 253 bp, Zea mays
  Clone ID: LIB3068-051-Q1-K1-A2
acgcacgcgttagctgttaaatgtaatccatccttttttatgtacatgattatctttagacaccttcgggatcttttaacaaatggggctgcccaaccaaacttcccacctgacaatgtctttcgccccgatctgaccatctaagccttgccttttaaccaaaaataaggtcctgtcccctctttctacccaccgaaataagtaaataaccttaaaagtattggtattttacttgctcccggaagcttccact

SEQ ID NO: 54854 - DNA, 431 bp, Zea mays
  Clone ID: LIB3068-051-Q1-K1-A3
gctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaatatattgctagtaaaaataatggcatcgtcggtatgcatgaataaaatgtatcagaatgttcaatctttcacgattg

SEQ ID NO: 54855 - DNA, 85 bp, Zea mays
  Clone ID: LIB3068-051-Q1-K1-A4
actcgtgtctcggcgcgtacgagggcacggacccaacccccgtcggagagagagatggcattggtggcggatatgcagcccctct

SEQ ID NO: 54856 - DNA, 463 bp, Zea mays
  Clone ID: LIB3068-051-Q1-K1-A6
caagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagcccccaaagctgaagccggcaatggtgatgatatcttttca

SEQ ID NO: 54857 - DNA, 345 bp, Zea mays
  Clone ID: LIB3068-051-Q1-K1-A7
gcaaccggtccaacactttcacgctcagcttcagcaatggctgcctccaccatggcgatctcctccacggcgatggccggcacccccatcaaggtgggttccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtcgggctgtccgtcgaccccgagacattcgccaagaaccgcgagctggaggtgatccactcccgctgggccatg

SEQ ID NO: 54858 - DNA, 441 bp, Zea mays
  unsure at all n locations
  Clone ID: LIB3068-051-Q1-K1-B1
cccacgcgtccgcccacgcgtccgcccacgcgtccgcccacgcgtccgcaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctgttatggaaagacaagaaaacttctgcttgtgtaatangcggcgcaactgtcatctgggttctgttcgaagtgcttgattaccaccttctgaccctgatatcccatgtacttgatggtgtgc

SEQ ID NO: 54859 - DNA, 400 bp, Zea mays
  Clone ID: LIB3068-051-Q1-K1-B10
cccacgcgtccgcccacgcgtccgcggacgcgtgggaaaaactgctcggttgctgctcctgcgtccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatgcccctgta

SEQ ID NO: 54860 - DNA, 399 bp, Zea mays
  Clone ID: LIB3068-051-Q1-K1-B11
gacgctggccgtcaggagaaggaggaggttgaggctgaggaggttgcgagcgggaggagcagaggccatggagatggtgaacctgaagctgtatctggagaaccggtgcatcatcgcagagaacgagaggctccgggagagggccagcgcgctccgccgcgagaacctcgcgctgctccagaacctgtcgtccaggacggcggccgtgccagagccaggagcgggagctgcgtgaggttgctgcttcgatcctctgcctgcctgcctgctgaacatgaagtagcgagctcgcgtcaccctcgtcgtttggtgcttgtgctacttgtgtggacaggagacaggccagtgaactcgtagccctaggaggccatctgcttggctgctccgccatgtctgtgt

SEQ ID NO: 54861 - DNA, 459 bp, Zea mays
  Clone ID: LIB3068-051-Q1-K1-B2
aggatatgttgagagtttgtgcacttcagcatggaggaagttgggataaaagtttaccttgtgctgagttctcatataataatagttaacatgccagtctgaagatgtcaccgttcgagactctatatgacaggaaatgcagaactcctctatttttggaccagactagaggaagacagttctttggacctgaacttattcaagaagcagaaaaacaagttcgtataattcgagagaattggaaggtagctcagaccaagcaaaagaagctacgctgataatagaagaagaccactggagtttgaagaaagtgatcatgtgtacctcaaagtgtcaccacttcgtggaatgaggagattcaatgttaagggcaaattgtcccctcgcttcattggaccattctgagttttttaggcaattggagagatggcataccaactcgagttacctgctagtcta

SEQ ID NO: 54862 - DNA, 307 bp, Zea mays
  Clone ID: LIB3068-051-Q1-K1-B7
cccacgcgtccgaaaaaaaaaaataaaaaaaaaaaaaaaaaaaaaaaaaaaaaagaaaaaagaaaaaaaaaaaaaaaaggaaaaaaaaaaaataaaaaaaaaaaaaaaaaaaaaaaaaaaaaaaaaaaaaaaaggtctcccttttcaaagattcaaactttacttcccctttcttccaacttttaaattcttttaaaggttcacctaattaaattttatggcccgttttttaaaaaccttttccctggaaaacccttagtttaaccaaattaaatcaccttccattaaatcctcttttcaacttttt

SEQ ID NO: 54863 - DNA, 380 bp, Zea mays
  Clone ID: LIB3068-051-Q1-K1-B9
aagagatatattttacatcctagaggggctataattggagatactattgttgctggtacagaagttcctatatgaatgggaaatgccctacctttgaccgatatgcccttaggcacggccatacataacatagaaatcacacgtggaaggggtgggcaattagctagagcagcacgtgctgtatcgaaactgattgcaaaagagggtaaattggccactttaagattaccatctggggaggtccgtttggtatcccaatactgcttagcaacagtcggacaagtgggtactgttggtgtgaaccaatatagtttgggtagagccggatctaagtgttggctaggtaaacgcctcgtagtaagaggggtagttatgaaccc

SEQ ID NO: 54864 - DNA, 215 bp, Zea mays
  Clone ID: LIB3068-051-Q1-K1-C10
tcttcctaaaacacataaaaaaacaaatttaaaaaaaaaaaaacaaaacaaaaaaaaaaagaaaaattctgaaatattcaaaaacttctactaaacataaacaaaaataaaaataaatcaaattgcttccttgccaattaataaccaaattaacatccccttacatctcaactcatatctttccataactcacccctaatatcatttaactcccc

SEQ ID NO: 54865 - DNA, 255 bp, Zea mays
  Clone ID: LIB3068-051-Q1-K1-C11
cggacgcgtgggctcggccctcgctcccacaacaagctcaagccagccttcgctctctctgtgctccaatggcgcgcttccagctcgcagccgtggccatggccatgctcttcgccgcggcggcagcgcaggccccgaccgccaccccgacgccggctcccaaggcgtccccaccgccggcgactccgacgccgacccgctcgccggcgtctccgcccgtgccgcccacgaccatgcctgctccagatcacgcgc

SEQ ID NO: 54866 - DNA, 397 bp, Zea mays
  Clone ID: LIB3068-051-Q1-K1-C12
ggcgctagctagcttacctttccatcacctcttcgcctagctagcctgccaggtccagcaggtgccaccgccatctctgctctgctctcgcaagcacacgcccggccgcctgccacagttgccatggcgaccatagccacgatggcgctgctgaagcccgccgccaaggccgcggcgcggccggcgccgtccaccagcagcggcagcgtctcgctgcgcgtcccggggcaggccgccaagaaggctgcggtgtccgcgtccgcgtcgtccacgctggcgggcgccttcttcgcggcgctggcgtcgtcgcccgacgctgcgctggcagacgtcgcggcggcggacgccggcggcgacagccgcggccagctgctgctcgtcgtggtggcgcccgcca

SEQ ID NO: 54867 - DNA, 421 bp, Zea mays
  Clone ID: LIB3068-051-Q1-K1-C2
tgtgttttcaagaggctctgaactacatcaggggtctaccagccgaagctgctgctaatcgaattgtgaaggaagctgtcacttcaaagggattaagagatgatactacttgcatagtagttgacatactacctccagaaaagttaagccccccactaaagcgacctggaaaaggagtcatcaaaactctgttccgtcggaggccctccgatgaaatgtctgaagatcagatggacagaggatgtttagaacctgatgtcgtggaggaaatatacgaggagggctctgcaatgcttgctcgaaggttgaatataaattacccatctggaaatatgttcaagctgcatgattgtgctgtctgccaattggagatgaaacctggtgagggcacctctgttcatggtaacatgcccaagcattc

SEQ ID NO: 54868 - DNA, 399 bp, Zea mays
  unsure at all n locations
  Clone ID: LIB3068-051-Q1-K1-A10
gcccggtcggttccgatggggtacgtgctgtcggcggtggcgagggtgctggggcagcccgcggcgtggggggcggcccgggagatggcgctcctcgcggggccgctctgggcggcggtcctcctcggcctcctgctcggctgggcctggcgcccgcgctgggcagctggcctcgtcgccgcccccgccgcgcagccgcccttcgccacgctcgacttctggaaggcccagctccccgcccggctccgcgccccgctcggctccgccgccgccgtgcagcacggggaggaggacgaggtctccgtgcgaggtggcaggtcgtcggaggcggngagcgaggagctggcggtggggaagcgtgacctggcgaacctctggaggctggtggagggcatggac

SEQ ID NO: 54869 - DNA, 298 bp, Zea mays
  Clone ID: LIB3068-051-Q1-K1-C3
aaaaaaaaaaaaaaaaaaaaaaaaaaaaaaaaaaaaaaaaaaaaaaaaaaaaaaaaaaaaggaaaaaagaaaaaaaaaaaaaaaaaaaaaaaaaataaaaaaaaaaaaaaaaaaaaaaaaaaaaaaaaaaaggggcgccctttttaaaggttccaagtttatttacccttccttccaacttaaaaccttttttttagggcccccaaatttcaatccattgcccgtctttttaaaacttttatactggaaaaaccttgggtttccccaacttaatccctttgaaaaaaatccccttttt

SEQ ID NO: 54870 - DNA, 342 bp, Zea mays
  Clone ID: LIB3068-051-Q1-K1-C4
atgtggaggagggctttagcgatggtcctgttcatggctggcgccgcgctgctcgccggggctgcgggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaagcgggagctcgccgccttcttcggccagacgtcccacgaaaccaccggtggatgggcgactgcttcggatggaccgtttgcctgtggatactgccgggtg

SEQ ID NO: 54871 - DNA, 209 bp, Zea mays
  Clone ID: LIB3068-050-Q1-K1-F6
aaaaaaaaaaaaaaaagaacaaaaaaaaactcaaaaaaaaacacaaaaaaaaagggaataggaaataataaagggccatacaaactcctcaaaccacaatttcctacccctccatccaaaacaataagactggtacaacgatcccaaaagacaatcaaatccccgttttctaacaacggaattactgaaataaccttaaaactaccaaa

SEQ ID NO: 54872 - DNA, 375 bp, Zea mays
  Clone ID: LIB3068-050-Q1-K1-F7
gagacaggcgtcttcgtactcgcctatctccgcgactcaaagcttcttccatgtcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgacagctctttcaccctgagcagcttatc

SEQ ID NO: 54873 - DNA, 51 bp, Zea mays
  Clone ID: LIB3068-050-Q1-K1-F8
aaaaaaaaaaaaaacaaacaaataaaaaattaaaaaaaaaaaaccacaacc

SEQ ID NO: 54874 - DNA, 407 bp, Zea mays
  Clone ID: LIB3068-050-Q1-K1-F9
cccacgcgtccgattcccggatccaggaatagcaacatgaactaaatgtcctgttgctattgccggatccaggggggagtacgttcgatggaataatttcttagatgtattaccctatccccaggggttgggtccccttctgacgggtcagtggaatctttatgcccaaaatcctgattcgagtaatcatttatttggtaccactcaaggagcgggaactgccattctgacccttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgat

SEQ ID NO: 54875 - DNA, 445 bp, Zea mays
  unsure at all n locations
  Clone ID: LIB3068-050-Q1-K1-G1
gcgcgccgcgctcctctgcttctacgccgtgcactctctctagtctctcccttcccttctacacgcctgcgcccccactcgtgagactctacctagccctagcgccagcaccacccgcccaacctcccggagagagagagagagaggaggaggccttcgccgccgccgttgccgtcggccgagacgccaggatgttcgggtaccagaagggcctcgatgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgncgtcgtcgccgcagtcgtcgtcaaggtccgcgccatcccgcacttcttcaccaccaccagcgccgggctcgggctctacatctttct

SEQ ID NO: 54876 - DNA, 343 bp, Zea mays
  Clone ID: LIB3068-050-Q1-K1-G12
aaaaaaaaaaacaaaccataaaacaaaaaatctaaaaaaaaacacctaaaaaaaaaaaaaaaggcatacttcgacaaaaactgtggcccctctaaacgatccaaacttccttactcatccttgcaatccattacatacttctctagtgtactctaattacaattaattacccaccattttaaaacctcatgcattcgaaaaaaatgcctctaccaaacttattaatctttaatcacatcctcattttctcatttgcccaaatatcaaacatcaccccatcaatctgccttcctaacaattccctactctccattgtgcatagaacccaccctttagttctcca

SEQ ID NO: 54877 - DNA, 168 bp, Zea mays
  unsure at all n locations
  Clone ID: LIB3068-050-Q1-K1-G2
cgacgcacgcacccacgcacccggccagaagaccggccggcccacncggcggctacggaggagaccaccgcggcngtggagagggaccaccagaggcacgagcaccggacggcaacacacaccgggcaacaacgggcacgcgaccgccaccaacagcaagagcgacaa

SEQ ID NO: 54878 - DNA, 442 bp, Zea mays
  unsure at all n locations
  Clone ID: LIB3068-050-Q1-K1-G4
cgnntccggtcggttcnnttggcttcnnctttctccaatcgaacctaggggttgacctgatgaccagccatgcctccgtgctctgggatgttcattggggtttgcttgcgtggcttactctgtcttcaacgtctttaccaaactgttcaagnggctcagaatggaagaacatncgccttgaggaccagccttcactttccctggcagtgtgtttgctatttttttcttcttgaatgctcttatctgggggcaaaagtcctcaggtgctgttccattcaccaccatgtttgctcttgtcctcctttggttcggtatttcagtacctttggtttttgttggaagcttccttggcttcaagaaacctaccattgaagatccagtgaagacaaacaagataccaaggcagatccctgaacaggcctggtacatgaacccaatcttc

SEQ ID NO: 54879 - DNA, 420 bp, Zea mays
  unsure at all n locations
  Clone ID: LIB3068-050-Q1-K1-G6
gcaagatgaaggagaggctngtcggcgtctctgaggagaccaccacgggtgtcgaagagggtctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaagacgttgtctctgaagctgacatcttcgtgaccaccactggcaacaaggatatcatcatg

SEQ ID NO: 54880 - DNA, 406 bp, Zea mays
  unsure at all n locations
  Clone ID: LIB3068-050-Q1-K1-G8
gcggagcaacaccacaccacccttggtccggcactagcactagctatccagtggagacggagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttncagacgcggggctcctacctcttcggccacttcagcatgcacatgaagctcgtcggcggcgactcctggggcaccgtcacggccttctacctgtcgtcgcagaacttcgagcacgacgagatcgacttcgagttcctggg

SEQ ID NO: 54881 - DNA, 326 bp, Zea mays
  Clone ID: LIB3068-050-Q1-K1-G9
gactcttgctcccactcttcctctaaggattaacggtccttatattcttctttgcagtatttgaccaaaaagttgttaatgccctcatgacaacctagtctggtctattccatgttggataattgtttgtggttcgtccattaaattccacatttcaagggagattgtttatcattattcccaagctgtcatagatatcattatcgcatggtctgtaacatgaccataatcttctaacatgactctggtttttttatcatactactatctaaccttttcgtcatttatttcctatatatggttactctatatccttagtctaatta

SEQ ID NO: 54882 - DNA, 326 bp, Zea mays
  unsure at all n locations
  Clone ID: LIB3068-050-Q1-K1-H1
agccacgagcggcccaagcgcgccgcgaagcaaacnacgccgacggcnacggcagcggggggagaggcgccgacggccgccgagcngaagacagcggcggccgaggcgcaacccggcggcgcgcgagngaaggggngggncacccaggcccacaaaggcccgaaccacaacgcgcgccgcgngaaacggcaacaagacgaacagcaaacaacacatgaaccggagacggggagcggagagacgcncgcgncacaacaacacacacagaccggcagcaaaaagcaacggaacgcgccggacgcacncaaagcacggaagaaagaggc

SEQ ID NO: 54883 - DNA, 339 bp, Zea mays
  unsure at all n locations
  Clone ID: LIB3068-050-Q1-K1-H10
cccacgcgtccgcccactcgttcgctggcttctccttcctctcttaccaattcctcttcaagttanctttacttagtgttttgtatatgggccatggcatctgctaatgtgtactaccgttgcttcgtcaccgggcttgcctgggccaccagcaaccattcgctcgataatgccttcgcctcctacagctagatcctctactccaacgtcatcaccaaccacgagacagcgaggtctcgccgcttcgtcttcgttaccttctcctgcgacaactccatgctcgacgctatctataacatgaacggcaaggatctcaacctccctaacatcaccgctaac

SEQ ID NO: 54884 - DNA, 406 bp, Zea mays
  Clone ID: LIB3068-050-Q1-K1-H11
ggtacactctgatccgaacaatggacgcgacgcaactgaaccgatcgatggacgccacgccgacgcggctgttccttggcgcgctcctcctcctcgtccccgccgcgctcctcctcctgctccgcgcgcggggcaggcgccgcctccccccgggcccgccgtccctgccgctgctcggcagcgtggtgtggctcaccaactcgcccgccgagatcgagcccctgctgcggcgcctcttcgagcgttacggccccgtcgtggcgctccgcgtcggggcgcgcttgtccgtcttcgtcgcggaccgccgcatcgcgcacgaggcgctcgttgaccgcggcgcgacgctggcggaccggccggcgctcgcgtcggtcaagttcctcgacgagagcgacaacaccatcac

SEQ ID NO: 54885 - DNA, 404 bp, Zea mays
  unsure at all n locations
  Clone ID: LIB3068-050-Q1-K1-H7
tgtgaagntacttgatcaagaaatctccaagtttcaaggccagtcacctgattatgatggactatgtgagaaaacacatcagttctctgcattagtcgataaagttctgtcaaacgttgatgttctaaatgatattgtcatagcactgtctgttatcttgtcagaaactagccagattaagttcacattgttgagagacaatagcaatgaagcagaaagtaataacttagattgtgttgataaagtgactctacttgaaaataaggtgcagcttgagccagtaaaagacaatgttcctggtatctgcccactgttgcctcattcatcttctgatcctgagtttgaggggcctgctgatgctagattcgatgttaagactgcagtgaaggtgtactcgccggagg

SEQ ID NO: 54886 - DNA, 442 bp, Zea mays
  unsure at all n locations
  Clone ID: LIB3068-050-Q1-K1-F5
ccatctngaaaatgggatcaaacagtctatcgaaggtgccacgatgtatgacggtgtggggactgcagatgatgttggtactcttcttgctgtagactgtacgcctatggatgacaatggccgccagggtgatttggtgacagaatttgctaataatgggaataagataacatgtgatccagagatgcagagtcatatcgatgcatgtatttctaaagggagagctgaatttgaagtttttgtcctgcaggcttattctcctgaggaatgggaactggctacattggtgctcacacgacctaattatcagattaagttcaaacagaccggtaatgttgtaattgacgagaagtactcacaaagtctacagacaaaaattcctaatgggcgcacaactcagttgggtttaataactgcgggtacaactcttccatttaacaca

SEQ ID NO: 54887 - DNA, 400 bp, Zea mays
  Clone ID: LIB3068-050-Q1-K1-H9
ctttaactatggtcctgaccatggctggcgcccagctgatcgcctcgactgacgccacccggacgcagcacttcctttggaggatcatcatcctggccatgttccagatcatgctgatccaccgcgcgcacagcaggtgccagggcgccttctacacctacgacgtcttcatcgacgccaccagcaagttcctcagcttctgcaccaccggcgacgagcagactctcaggcgggagctcgacggcttcttcggccagacgtcccacgaaaccaccggtcgatgggccactgctccggatggaccgtttgactggggatactgcctggtgaacgaacagaaacagactgacccaccctactatggacgaggacccatacagctaactcataagtacaacta

SEQ ID NO: 54888 - DNA, 303 bp, Zea mays
  Clone ID: LIB3068-051-Q1-K1-A1
cggacgcgtgggctggcacatgagtatttttgttcaaactttaacggtggctgtctgttatcagaaatgcgtcaagagagttgagaatgatgatactggtcacaaacactgcactgggcaatactttgattactggtcatgcatcgacaaatgtgtagcatcaaagctctttaagaagctcaaatgatttgtgcgatgtgatgcgacttctgacaaagtgaatcgaatttgcataccttacacctttggaaagtgtatgagctcgtacatcttggaataaaacatcaattcttctttgctaaa

SEQ ID NO: 54889 - DNA, 407 bp, Zea mays
  Clone ID: LIB3068-050-Q1-K1-D12
cccacgcgtccgaattcgtaaaggatgtgcacctggaaccagtaccgtttgacatggaccgggatttgagcaccccgacatacaaaaagaagcgtccgcaactgctcaagtactaccagggcgtgattgacaacatgtacaaaagtgctaagtgaactcactctacagtacacatcccgatgaagattcccaacgctgaatcttgaatgagcagccagaagttctgctgcgtatatgctcgtagtttgcatgcgagaattcttcctgtatcagtttttcagaaacgatttgccttgggcatatatatatagcaaaaccggctatgtggccagcagccaagtggagacaccgtttcaaattgattgaactatggcgaatactgattgacagaagggttagggcatgct

SEQ ID NO: 54890 - DNA, 415 bp, Zea mays
  unsure at all n locations
  Clone ID: LIB3068-050-Q1-K1-D3
cggacgcgngggtccngatcgtcctgttcctcacagcagcagccatggcggccgagccggagaagcgggctgtccccgctgcacatgagacggccgtgcacatcgtgtacgttgaccgccccgaggacgccgaccctgaggagttccacatccggaccctcacccccgtcctcggcagctaacagaaggccagggacgcantgctctaccactacaataacgcctgcagcggcttctccgcgaagctcaccccccagcaggtcaaggatctcaaggagcaaccaggtgttctccaggttgtgccgagccagacttaccagctacatggtcctgggtctggcacttaccagggcacgacacacaccttgggccttatgtgaaggcgtttgagaatcaagaagattgtgtttaagta

SEQ ID NO: 54891 - DNA, 347 bp, Zea mays
  Clone ID: LIB3068-050-Q1-K1-D4
cccacgcgtccgaaaaaaaaaaaaaaaaaaaaaaaaaaaaaaaaaaaaaaaaaaaaaaaagaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcgcaacaaaaaaaagaccaaaagaaaaaacaaagatataccacaaaatgaaagcaaaaaaggagagaacaaaaaaaattacactgccagaaattaaaaaaatcaaaaaaaaaaaaaacacgcgacatacaaaacaaaaaccagacggaaaaaaataaaaaaatacaaacagg

SEQ ID NO: 54892 - DNA, 425 bp, Zea mays
  Clone ID: LIB3068-050-Q1-K1-D6
caagaacaacatttcggggacaataccttctgcccttggaaagttgaagtcccttgtatgcttgcgtctcaatggcaatcatttgactgggcccatcccaagggaactcgctggaatatctagtctcaaagttgttgatgtttcaagtaatgatttgtgcgggacgattcccacgtctggaccatttgagcatattcctctgagcaactttgagaagaacccgcgcttggaaggtccagagctacaaggcctggccatatacgacaccaactgctagaggcaccacgaagaaaagaactgctagaaagtaacgagcgaacaaggttaccagaaattgggcgatatagatttactaggtctggatctgtaatccttcctgcatagctcttattcgtaactcgctgtctgcacgaaaagtggtgtgt

SEQ ID NO: 54893 - DNA, 260 bp, Zea mays
  unsure at all n locations
  Clone ID: LIB3068-050-Q1-K1-D7
cccacgcgnccgagcagncacaatacggcacacggaaacagcgcgccagaggcgggacaggcaaacgcgaagacgaaaagagagaagcaacggaaacccacggacaagggcgaagaacgaacgcggcacgggcagcaanagggcaaaacaaaccnggcgcacgacggnccaaacacaacgcacgaaccgaacacgggggcgaacagaccaacacagggggaagaccgcagcacaacgacaggaacagccgacagccaagg

SEQ ID NO: 54894 - DNA, 51 bp, Zea mays
  Clone ID: LIB3068-050-Q1-K1-D8
cccacgcgtgcgattactcgctccacgtctcaccgcaacaactcaccacca

SEQ ID NO: 54895 - DNA, 359 bp, Zea mays
  Clone ID: LIB3068-050-Q1-K1-D9
gcgcccacgcgtccgccgtgatttttctttgcgcaacgctgctgtaagcctgtaatggtgaattgctagctatggttatgccgttatgaaggaagaaagtgtatgcatgcatggtagggtaaagagtgggtaattaatatcgttgatcaaaaaaaaaaaaaaaaaaaaaaaaaaaaaaaaaaaaaaaaaaaaaaaaaaaaaaaaaaaaaaaaaaaaaaaaaaaaaaaagaaaaaagaaaaaaagctaattacttgaaaaaaaaaaaaaaacaaaaaggtgcgacctttttaaaattaaatgctgctggacagacaaatggcggggccgtaaatttttatagggttaccaaattttaaaa

SEQ ID NO: 54896 - DNA, 359 bp, Zea mays
  Clone ID: LIB3068-050-Q1-K1-E10
cggacgcgtgcggctgatcgctcactcttgcagctcgatcattctttagctgctctatctctagcctttagccctagctagtagctagccactcggtcgtgtagtcatcaaccttatgatcgtcacccatggccactgccgacgtccagaccccgaccgtcgtggccaccgaggaagcgccggtggtggagaccccggctccgtccgccgtcgtgccctaggaggctgccccctccgtcgaggccaacgtggacgagccagctgccccggcggaaaccgagccagctgccgtcgctgagcccgaggctgcccccgtggcagcggaggaagagacgccaaaggaggaagagacagctaac

SEQ ID NO: 54897 - DNA, 383 bp, Zea mays
  Clone ID: LIB3068-050-Q1-K1-E11
agcacgcctcccgttacgaaatcagctactattctgaccaactcagaacctcttctctatcgactgatccaatagcacgggcccttggtgcgctaatgccataactatgctcctctactccctcgagcataggcaccagatgatagctatgattcttacttatatgcattcaaccataatccgtcacactataactctgctccactagcttttcaacccatcgcgattaccacttgtatgaatcaacagttcatctcatactatgctgaattactaatctacagctcactcattaattcagtcaaactatcctttctcacgaccgtctaaactcattttacttctcatatcgtccggttaacaatcctacacttaactaattc

SEQ ID NO: 54898 - DNA, 244 bp, Zea mays
  Clone ID: LIB3068-050-Q1-K1-E12
ccgaagcatttcttcttcttcttgtcagtagctgtggcctgcacagctagcgccactgtacgaccattggtttgttagcatggccccgagtaacatcgtcgttcagagcagcagcactccgccggttgccggccgctaccaggagttcgcgccgtctgtatggggagatttcttcgtcacctatgccactccacgtctcactcgcatcagagcagcggatgactagagatagccctgctgctca

SEQ ID NO: 54899 - DNA, 366 bp, Zea mays
  Clone ID: LIB3068-050-Q1-K1-E4
tcgagacatctggccaaagcataacgcgctcacaggatctgctgcggtctcctgacatgggaaggacattcatcattgggcccgaggcctgctagttctctgccatggactacacttaccctctgtcgatgccgctccacgacgcagatgagctcaccaagtggtccctctaccgctcggtcatcgccgagttcatctccacgctgctcttactctacatcaccgtggacaccgtcatcgtatacaagcaccacacggacacggcctcttaaggccccgacacggcgtacagtagcgtgagcatacacggcatcatgtgggccttcagcggcatgatcttcatcctcagctactgcaccgtcggcc

SEQ ID NO: 54900 - DNA, 194 bp, Zea mays
  Clone ID: LIB3068-050-Q1-K1-E6
cctgcactgaaatgagatcatatagcggattaaaggagctacgaaccatcagggatacggtgcagcatatgatgtagctgctaggccagatgtacactgacctactatggatctcgatgtacgccgaggagatttggatacaggatgagcgtactctgacgaagaaaataacatggaatccagagatgcatagt

SEQ ID NO: 54901 - DNA, 419 bp, Zea mays
  Clone ID: LIB3068-050-Q1-K1-E9
aattccctgtcgaccgactcttcaccccacgcgtccgattacccgatccacgaatttcaacatcaactaaatatcctctttctattgccgcattcaaaacttaggactttctattcaataatttcttaaatatattaccctatccccaaggcttgggtccccttctgaccattcaatccaatctttattcccaaaatcctgattccactaatcatttatttggtaccactcaaggaactggaactaccattctgacccttcttccgggattccatccacaaacacaaactttgttacttacctatatttctcatcatcatttagctatttcatttatttttctcattgccattcatatatatccaactaacttcacaattttgcacattattaaacatctttttataatcacatactcc

SEQ ID NO: 54902 - DNA, 305 bp, Zea mays
  unsure at all n locations
  Clone ID: LIB3068-050-Q1-K1-F1
gcgctccgctgcccagacgactcgngggcctcgtgctgctcgccgacgtcgtcgcggacacggggtacggcgcgtcccttagcggcgcagcgaacgacctgctgcccaagtacggcctcccgaaggggctcatcccggactccgtcacctcctacagcttcgacgaggccacgggcgccttcgagatccacctgaccagcacctgctacgttcacttcggctcccacctcgtctactacgagaggaccataaccggcaagctctccaggggcgccatctcggacctctccggcgtccaggccaag

SEQ ID NO: 54903 - DNA, 408 bp, Zea mays
  Clone ID: LIB3068-050-Q1-K1-F10
cccacgcgtccgcccacgcgtccgcccacgcgtccgtttcgttcacatccccttctctgacggcatgccccacgactgggccgaccgccacgccactgagaaccggatgcgcctccacgccctacgcgtgatccgcgagaggaagatggatggcgtagttgttttcaccgacgacagcaatgttcatagcatggagctgttcgatgaggtgcacaaggtccagtggatgggtgctgtatccgtcggaatccttgcgcatactggcacggcagaccaactacggctcactgaggaggacaagcagaatatgcctcttccagtccagggccctgcttgcaactcctcagggcatctgattggatggcacacgttcaactcattgcccttctctgggaagacggccacagt

SEQ ID NO: 54904 - DNA, 386 bp, Zea mays
  Clone ID: LIB3068-050-Q1-K1-D11
gcgtcgttcttcgacccaaaccgtaaacagccgatgactagcccggtggttaccctatgcggcctcccaccctaactggttctcttcacaactgattactgggtcgatgttgacctctagactgcagcatatatcctggcctatttgctcgctgggaggccaattatgccacgacgaacacaggttgaacagctacataaaatttttaatttgtattgctccacaacagaataatattggaaaaagtctaatctacctcatgctacaatatttaatcctcagcaaccgtacagaaagcgaataacatatacttttaacgattttccacaatcaacacttacattgatctagacactacttgcaattgatccatcatatcgcttaac

SEQ ID NO: 54905 - DNA, 139 bp, Zea mays
  Clone ID: LIB3068-050-Q1-K1-F11
tatacttctcttttccaatatacggtgccttttgtgctaaaaaaaaaaacacttatctaacgacatacccgacaactaaacacaaacaacacaccactaaaaaaccaaatacacctacacacactaacacataatccac

SEQ ID NO: 54906 - DNA, 390 bp, Zea mays
  unsure at all n locations
  Clone ID: LIB3068-050-Q1-K1-F3
cggacgcgtggggcaaagcgaagcgcgcgcacagcagctgctgcaggtctcctgacatggcgaaggacatcgaagcatcggggcccgaggccggcgagttctcggccaaggactacaccgaccctccgccggcgccgctcgtcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggtggcgtgggcatcctcggcatcgcgtgggccttcggcggcatgatcttcatcctcgtctactgcaccgncggcatctcaagtgggcacatcaacc

SEQ ID NO: 54907 - DNA, 213 bp, Zea mays
  Clone ID: LIB3068-050-Q1-K1-F4
aagagacagaggcctatacagcagtctggtaaatgcacattcagctgtccaaagagatgcggacagagggttcccagctgggttgtcagaaatgctggtacagagccctgggaccgacttataccttctctctgctcttccacgccacacgtgagctcaacgctacgttaatggtccgatagctcaaggtggtgttactgtacacattagttg

SEQ ID NO: 54908 - DNA, 321 bp, Zea mays
  Clone ID: LIB3068-020-Q1-K1-H6
agccatgtggaggagggctttagcgatggtcctgttcatggctggcgccgcgctggggggcggggctgccggcgccggcgcgcagcatggcgtgtggagcatcatcacccggcccatgttccagagcatgctgagccaccgcggtgacagcgggtgccagggcgccttctacacctacgacgcctttatcgaggccgccagcaagttccccggcttcggcaccaccggtgacgagcagacgcgcatgcggtagctcgccgtctttcttcagtcagacgttccacgaaaccaccggtggatggtcgactgctcctgatggac

SEQ ID NO: 54909 - DNA, 381 bp, Zea mays
  Clone ID: LIB3068-020-Q1-K1-H9
tcccattcttgcaccggggtcattggactattattactgaaccagtgcgaggtaggctctggtgtaaacctccaatttatgacataaatgctcctgacttgtacattccattaatggcatttggtacctatgttgttcttgctggcatctcattgtgtctttgtggaaagcttagtcctgaagctttgaactggttatttatcaagggattggttggttggtttatgcaaacagcactgcttaaagttactttactttcattaggcaatgggtaagcacctctattggacattatagcttacgcctgtttcacttttcctggcttgtgtttggctgtttctggaagaataatatgtgattacttctactactttctgatgc

SEQ ID NO: 54910 - DNA, 446 bp, Zea mays
  unsure at all n locations
  Clone ID: LIB3068-021-Q1-K1-A1
cccacgcgtccgcgctgttctctactacttcgatcacagcgttgcgtctcagcttgctcagcagaaagagttcaacttgaggaagcctccatccttccactacgatttgcttctcttaggtttcctgacgttaatgtgtggccttattggtatccctccatcaaatggtgtcattccacaatcacccatgcatacgaagagtttggctactctcaagcaccagatccttcgtaaccggctagtagccaccgcacggaagggcatgagccagaatgcaagcctgagccactgtatggcagcatgcangatgcttatcagcagatgcagacaccactggtttatcagcaacagtctgtcagaagaggcttaaatgagctcaaggactcaacagtccagctagcttcgagtatgggtaacattgatgcacaagtgatgagacagtcttt

SEQ ID NO: 54911 - DNA, 414 bp, Zea mays
  Clone ID: LIB3068-021-Q1-K1-A10
gagaaagacgtgctgagcaatgaagtccctctcggcccaacactagattgatatacagagaatttccactgtggcctcccgaaccaagccctctcccactgctaccaccttccttcgttgtacccggattatttcgtgtaaagatcacatgtgatcctaagaattaaaacgtgagtcgttctagcatatattgtgaagcacgtgctggcaagtttccgttcttggcattgggtcaaattggggtgccctgcttccgattccctgctgcaccgtgcctatgtagcatgtaaagttgtatatgctgcgaatcgtagtacagctatatatttgtgtgtcctaaatcttgagtgtctttttactggcttctgtaaatgctccccaactgatgtaaatacaaaattccatgttcctcgc

SEQ ID NO: 54912 - DNA, 339 bp, Zea mays
  Clone ID: LIB3068-021-Q1-K1-A11
cccacgcgtccgcccacgcgtccgcccacgcgtccgcccacgcgtccgaaaaaaaaaaagagaaaaaaaaaaaaaaaaaaaaaaaaaaaaaaaaaaaaaaaaaaaaaaaaaaaaaaaaaaaaaaaaaaaaaaaataaaaaaataaaaaataaaaaaaaaaaaaaaaaaaaaaagttggacactttttaaaatcgaaatgttatttcaatagattgacaatatctaactttttaaattggttcaaaataattaattcaatcaggcagaaaatataaaataatagggactgtaaaaactgtgtatttaacaattctaaagtctttatgtcaaatttcattt

SEQ ID NO: 54913 - DNA, 445 bp, Zea mays
  Clone ID: LIB3068-021-Q1-K1-A12
agcgtacgcgcctagcgaccagcacagattcgttccacgcctacctcctgccctcgcccgtgctctcagatctcgcgcgcgccccgcaaagggtaactttgagccatgggcacagttgtggatgctccagcagttgtggctgaagaggtcactgaaaacatgttgggtggtaagaaagttacagttgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggatggaaagattgttccatcagaggtgactataaagctgttgcaagaggcaatgataaaaaatgaaaatgacaaattcctgatcgacggattttcaaggaatg

SEQ ID NO: 54914 - DNA, 190 bp, Zea mays
  Clone ID: LIB3068-021-Q1-K1-A3
gacaaggtggagaaattcctggcttgaatgccagagctctctcatcagatggactcccgaagacatcaagtttagggagggaatatgcatgtactctctctttcccaccccaaataagtcttcttcatctcatatttcgataaatcaaacaatctcaattttgatctaatatatatacacacaacacatt

SEQ ID NO: 54915 - DNA, 131 bp, Zea mays
  Clone ID: LIB3068-021-Q1-K1-A4
cggacgcgtggggccttctctgactccggaagcaatggattttgtcaagcgattgctgtgcaaggatccgcgtagaaggattactgcagctcaagctttaagtcatccatggatcagaaattataatgaca

SEQ ID NO: 54916 - DNA, 340 bp, Zea mays
  unsure at all n locations
  Clone ID: LIB3068-021-Q1-K1-A5
cccacgcgtccggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaagcgatgcggaacgccatcgagggcatgaacggcaaggagctggacggncgcaacatcaccgtcaacg

SEQ ID NO: 54917 - DNA, 197 bp, Zea mays
  Clone ID: LIB3068-021-Q1-K1-A6
caaaaaaaagcaaagtgccatgcaggtgcagatagaagtgtttattaactcttaaattgatcacacgaaatgattggacatcttctagcctacacatatgtacaaacttcatatacaaatcaatgcatatttttgtggctgaagcagatttctgtacctaattaggtttgcacacctgtgcacttgaaaagattcac

SEQ ID NO: 54918 - DNA, 267 bp, Zea mays
  Clone ID: LIB3068-021-Q1-K1-A8
cccacgcgtccgcttttgttccacacgagatttctgttctcgttgagctcatcttaggacacgtgcgttatcttttaacagatgtgccgccccagccaaactccccacctgacaatgtcttccgcccggatccgccccgcgaggtgcggccttggagccaaaaagaagggccgttccccgcttcccaaccacggaaataagtaaataacggttaaaggaatggcatttcacttgccccccgaggcttccacttatcctacacctctc

SEQ ID NO: 54919 - DNA, 391 bp, Zea mays
  Clone ID: LIB3068-021-Q1-K1-B10
cccacgcgtccgcccacgcgtccgcttctctccactatcctaccaggcaccactcgcatggggtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaatatcggaagagtgtggcccgccagggcttcccattgatctcagaggtaaaagggcattcattgctggagttgctga

SEQ ID NO: 54920 - DNA, 329 bp, Zea mays
  Clone ID: LIB3068-021-Q1-K1-B11
ggtgggcgcaccgcaactgagcctgtatagcacgagcgcgcccgtgagagtggaagagggggctggccccgccggcctgagcagatcatcggaaggcacaccgagctcttgccagctgcctccactccacccaatggcgatgccgagggcggagtcactccgcttactgggcctgctgaagcagcccgagtccgacgccggcgccccattcgagctcgacgagcgcgacgtggtgtgtccggcgtgcggtgggcagcaagacggttgtgccgccccgcctacgccgaggtgtcatgcgcacgccgtgccgctgtacatcttaggactgt

SEQ ID NO: 54921 - DNA, 269 bp, Zea mays
  Clone ID: LIB3068-021-Q1-K1-B12
gtgacttaagccgccgccgagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgccgtctgcacgactgttgcagctatgaagctgtatgtaccttactgttggtgcactattttagttattgctaatcacaggggatac

SEQ ID NO: 54922 - DNA, 312 bp, Zea mays
  unsure at all n locations
  Clone ID: LIB3068-021-Q1-K1-B3
cccacgcgtccgcccacgcgtccgcccacgcgtccgccccaattgtatgctgatcgtttcagttggttcgtgcaaagtcagatggctcagtgataatttgcatctatctgatgacttgaatcatgctgaaccaggctttagttctgctagcagtctgtccagtttcaataactacgtttatttgttgatagcatttccattcatttttcggtatcatgccttggtttcttgttcaaaataatatggtttgcttgcatgaagtacatgtagtgacagtnactagtaagagttaaaccatgtgagtatttttta

SEQ ID NO: 54923 - DNA, 240 bp, Zea mays
  Clone ID: LIB3068-021-Q1-K1-B4
ctcactcgtcctaacgccttacggaatgcacttcgatgtgcttgctcgttcaaaagctactgggtgagggacttggctctaaagctcgccatactcttgatactctgccacctattgattacttcgtagctcaaaagtacacgtatctttaactcgtgcttacacacaatggggttacgcatgtcaagatcaaccgtatttttaaatcaccatctttgagaaaacggttgaaattatttt

SEQ ID NO: 54924 - DNA, 327 bp, Zea mays
  Clone ID: LIB3068-021-Q1-K1-B5
gactgatgtcgataggcctgtcataactccagctggaccatctggtccatcttctcctcagtctgaagctggggagtccaatgtgtttcgccaggaaaaagatgctgcagtagatggggcaccatctgacactgatggagcagtggctgagacccgagaggaagaaacgacagagaatgttggtgaagcgacatttagctatgaccgcttgatatctaaatctaccgatccagtccgtgggatagattacaaacgcagagaggcatacttatcagatagtgagttccaaagtgtttttggcatgaccaaggatgcattctaccgaca

SEQ ID NO: 54925 - DNA, 301 bp, Zea mays
  Clone ID: LIB3068-020-Q1-K1-H11
tcccattcttgcaccggggtcattggactatgattactgaaccagtgcgaggtaggctctgtgataaacctccaatttatgacatatatgctcctgacttgtacattccattaatggcatttggtacctatgttgttcttgctggcatctcattgggtctttgtggaaagtttagtactgaagctttgaactgtttatgtatcaagggattggttggttggtttatgcatacagcactgctttaagttactatactttcattactcaatgtggaagctcctttattggacattatagctta

SEQ ID NO: 54926 - DNA, 89 bp, Zea mays
  Clone ID: LIB3068-021-Q1-K1-B6
tcgcgcccaagccgaccccaccgacgtacacccctttccccaagccttcgacacctaaaccgaccccggctacctacacttcaagccct

SEQ ID NO: 54927 - DNA, 285 bp, Zea mays
  unsure at all n locations
  Clone ID: LIB3068-021-Q1-K1-B7
cggacccgtggccggcaccctggccaacaggttcctcgggaaggacggcccgcagctgttccgccgacgtctctggtccaacgggcccgagacggcgtcgcccacgctgcaggacaagcagtgcgccggcaaggccttcgtcgtgctcatcgcgcgccttctcgtcgccgagctctttctncgctacgactncttcgacgtncaggtcggcgcctccgggctggggtcgtcggtcaccatcacctcgctcaagaaagccaccttctgangtatgagctctgatcg

SEQ ID NO: 54928 - DNA, 421 bp, Zea mays
  Clone ID: LIB3068-021-Q1-K1-B9
cccacgcgtccggaaagaaagcccttttcctttttaacaaaattctttctatttctaccgggtcaaggtattcatcattctagtacaactattgcagtagaatgacaacagactcgtgtatagggaactagattagcttagctacctatctaatttattgtagaaattccgggatccgcgattggacatggaaaatagaaaaactttttcttggttaaaggaacagatgattcgatcgatttctgtatcgatcatgatatacgtaataactcgcacatctatttcaaacgcatatcccatttttgcgcagcagggttatgaaaacccgcgggaagcaactggacgaattgtatgtgccaattgccatttaactaataagcctgtggatattgaagttccccaagcagtgctttctgatact

SEQ ID NO: 54929 - DNA, 245 bp, Zea mays
  Clone ID: LIB3068-020-Q1-K1-E10
ctgacgcctttactctgtctatctctacgctttattccttgaaatccactcatgtatccagggtactttattacataccgtggagacattaaccatgtttattcatctctctacatgctcgtatagattttcgaaatataaaaccacttcttaattccattcactacaccaccatcttttactacctcaaacttttccacatctctatcactactaccacctttatattcaactttcatactgtc

SEQ ID NO: 54930 - DNA, 419 bp, Zea mays
  Clone ID: LIB3068-020-Q1-K1-E2
cccacgcgtccgccgaccgcgccgcggggtggctccccggatacggcctgaccacgggcagcatcaacggtggtctagagtgcggcgaggaccgctccaccgacggcgccaaagccgccaaggaccgggtcggctactacaagaggtactgcggtatgctcggagtggggtacggggacaacatggcatgcgggagccagaagccttacggaggatgatgacactagtagctgatctatggttgctgcaatgcaagccttcacgtgtgtttgcctctctacctaaagaataaatcaagctagcagcaaacctaccttcggcgtgtgtctacttgcttatcatagtgtgtgtccgtgtatgagagatgatgtactgtcacgaactcacgtgtgtatgagagaggattcatggtaagacta

SEQ ID NO: 54931 - DNA, 93 bp, Zea mays
  Clone ID: LIB3068-020-Q1-K1-E7
cccactcgtccgcccactcgtacgcccactcttcctcaaaatggctccgccagactgtccgtggggtttgccttcctcatggagatgatagtc

SEQ ID NO: 54932 - DNA, 446 bp, Zea mays
  Clone ID: LIB3068-020-Q1-K1-E9
cggacgcgtgggtttttgaaacaggaaagcaataaacagcaaaaaaaaaagaattgatatcgcatattttacagttaccttgcagttctcgtactctgcagtcattttctcactgtctgttacaaagtacggagagatgtaaccacggtcaaattgcattccctccacaacatagagaaagttctcagaactcttcccctcttcaagggtgacaacgcccttccgaccgaccttgctcatggcctctgctatcatgttaccaatttcatagttgttgccagcactaactgcagcaacatctgcaagctcactatcttcaacctccttagacaacttccttagttcttcaactagtgctttagctgttttctcaataccacgagtaatctgaacaggattagcaccagctgccacgacctggacaagacagtttttagctgaaaaca

SEQ ID NO: 54933 - DNA, 55 bp, Zea mays
  Clone ID: LIB3068-020-Q1-K1-F1
actcgttcgcggacgcgtgattcgacccatgcattctgttctacaacaagatgtc

SEQ ID NO: 54934 - DNA, 217 bp, Zea mays
  Clone ID: LIB3068-020-Q1-K1-F11
cccacgcgtccgctcactcacactctaactcgaatactaacacttacaaacacacatacgcggcgcatatcaaccactcaaacactcaaacaatcaaaaaataatatttataaccaaaaacaatacccattatcactgctcttcttgctttcaccctacttgtctaacatattatctattactataccaatataaatacctctacctccaaatactt

SEQ ID NO: 54935 - DNA, 401 bp, Zea mays
  Clone ID: LIB3068-020-Q1-K1-F2
gcaggatggcactcctccttggcttgctgctgctagtagtagcttcgcccgcgatcgctggtgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgactggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagact

SEQ ID NO: 54936 - DNA, 272 bp, Zea mays
  Clone ID: LIB3068-020-Q1-K1-F3
cgcccttgtccgtaccagttctgagtcggttgttcgacgcccggggaaggcccccgggggggccgttcccggtccgtcccccggccggcacgcggcggcccgctctcgccgcacgagcagctcgagcattccgccagcagccgacgggttcggggccgggacccccgagcccaaccctcagagccaatccttttcccgaagttactgatccgttttgtcgacttcctttgcctacattgtttcattgtccattaggtagttcactttgtata

SEQ ID NO: 54937 - DNA, 390 bp, Zea mays
  Clone ID: LIB3068-020-Q1-K1-F4
caatacttgtgagctttcctcctggcacaatcgaaccaagtatggctggcctcgctgtaggatatggacttaatttaaatgctcgcatgtcaagatggatattgagcttctgtaaattagagaacaggataatctctgttgagcgcatttatcaatattgcaggcttcctagtgaagcaccattgattattgagaactgccgtccaccatcatcatggcctcagaatggaaacattgaactgattgatctcaaggtccgctacaaggacgatctaccattagttcttcatggtgtaagttgtatgtttcctggcgggaaaaagattgggattgtatggcgtactggaagcggtaaatctactcttattcaggcccttttccgtctaattg

SEQ ID NO: 54938 - DNA, 460 bp, Zea mays
  Clone ID: LIB3068-020-Q1-K1-F8
atcacacgtccacagacgcgttcgactacgcgtgctggactgcgcgagcgagcgagatggggtggacgacggtggagacgagggacggcgcgaagctgaacgtgcggctgttcaagccccccgcgtacggaacggggttggagccggagccgagggaggacgtggcggtggtgctggtgcatccctacaccatcctcggcggcgtgcagggcctgctgcgggggatggcggagggcgtctcgcggcggggttacaccgccgtcaccttcgacatgcgcggcgcgggccggtccacggggcgggcgtcgctcacgggctccaccgaagtcggggacgtcgtcggcgtctgccgatgggtcgcagagaacatcaagccgcgcggcatacttctcgtcggatcctcaactggagcaccaattgccggatctgcaatttgataagtggatgaagtgattggtta

SEQ ID NO: 54939 - DNA, 222 bp, Zea mays
  Clone ID: LIB3068-020-Q1-K1-F9
tcccactcttccgttaactcacactctaactttaattctagcattaaaaaatacaactaaaagaaaaattataaaaaaattaaacactaaaaaaaaataaaaataaaataaatataaatacaacacacacattaacatacaaattattactttcaccatataaataatctcatattatcttaatcatattactaatataaatattctcttccatttaattac

SEQ ID NO: 54940 - DNA, 186 bp, Zea mays
  Clone ID: LIB3068-020-Q1-K1-G10
taccaggcctacatccactcatccacataatttttcattattaggttttcttaattgtttgtgatagccataaaaacaaaggtcgccaaatcgcaaatcatattctattcttccacctcaacactatctccaatatcccttcaatctcctttataacttatcattctaatcctttccttatttctt

SEQ ID NO: 54941 - DNA, 377 bp, Zea mays
  Clone ID: LIB3068-020-Q1-K1-G11
aaaaagcatacaaaaacaacatacaaaaaaactaacaataaaagaaaaaatagataaaaaagagtggaaataaaaaaaaaagagaagggaaatggcaaaggataattcgattcttcgacctcaacacgggcgccaagatcccttcagtcggcttgggaacttggcattctgatcctgtccttgttgctgaagccgtcgcggctggccatcaaggttggttaccgccacattgattgtgctcaaatctatggcaatgagaaggagattggctctttgttgaagaatctgtttgaggagggtgtagtgtagcgcgaggatttgtggattacatctaaactctggaatactgatcatgcttcataagatgtaccactggc

SEQ ID NO: 54942 - DNA, 231 bp, Zea mays
  Clone ID: LIB3068-020-Q1-K1-G4
aaaaaaaaaaaaaaaaaaaaaaaaaaaaaattaaaaaaaaaaaaaaaaaaaaaaaaaaaagagaaaggtaaaaaacactaaaaaggttccgactctaaaacgcccttccttgccatgctatttcttttctatcgtgtcgcctaatctaatttcactgccctcttcgtttacttcggtaacccctgtattgtcccttgctttgccccatcttattcgtttcgcttcccatcc

SEQ ID NO: 54943 - DNA, 277 bp, Zea mays
  Clone ID: LIB3068-020-Q1-K1-G7
ataacgactgagacagacgcatgagcagactctggtttcgaaaaacagaatcaaactaacttgtagggtttaaaaaaacacaagaaaaatgatataaaaagggctcaccgttctacagcatccaagttttctaacacatgttcaaaacccaatgaatttttccaacctgacaccgaatttcaactgaatgggcccggataaacacggcctggattctaaaaaccgtggcattgccccacttaatccccttggagtaaatcccctatcgtcaaatttg

SEQ ID NO: 54944 - DNA, 244 bp, Zea mays
  Clone ID: LIB3068-020-Q1-K1-D9
agtgaatcaatttccatgtctgaatattatcgaccaaagaaactgcgttcacaaattctatacttatcactagcgttccttcttggacccacaacacaacaatgtttcacacacagctggtggatcgttatacccaaatcgattctctagcagcaaatttatgtgatgttgtgacacatatacctactgtcgataaagttgccatagccaatgcaaatcttcaacacccataactccatcttca

SEQ ID NO: 54945 - DNA, 453 bp, Zea mays
  Clone ID: LIB3068-020-Q1-K1-G8
tcgttagccacgcgttcgcggacgcgtgggcttacggtctggttactttttgtgggcaatgagttggtatggctctggacttctaatcacatatgttgcgctgaacctgatggatgggcatggacaacctgcccttttgtacatcgtgcccttcactcttggcaccttgatcgcgcttggatggaagagaggggagctgcagaacctgtgggcgaggggagagccagagagagtgtgcacgcatatgcatatgccgctgctgccgacgaccccaaactaaccacagggtcagtagaaaatcagcaagggttcctagcttctgcaaaatattgtatttgcctgctggtaatatgcaaaccaaattaatgccagtttaaaatgaggcacctgcttcttggagaccgcaaagtctgattgtgagctaactgcttgccaatgtgccttcattcatgt

SEQ ID NO: 54946 - DNA, 354 bp, Zea mays
  Clone ID: LIB3068-020-Q1-K1-G9
ccctcgcctacattgatgcattggccaaatctctgcataccttggagacctgaatgcggttgagtgagacaaaccagacgtggacggaatatggcacttgatattctcaaggtccacctcaagaccaccgcacacatccctatatgcggctctctaacttgcgatggtcattatgtccttgtgaatcaattccacggttggcccatcaatgatcattaccgatacatctattgtactcaaatgtatgcgtatgagaacttgataacctcttcgtttgacaatctgttccaggtcggtatatcgtaacccgaggatctgtggattacatctaaactctggaatacttgatcatgc

SEQ ID NO: 54947 - DNA, 270 bp, Zea mays
  Clone ID: LIB3068-020-Q1-K1-H10
aaactgattggcaccaggccccaaaagcggacgtatctgaaccatgcgaaacaggtccccgtgaggatcaagctgatgaggaggatgattctccaatatgtctcgttgaatacgacacagaaaatgcacattcggtcacctactgccagcatcattggcatctctggtgcatactctcatggatggacaggcgcgtgacatgcccagtctgtgaccagataactctgacagacaggatgtacgaatagcactctaggctgatgatcctgc

SEQ ID NO: 54948 - DNA, 388 bp, Zea mays
  Clone ID: LIB3068-020-Q1-K1-B7
cccacgcgtccgtcatgatttcatccatattggatcaattattgataccattttgcaacggaatgtgaggaatgttatggttaaacttccttatatacgatgtggtacaaagcaacgtgcgacttgtatgacatgatcgattgtggatttgcctatccatcattttacatagtaatgaaaatgctcttggcttgacatactatgttctattcgtactgaaccgaattttcgctgggttgtatgtgagtaaagtagatagtacacgatggacctcgataggacataatttctttttgatctagggaaagaatctatggttagtgaaaactaatatattaggccaactttgtaagtctattcttaatatataaatcaaaaggttaaaata

SEQ ID NO: 54949 - DNA, 399 bp, Zea mays
  Clone ID: LIB3068-020-Q1-K1-B9
cccacgcgtccgcccacgcgtccgcccactctttctcccacgcgtccgatttgcaaaggaatgagtttttcatttgccaatcgaccttcttcaaccctctagatcgaaaggccaattttttttttcttttagtttttgttattatttcgcattctttttaccttttcaattcttcaaaaattctctcgactgaattcacgtcagaacacggaatcataaagatcaattttttgcatcgtttttattaaaatttgtttgctaacaaaacatagaaataaaaaccaaaaaattgaaattccttatccgttttggcgaattgaactgcttgttcaattgtgtttgttgaattctatgcttatggaacctcttttgtactatgatattcttattcttcttgtt

SEQ ID NO: 54950 - DNA, 414 bp, Zea mays
  Clone ID: LIB3068-020-Q1-K1-C10
cccacgcgttcggccacgcgtacgcggactcgtgggctcgcgcggcgaccacccgattcggggcgtgcggagagaccgaagaagcgggagagatggctcgtaccaagcagactgctggcaagtccacgggagggaaggctcccaggaagcagcttgccaccaaggctgaccgtaagtctgcccccaccactggtggagtgaagaagcctcaccgttaccgtcctggaactgttgccctccgtgagatccgcaagtatcagaagagcactgagctgctgatcaggaagctgcccttccagaggctcggcagggaaattgcacaggactttcaaaactgatttgcgtttccagagccatgcggtgcttggccttcaagaggctgctgaggcataccttgttggtctgtttgaagac

SEQ ID NO: 54951 - DNA, 273 bp, Zea mays
  Clone ID: LIB3068-020-Q1-K1-C11
gccagatcagttgggaagggagcttcgaggctggtcgtcctgacacgtggttcaagcgcgcggagctaatggcactggccgttggggcgcatacgccctaacatggatcgaatcgttcggtaagcagaagctccatatgctagattggattctcacttaaaggcatatatatctaatacctctcacaggagctacgcaccactttatgttgaatctagcgcgatgaccaatagtgtgaatcaactgttgctatgagactacgtggaatcacta

SEQ ID NO: 54952 - DNA, 422 bp, Zea mays
  Clone ID: LIB3068-020-Q1-K1-C2
agaaaccagtcattgtcgctacaaatatgttggaaagcatgattgaccatcctactgccacgtggggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccgcaagccagctaagtaaaatgttctgatctcatgcatcgatgatggccaacacccttcgcacaccaatcattgtatttacacagacaggctccatggctgttctcctgagccactatccgtccttgtctacactatttgcatttacaaa

SEQ ID NO: 54953 - DNA, 455 bp, Zea mays
  Clone ID: LIB3068-020-Q1-K1-C3
ggtgtctcgtggcggcggcggcctctggggcagggttgcaggtgccgccgcggcgggctggaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcggtctgggtcccttgtggctcgtcgacattgccaacatgtgcctcatcctccacctgatcggtgcataccatgtatacgctcagcctgtcttcgctattggtgagaggtgggccgtctcacgggggccagaagcccaagtcatgagcagcgcataca

SEQ ID NO: 54954 - DNA, 134 bp, Zea mays
  Clone ID: LIB3068-020-Q1-K1-C4
acaaacaaaaacacataaaaaaaaaatctattactaatcctaataacaaaaaaaaaaatgaaggattctattaaatcaagaacggcaacaataaaaagcttctcgcactttcccaccgtttctcctccctttgg

SEQ ID NO: 54955 - DNA, 398 bp, Zea mays
  Clone ID: LIB3068-020-Q1-K1-C6
cccacgcgtccgcccacgcgtccggcaaaacctcctcctagtcctctcgcagaaggaggctgtgggcttttcttcatcggcgcggcaacagcgaaagcttctcggtctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaagtcaatgatctactgcagatcagatgcggcatcattgggcttatcatgcgaccgtaat

SEQ ID NO: 54956 - DNA, 103 bp, Zea mays
  Clone ID: LIB3068-020-Q1-K1-C8
cccacgcgtccgagttgctgcacttaacctttactttggcggcctgaaatctggtgtgagggctggtgttatttgagatccagcaagacctggtcagaagtgg

SEQ ID NO: 54957 - DNA, 334 bp, Zea mays
  Clone ID: LIB3068-020-Q1-K1-C9
cccactcattctgcacgcgtcctcataactagttgtgctcactatttagataaagagcaaggagctctaatttatttttggttttttgaatattcctaattattaaattaattcttgtctatgccagaatatttatatgtctcatttcatttccttgtgaagggatattatcttaaagctggaatatggtatattcatcatattatgtttaatctaggttgacccttgatatgaaataaatcatattgtcaggagaatacttgtgtgcacccccatcctctgacctagatgtgttactcatttctgaccttgctcagaataaaaaattcttacc

SEQ ID NO: 54958 - DNA, 406 bp, Zea mays
  Clone ID: LIB3068-020-Q1-K1-D1
caggttttaatctttctgggttttttgaggataagtatggtctcagggaagagagagttagtaccagacagcctgtaacaacagtatttacaaagctgaaggagcttgccaaacgcctaaagttgagggtcaagaagaaagaaaatgggaccttgaaattggcagctccgaaggaaggaaagaagggtatgcttgagcttgatgcatagatttttgaggttgctccttctttgctcttagttgagttgaaaaaaaccaatggggacacgctggagtatcaaaagctagtgaaagaggagataaggccggcactgaaggatattgtttgggtttggcaagatgatcaacaccagtgctcacaatcaccagagtctctattatcaccaccggagacacaagatgaatt

SEQ ID NO: 54959 - DNA, 391 bp, Zea mays
  Clone ID: LIB3068-020-Q1-K1-D2
cccacgcgtccgcggcgcgtgggtctggacaaaaaatgctgctaatgaagctgctcggataagcatcgggaagcagtggaaggaatttctggattacaaggactccattggattcattgttcatgacgatgcaaagaagatggacaagggactgaagaaccgttacacggtttgatcccaaagagtagtagcatgtagggtggttctatccgattccgtagcaccttgcagagtgtgttgaaggttctctatttgctgaggagttgcttaagcataatctaacatgatgtcgaatgtattcctgtatgttccatatgtcagtcacctaggtgttgtttttgtctcagcgctgtgtgctatatatatatatatatatatatatatattggat

SEQ ID NO: 54960 - DNA, 445 bp, Zea mays
  Clone ID: LIB3068-020-Q1-K1-D3
gtccccagacgagcggttggagcttcgacgtgcggtttccatttccttccctgctgggatggccgtcgccgaagtggcgatcgagattctcccgcagcagcagcagcagcagccgccgccgtcgcagccgcgggaaccggcggtagcgcccccgaacctctccgtgccgagagtgctccagtatctgtacctcttgagcgcgtgggtcgcctgcgcgggcgtggctgccgggaccgtggcgcgccgggccttgggcgactcttccccgttggtctacgggttcctcaaagtctcgatcggagccctcgttttacccgcgctgctcatcctcgtcttcgccctgcgggtcttgcgcgccatgcttgcggtggggttcagacggtcactccgcactcacgccagggagattcagatccatgccacgaagattttagagcgttaacgt

SEQ ID NO: 54961 - DNA, 458 bp, Zea mays
  unsure at all n locations
  Clone ID: LIB3068-020-Q1-K1-D5
acttcatagagcaaggttaattcttgagcatgcagataggatgggctgcaaaaggtacctgactccaaaagacatagttgatggtttacccaatctaaatcttgccttcgtggctcatattttccaaaaaagaaatgggttgtccaaacaaatgaaacaagtttcctttgtggatggactctctgatgatgctcaagtttccagggaagaaaggtcattccggctgtggattaacagccttggaatttcaacttacatcaacaatgtgtttgaagaccttagaaatggatgggttctccttgaggtgattgacaagattgctccaggctcagttaattggaagatggcaaatcgcccaccaatcaaattaccattcaggaaagttgaaaactgcaatcaagttttgaagattggaaaagaactaaaattttctttggtgaatattgctgganatgata

SEQ ID NO: 54962 - DNA, 287 bp, Zea mays
  Clone ID: LIB3068-020-Q1-K1-D8
aaaacacatagcaaggataaattattgagcatgcagatcggataggcatgaaaaaagtaccggactgcaatagacttcattgtgggtttaccctaactaatatcttgccattcgtggctcatattctccagaagagatatggcatgatcaagcaaatgtaacaagtattcctttttggatggactctctgatgatgctcactttttcaaggttgaaaagtcatttctgctgttgattatctggcttttattttcactttctataacattgtgtttagaagacctttt

SEQ ID NO: 54963 - DNA, 460 bp, Zea mays
  Clone ID: LIB3068-020-Q1-K1-B6
cccacgcgtccgtcatgattccatccatattggatcaattctcgataccattttgcaatgaaattagaggaatgttatggtaaaacttcgtttaaaacgatgtggtagaaagcaacgtgcgacttgaaggacatgatcgattgtggatttgcctatccatcattttccatagtaatgaaaatgctcttggctcgacatagtctgttctattcgtcccgaaccgaattttcgctgggttgtttgtaagtaaagtaaatagtacacgatggagctcgagaggacagaatttctttttgatcaagggaaagaatctagggttagtgaaaactaataaattaggccaactttgtcagtctatccttaatatagaaatcaaaaggttaaaataagaaaaagtctaatttttggaagattggaaaaacttttttgatgaaaagtctatcttgatcaattgttcata

SEQ ID NO: 54964 - DNA, 421 bp, Zea mays
  Clone ID: LIB3068-006-Q1-K1-E6
cccacgcgtccgaaaaagaaaaggcaaaggcaaaggaatcccaatcaggcaagcaaaagggagaaccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcgggtccatcggcaagcaggtgtggtacgacagggaagtgacggcgttcgtggagccggggcggatgcacggcctcgccggggtgaagagcaaggagctcctcatctgggtcaccatctccgagatcg

SEQ ID NO: 54965 - DNA, 444 bp, Zea mays
  Clone ID: LIB3068-006-Q1-K1-E9
gcatgcagtcgtgtaagtcctgcgatcctaactgattatgcactccaatgggctgccgaggacagaggggagaaatacactgacgagtgttaggtggacgtgggccatgttgctgctgctgacgaggcttcgcgacccatagtaaacgcatacaacagatgacctgactcgtccagctgcaggcggcgtcaggcttccgacgctacttctaactccgttcgcctccagtcgacaccgtgtcccgctggcacgcctgctcagcaggttaacacaatttggcccagtgcttaattgaatcctgcttgctgcactgcggacaaccatggcgtcgtcgaatctgcaaatgtctgctgacgacagcgtgctgctgctcattacccactccaatctgaccaccttcgcagctgacatgcgcgtattgcaacataccaccgtggaggcgct

SEQ ID NO: 54966 - DNA, 396 bp, Zea mays
  Clone ID: LIB3068-006-Q1-K1-F1
cagaatcgctgcgtcttcgttggcaacataccatacgatgcgacagaggagcagctcgtgtagatttgcgaagaggttggcccagtcgtatccttcaggttggtgattgacaaagagactggcaagccaaaaggttatggcttttgcgagtacaaggacgaggaaactgctctaagtgcacggcggaaccttcagggttacgagatcaatggtcgtcagttacgggttgattttgctgaaaatgggaggaacactgacagaaatagagaaaaggtcgacgatcctcaaatttttactgtagaagagcctttcctaccacctttggagttctctgttaatctgagaagttgtattgtcttcgttctgtgaatgataatagttgcgccttcttcaacc

SEQ ID NO: 54967 - DNA, 427 bp, Zea mays
  Clone ID: LIB3068-006-Q1-K1-F12
tcgcccacgcgtccgcccacgcgtccgctccagcactgaacacttgattgattcagtaggtaggtagctagctgaatcacaatggatcctaccaagttccgtccgtccagtagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggccttcgccaagggcttcttcgagtgcacccacgacgtgacgtcgctgacgtgcgccgacttcctgcgcgcgcccggcgtgcggacgcccgtgatcgtgcgcttctcgacggtgatccacgagcggtggtccccggagacga

SEQ ID NO: 54968 - DNA, 407 bp, Zea mays
  Clone ID: LIB3068-006-Q1-K1-F4
gagcgacccacgtccacacgacacgaaccaccaccaccaaccagcagccgcaccacgcagccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgtcaaggtctgccacaactgagcacgcccgcgttgcatgc

SEQ ID NO: 54969 - DNA, 434 bp, Zea mays
  Clone ID: LIB3068-006-Q1-K1-F5
cgacgctcagccgctcaggaatcgaaggagcgacgaagctaaaggagggcgcatcgaaggcgaattgaagcatgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtatccggtccttcatggctaccacactttggtagtcatttatcgtgacggttggagctaca

SEQ ID NO: 54970 - DNA, 432 bp, Zea mays
  unsure at all n locations
  Clone ID: LIB3068-006-Q1-K1-F6
cggacgcgtggcggacgcgtgggttactggactgatgatgggcttggatattatgagtggcttcagcttgcggaggacctgggtgctgccccaatctgggtattcaacaatggaataagccacaatgatgaagttgatactgtagctattgccccttttgtaaaggatgtattggacagtctggaatttgcaagggggagtgcagattcaacatggggctctgttagggctgcaatggggcaccctgaacctttcctggtcaaacatgtcgcaattggaaatgaagattgcgggaaaaagttctaccgtggtaattacctcaaattctacaatgctataagagaggcctatccagacattcagatgatttcaaactgtgatggttcatctagaccacttgaccatcctgcggatntgtatgatttccatgtc

SEQ ID NO: 54971 - DNA, 429 bp, Zea mays
  unsure at all n locations
  Clone ID: LIB3068-006-Q1-K1-F8
acttctacgagaacggcctcacgggcacggatgacgaggcgttcgagcagtcttgcaccgatatctacacggggaagagcctgcagaagccgtggtacctggtgctgggaaaccatgactacaggggtgacgcgctcgcgcagctgagcccggtcctgcggaagatcgacagccggttcatctgcatgaaatccttcgtcgtcaacgcagaaatcgtggagttcttcttcgttgacaccaccacgtttcaactcaagtactggactcaccctaaggatgatcactacgactggagaggggtggcgcctcgggaaaaatacataaacaatctgctcaaggatttggacggngccatcaagagatcgactgcggcgtggaaggttgccgtgggccaccataccatgaggagtgtcagtgatcatggtgaca

SEQ ID NO: 54972 - DNA, 374 bp, Zea mays
  Clone ID: LIB3068-006-Q1-K1-F9
caaatgctttcagagaagctataattggtaacactcttgatcttacagcagcccatcagaggataggtctcacgacacaatgacaggtcctactaatgaaacagacttattatcccatattcgacacttatatcgagcttgacattggtgaccacacatgcgatgatcaccacaagctattacttgcatatctagggattccaccctatgaactgtccccaggttgatcctacaatggtcacacatcattcagatgatctgctcaaagctcgagatgaaacgctccgtaccgaccagatacaacttataccggttctcactgatctcacgtgcgtacactcgccatttcgatcgtatgatcaccatcatatctc

SEQ ID NO: 54973 - DNA, 435 bp, Zea mays
  Clone ID: LIB3068-006-Q1-K1-G1
cggacgcgtgggtctgtattatcaacctagcaacgcttcaagtgccggtatgctatcttggtgcgtgccatctgttagatttttctgttcttttaacaaccctttggtattactatattaggagatcctcggtgactgtggccgagctgcaatccagacacaaggctccatgaacaatccatttggatcaacttttgtatatggttatcagaatatcgctttcgaggtgatgaaaaacggatatattgcaactgtcaccctcttccaatcatgagtgtgccactacatgtgctgctgctctgagctctggctgcaacaatggtggttaacctgcagaaaggaagtatgccgtacttttgtgcttcagcagcagcaatttcgagtcgaagccaactctatggggcctggtgacggtgcttggtttatggaatggga

SEQ ID NO: 54974 - DNA, 219 bp, Zea mays
  Clone ID: LIB3068-006-Q1-K1-G10
ggttcgatcgcaagcgccgtcggctgctcgaccaccagttgcggctcggcgatcgcgacggctttgcgcggctcggctacggcgcgccgtccgacgcgcagatgttcatcaagggctggctgttctatccgtacggcgcgccgttgccgccggtggccgccgaaatcgcgccggatcacccgcgcggtttctggctgacgcacgcgcagtggccggcgt

SEQ ID NO: 54975 - DNA, 364 bp, Zea mays
  unsure at all n locations
  Clone ID: LIB3068-006-Q1-K1-G11
gcggccggctgcagccggcgatcgggcatgcgaagggtggagccgggtggcggaccagccggccgcgtcgggaggcagcagcggcgggcggtggcgggatcgtcgccatcatcatcagcagcagcaggagctggtgctgcgtcggctgctgccgatcaacaaggccaaggcgtgccggttcaagcgcagctgcttcagcgaggaggacgacgccgtctncttcgccatgcttctgctcgcctgcgtcgtctgcgccccctccctttgatggtgataaaaatacttttgattactttggccgcctgcttgtaactaatcaacatgtggatcaccatgtgatgccatgacccatgcatgtcagtct

SEQ ID NO: 54976 - DNA, 435 bp, Zea mays
  Clone ID: LIB3068-006-Q1-K1-G12
atggtcgtttcattctgtctccgcttagaaaaggtcaagcggatactgtcggtattgccgtgcgaagagctttacttggagaaatagaaggaacatgtatcacacgcgccaaatttgggaacgtgccacatgaatattccacaatagtaggtattgaagaatccatacaagaaattttactaaatttgaaagaaattgtattgagaagtaatctctatggagttagagacgcatcaatttgcgtcaaaggtcctagatacataaccgctcaagatataatcttaccgccttccgtagaaatcgttgatacgacacaacctatagctaacttgagagaacccgttgatttctgtattgagttacagatcaagagagatcgcgcatatcatacggaactcagaaagaactctcaagatggaaagtatcctatagatg

SEQ ID NO: 54977 - DNA, 421 bp, Zea mays
  unsure at all n locations
  Clone ID: LIB3068-006-Q1-K1-G2
cagggtgtcccggccctctctagtttctaccccggcccccaacattggcctgatgctggggccatgtagcccagcggtcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgtgggagagaagatggtaatggagtgcgtgtgtatgtatgtgtatgcccagggcgcgcgcgcgcggctctgggcgagtcacagtagagatgcaatatcatgtatccagtatctttcttacaacacanacagtgagaaattattagtaaagtgtgcattgtggtgca

SEQ ID NO: 54978 - DNA, 435 bp, Zea mays
  Clone ID: LIB3068-006-Q1-K1-G3
gcgcagtactatcaactcattcgcctaggcttcgaggggtacagaaacatcatgcagaactgccaggagaacgccgcgatactgcgggagggcatcgcggcgacgggccgcttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgtcaccgtcgagcagtcgggcgacggcgtcgtggccaagaaaagc

SEQ ID NO: 54979 - DNA, 278 bp, Zea mays
  Clone ID: LIB3068-006-Q1-K1-G4
cccacgcgtccgcggacacgtgcacgaactcgtggccggtgcctgggggactaaatcaggggccgccagttctgaagagggctatggacaacctattcgtgttaatgaattggctgatcctctcgcacgttatgctgatctttcgacgctgtcactgctggctacggccttccagctgcggtgttattctgcgaggctctgatagggatgggccacatctcttcatgatagaaccctgacgagcttgctatacatactatactgctgcattcaccaag

SEQ ID NO: 54980 - DNA, 424 bp, Zea mays
  Clone ID: LIB3068-006-Q1-K1-C10
cccactcgtccggaaaaaacataatcaaaatacagaaaagttcactggtatcgtaagctgggcacattagatcacaacttttgcccctcttctctaaaacggaagctcatgttcatttcagcaattcagcttcaaccatttggcattcatgtaatatttcatacgagttaaagggctcatacctaatcaagtctgcgggtctccaattctgaaatacaaagataatttatgttctcatctttctgaaatgaacaagatgactggcttatgggttaaggtttttttatagagcaccatgacttatcaggtaaagttatagttgtgcacaaaatgtcattttttaatccttaatgcgtgtgctattcacacctgtcttctcttgcagttctgtgaacaaccctaacttatgtggtcctggcaccac

SEQ ID NO: 54981 - DNA, 446 bp, Zea mays
  Clone ID: LIB3068-006-Q1-K1-C12
cacaaacgccggcgcaaactctcgcccgagcccgacagatcttcaattccccattccgccgaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgtcagctcttccaccctgagcagctcatcagtggcaaggaggatgccgctaacaatttcg

SEQ ID NO: 54982 - DNA, 172 bp, Zea mays
  Clone ID: LIB3068-006-Q1-K1-C3
acgcccactcgtacgaccactcgtccgaccactcgttctcccactcgtccgaaaaaaaaaaaggaagggtaaaaaaaaaaagaaaggaaaaaaaaataataaaaaaaaaaaataaataataaaataaaactaaaatatataaaaaaatataaattaaaaatatattaataat

SEQ ID NO: 54983 - DNA, 435 bp, Zea mays
  Clone ID: LIB3068-006-Q1-K1-C5
cccacgcgtccgcccacgcgtccgcccacgcgtccgcccacgcgtccgctcaaactaacgccgggaatacacctaagagctactctttgaatatgttcaaagatttcgttcctatgtgtgttttctccgaatctaaccaagggaaactttcatgtgaaggaaaagtcgagcataaatttgacatggaacctcacagcgataatttggcgaactatggaaagttatgccgtgaaagaacacaaaagtacatggttaaatctagacaagtgcaggtacttgacaatgaccatggaatgagcatgaggccaatgcctggcattgttggtctcatatcttctagttcaaaggaaaagaagaagcaagcaccagtgaaaccatctgatgccaaaagaactcgtagggatcgcacggagatggaaaacgttattttcaagc

SEQ ID NO: 54984 - DNA, 293 bp, Zea mays
  Clone ID: LIB3068-006-Q1-K1-C6
taaaaaaaataaaaaaaaaaataaataaaattaaaaaaaaaaaaaataaaaataaaaagtaaagaaaaatataaaaataagtgaatgatctataaatatatttataaatatattaatttatcttttttttatccttttttatcttattttataatttttctattttaagttaattcttcctttttttttcacacttttcctttataaaaattattttcttattctattttaatttatattctttaaatatctcattttttcaatctttattctatacaattttttctactttt

SEQ ID NO: 54985 - DNA, 417 bp, Zea mays
  unsure at all n locations
  Clone ID: LIB3068-006-Q1-K1-C7
cccacgcgtccgcccacgcgtccgcccacgcgtccgcccacgcgtccgcggacgcgtgggggcgaccgcgagcagcggatctacctctggttcgaccccaccaaggagtaccactcctactccgtcctctggaacctctacatgatcgcgttcttcgtggacgacgtgccgatccgggtgttcaagaacacgagcgccgacctgggcgtgcggtacccgttcagccagccgatgaagctctactccagcctgtggaacgccgacgactgggcgacccgcggcgggcgcgagaagacggactggttcaacgcgcccttcgtcgcctcctaccgcggcttccacgtcgacggctgcgaggcctncgcggaggcgcgcttctgcgccacccagggcgcgcgctggtgggacccagccgag

SEQ ID NO: 54986 - DNA, 449 bp, Zea mays
  Clone ID: LIB3068-006-Q1-K1-C9
gattgaggtagttgatggtcctaatgatgagggtgaaatgttcacccgccctggtaaacggagcgatcgcttcccacagccttatgcaaacgagcaagcagcccggtttgctaatggtggtgcataccctccggaccttagtctcatcacaaaggcaaggcacaatggtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaagatggtacacctgcaactgaagcccagatgggtaaggatgtcgtatcattcctttcgtgggcagcttgacctgagatggaagagagaaagctgatgggagtgaaatggatctttctactatcactagcgcttc

SEQ ID NO: 54987 - DNA, 422 bp, Zea mays
  unsure at all n locations
  Clone ID: LIB3068-006-Q1-K1-D1
cccacgcgtccgctccaaggaagagactgtggaatacgtgcttgcactcattgatgaaatgcttgcaacaaatcctaagcgtgcagcactgttttatgatcaatctttgtcgggtgaagatatttatgaaccgttcttaaggttgttatggaaaggcaactggtttgtacaagaaaaaagttgtaagatattgactgttataattagtgcacgaccaaagcttcagaatggcacacttccaaatggagatgcttcgaattcgaagagcaagcttacttcaacacacgatgtattgagaggtttggttgattggctctgttcacagctgaggaatcctacacacccgagctgctctattcctacttctatccattgnctctccactttgctaagagaaccatatgttatgacattatttgttc

SEQ ID NO: 54988 - DNA, 414 bp, Zea mays
  Clone ID: LIB3068-006-Q1-K1-D3
cccacgcgtccgcccacgcgtccgcttgtaagtatccatatctattggtggtatcgcatggatggtttttttcaatggaatttaatacgcgcccacattgatgtttacaaaatgatgcttgagttgtgtgtacggcagtaacggcacgagcaaatatttatgttgctctacctcatatgcttaatgtgtaattcagtaaatatccattaatacagaccataatggaattactagaaacttatattctcatattgtgctatatttatattgatgttttcaatggttattacactttttatagaactttgggtagaggagctcatttgccattgttccctaatatgcagagtaaattgtcgagagccatttgagctaatttttagtcaaccacctgttcgagttagctgtttcttc

SEQ ID NO: 54989 - DNA, 428 bp, Zea mays
  Clone ID: LIB3068-006-Q1-K1-D5
atcaacacctgccgactgctgcaggcaagtaaaggtactcctctcctcccctctgctgcggtcctctgcccgctgcagatcatggaggaggaagcatggcaggagtgtctgcatgggtcctgagagtcgcgtgagcagcgaagcagttcacggatggttggatggagggcaatgaccagctgctgagctgctgctgctcctcctggtcgaccatcagtttgtatttgtccatgcctcgtgtagccggccgtcttcttgccctggcttgtccagttccggaaggcgggcaagcccggtgaggcgtggacagagaccggcaagtcagagatcggcaatagtgagctccagcaggagcctacttgtactccttatttacccgttttaaggttcccttcttcgtgctgttcctcgtcttcctttcgttcttc

SEQ ID NO: 54990 - DNA, 340 bp, Zea mays
  Clone ID: LIB3068-006-Q1-K1-D6
gcgatggccagatcaactacgaggagttcttcaaggtcatgatggccaagtgagtaaatgctgctgtaatggtatagtaaccccgctcggaaggaggaaaccgtgcgttgcatattagtaaggcaatgcaatgcagctcttgtttccttcttcccgtgaagaaaccgtactagctgtagctgctgaacgtttgagtccctctgctgccacccttatctccattgtgccgtctaacctccttgcttcccctgtgtgaatctgtacggattttcgtgttctgaacactgattgcagttgaatccagtttgtagttctatttgttcaaaaaaaaaaaatattt

SEQ ID NO: 54991 - DNA, 408 bp, Zea mays
  Clone ID: LIB3068-006-Q1-K1-D9
acttcttcaaactaacttggggttcgaagtactttgaggtgtggtacgaggggggcagttggaccctccctgcaacgccgtacgctacatctaccgcagagtcctcggcatcaaccacatgtaccacaagccggtatggagaaggcacacggcctgcactgatgactccccacacgaaggtccttctacagacgattccccatcgtggcagtgctccaccattcgatcctgaaaggatactgagctcactgtctacggtgctgaactctgtcgtcgctgttaactacaggcatgtgcttgtccacatgaagagccattcatacaggcttacgcagcgtattaccatgggcacaactcttctcgttctcagaatcattctgcacttatcgcatgcgatcccactcaaca

SEQ ID NO: 54992 - DNA, 331 bp, Zea mays
  Clone ID: LIB3068-006-Q1-K1-E1
aaaaaaaaaaaaaaaaaaaaaaaaaaaaatataaaaaaaaaaaaaaaaaaaaaaaaaaaaaaagaaagtaaaaaaaaaagggaagaaaaaaaaaaaaaaaaaaaaaaaaaaaaaaaaaaaaaaaaaaaaaaaaaaaaaaaaaaaaaaaaaaaaaaaaaaaaaatgggcttcctattttaaaaatccaaatttttattcacctttttattcatttataattttttataatgattccccaaattaatttaatatgtactttattattaaaactttttttctgaaaaaacccttccttacccaattataatatttttcaaaaaattcttttttt

SEQ ID NO: 54993 - DNA, 399 bp, Zea mays
  Clone ID: LIB3068-006-Q1-K1-E3
cgtcctcgcgctcagtgtcatttgcagttcccggcagcagccatggcgtcggtgcagctggctgggccgcgggtggtggcggctgcgaaaccggctgcgttgggcgggctcctcctgacgccgtcccttgcggtgccaaaggggcggagaaccagggggctcgtggtgagggccgccacggtcgtgtcacctaagtatacatccataaaaccattgggagacagagtacttgtgaagatcaagacctctgaggctaaatctgatggagggattttacttccagtatcagttcagacaagaccacaaggaggggaaattgttgcggttggagaagggagaagttttggaagtaaccgcattgagatcagtgttccggttggtgcacaagttgtctactcg

SEQ ID NO: 54994 - DNA, 436 bp, Zea mays
  Clone ID: LIB3068-006-Q1-K1-E4
gaagaaaagcgcatcacagggaatatctatgacacttttatactcatgttcttgtgtttggtgggtgcagcctacacaaatctggagtttgaacacacgacaggtgatatgcttatcttttgtggatggactgttcgcttggcttttgctgattgaattggagctgcacttgtagtttggtaacgtttatatacataactatgcggattgcgttacctagaatatgtcttccagtacctgggtgacaatgggctctaaattttagagtgttgtagatttgttttgttgcaaatgtggcatggcatggcttggcttgcagcttcgagtactggtcgttcgagatccttgtgctgtttgcagggctgatgcccgactctcatctcagcacttccatcattgcaatgtggtagttaacttaacttactctagctactat

SEQ ID NO: 54995 - DNA, 374 bp, Zea mays
  Clone ID: LIB3068-006-Q1-K1-C1
acgcccaacgtacgacactcataccatgattttcttaacatatctaatcctacaaattatctaccggtaaaaatttaagtgtgttaccatgatatctacttagacaaatatatcatctattaactatatatacatctctatccaattatcacattcatcatatacctttatatatacttcacttttcatagacatcctaattgatatattatttcatacaccaaatacgtcatccttataaaaaacaccacagtcaatgtttaatcttcttcaatacaacaactagttcacttacaactacattatcctttaaccatattatttacctattctaactttacattcttttactgtcaatctaaaataataatcat

SEQ ID NO: 54996 - DNA, 538 bp, Zea mays
  unsure at all n locations
  Clone ID: LIB3068-005-Q1-K1-G5
gcactgctactcggtccgtgtaattcccgggttcgactccacgtccgtctcgtgcttaatttcanntgtgaatccttccatgcccggatgtgcatgccctggaaacctatnnggttgctccgtgatgggccgaattggttttatntgannttttgggattggttggtcgtaatatttctccaagaaccttgggccagctatggagggtcttcttggcttttcttttgcaactgaggattatgatgnnctatggcctctgcccttctctgaaatgggtgctacagggaatgatataaatactaacgaatttgcaaaggacctgcgaaagatattctcatcgatacaggacttggatactgaaatcatagtggcaacagcaaggacccctgatgctacagcagtatctgctaatgttgtccttgatgagaggcagatgaatgctctatttcttgatctggtcaaggtgagcgagtcttacgggctgaagtttcctcgggagtttgctcttctcatgaagcagctgctgtattttgatcgc

SEQ ID NO: 54997 - DNA, 139 bp, Zea mays
  Clone ID: LIB3068-005-Q1-K1-G6
aaaaaaaaaaatgtttaatcctaccattcttattaacatactaaaaaaccaatataaggtgacggtatattctaataaattttataagattattatatatttatatcaaaatatcttcaataacattcaacaaataaaa

SEQ ID NO: 54998 - DNA, 62 bp, Zea mays
  Clone ID: LIB3068-005-Q1-K1-G7
aaaaaaaaaataattaaaaaaattcctaaatctacaaaaaaaaaaaaaactcaaaaacaaaa

SEQ ID NO: 54999 - DNA, 465 bp, Zea mays
  Clone ID: LIB3068-005-Q1-K1-H1
ccagcagtcaccactcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgtcagcaccgtcgtcgacaggcgcgccgtctgcaactgcctcaagaacgccgtcaggggcgtcagcggcctcaacgccggcaacgccgtcagcatcctcttcaagtgcggcgtcagcatcccctacaccatcagcaccttcaccgactgctccagggtgaactaaaacctagaccacgcgcgacga

SEQ ID NO: 55000 - DNA, 152 bp, Zea mays
  Clone ID: LIB3068-005-Q1-K1-H11
tccacgcatgcggtctggtaattgtaatgagtactttctaaatcccttaacgagtatccatggaagacgcatgtctgatgccagcagccacaggaaaaatagttactatagcgtatacttaacttgtagcatttaagaagctcaaagatgca

SEQ ID NO: 55001 - DNA, 428 bp, Zea mays
  Clone ID: LIB3068-005-Q1-K1-H9
tcgtttcagcgattgtctacataccttactatgtcattgcattcaacatcgcggcttcctaactgaggcatgcctactactgctttgagtccaccagcaacttatttgcatcgagtctgcattagaggcttgactcctccaaattaaactcggcgcacctttgctacaatttcagctcgatgcctacatgaactcgtcgctgtcactgctcttacaatctacgccttcttcgctctactcatatctcgatgatcgcatagactgacacaagacctcactcagatccagcaagaaactccatggaaaccaatgctggtatctgttctactttctgtacctgctaggtttgatacgataccactgactacgacaatacattctctgtttacgatcaacatgagtagacaaatatatgatcacaatgactc

SEQ ID NO: 55002 - DNA, 383 bp, Zea mays
  Clone ID: LIB3068-006-Q1-K1-A1
gccggcatctcaccagaggtgtatgttgtactatgagcgtgacagtgtggctaagtcactgtggcgagttttctgcagcagtaaatatatgatgtaatgttcattagttatcaatgtgctatgattttctttttgttgtcttattttcgatacatgtaaatgtcgaataactagccgtgagaattgagagttcaagcctatagagcttgatatgtttgatcaaagtaaatgtatcttcttaaaaacatgaaagtcaggtgctttctttttttatcctctataaaaagcacaaagtgatggtgatggttttctgtaaaaaaaaaaatatttatatctcattcattatcttaactttttacaatacatttataatttgttatttt

SEQ ID NO: 55003 - DNA, 300 bp, Zea mays
  Clone ID: LIB3068-006-Q1-K1-A10
gtctgacaacacagagcaattcttgataactagacacacaagggctttgacatcatcccagagcatacatgaggcgcgttagaccgcaagcgaagcaggctcccgcattgctctgagaccttcggcctcctacggatccactctgcacatgcacatagctgaggctaatctcttgtatgaaacaccatatgtatcatggtgcttgcagaattaactatctacaatgctaactgtgtctctcttaacagccttattaactgcttgcagtgcgcgatatgcgcgatgatgaccgaaaccttg

SEQ ID NO: 55004 - DNA, 451 bp, Zea mays
  Clone ID: LIB3068-006-Q1-K1-A11
ctctattatactgaggactgcccttgttgcgtcaactgtatgcattgcctttcttctgccgttctttggtcttgtgatggctctcattggatctcttcttagtatacttgtggcggtcataatgccagccctgtgcttcctgaagatcgcacaaaacaaagcaacctgtccacaggtgatcgcgagcgtcggtatcgtaatactgggcgtcgtcagcgccgcgctggggacctactcgtccgtgaaaaagatcgcagaaaactactaggcactggggacagtttctctccgcagaggctactaccacacggttgcacgtacgtccggccggagctggggaatggtcagggtttacgtacacgatctcaaagttttgctagaactaccgaaattccctgtagattattactggtatgattcggaccacaatagtctacttatacaaacaaaa

SEQ ID NO: 55005 - DNA, 332 bp, Zea mays
  Clone ID: LIB3068-006-Q1-K1-A12
tcttactctctcacatcacacacgcacttcctgaccactttacctacaagcataccctttcttacaccgatcattctcaatgtaactgatcacattgaatctcttacttacctacctgcttcccaaataataccatctcctaacttcctgaacacagcactcaacaaagcaacctgcacaaaggtgatccagaccgaccacatccgaatacatagcatactcagccccaagctctaaacctactcaccctcaaaatatatcgcataacactactatacactcgaaacactaatctatcccacaagctactaccacactgctaaacttacctc

SEQ ID NO: 55006 - DNA, 210 bp, Zea mays
  Clone ID: LIB3068-006-Q1-K1-A2
acgcccacgcgttcgaaaaaaaaaaaaaaaaataaaataaaaaaaaaaaaaaaaaaaaaaaaaagaaaaaaaaaaaaaaaaaggaaggaaaaaaaaaaaaaaaaaaaaaaaaaaaaaaaaaaaaaaaataaaaaaaaaaaaaataaaaaaaataaaaaataaaaaacaaaaatattctaactatataaaagatcttaatcacttatacta

SEQ ID NO: 55007 - DNA, 396 bp, Zea mays
  Clone ID: LIB3068-006-Q1-K1-A4
agagatcgtcgtccgcgctccgccgccgtcggagtcgcaggacacggcggggttcggtggcggcgcgccgtcgccgtcgaggtggcccaaggcggaggtgcacgcgctgatccagctgcgcacggagctggagacgcggtaccaggactccgggcccaagtgcccgctgtgggaggacatctcgtcggggatgcggcggctcgggtacaaccggagcgccaagcgctgcaaggagaagtgggagaacatcaacaagtacttcaagaaggtgaaggagagcaacaagaagcgccccgaggactccaagacctgcccctactaccaccagctcgacgcgctgtaccgcagcaaggcgctcgcgtcgtcgtcgtccgggcccggtgcagctccggcgct

SEQ ID NO: 55008 - DNA, 243 bp, Zea mays
  Clone ID: LIB3068-006-Q1-K1-A6
cccacgcgtccgaaaaaaaaaaaaaaaaataaaaaaaaaaaaaaaaaaaaaaaaaagagaaagaaaaaaaaaaaaaaaaaagaaaaaaaaaaaaaaaaaaaaaaaaaaaaaaaaaaaaaaaaaaaaaaaaaaaaaaaatcacactaaaaatacacactaaaaaaaaacaatattagaagtcataaaagaccaaaataaaatagaaaaacaaacaacatgaaaaaaccaaccaaggaaagaaca

SEQ ID NO: 55009 - DNA, 426 bp, Zea mays
  Clone ID: LIB3068-006-Q1-K1-A7
atttgcattaaaaaaaccgatcaaaaaaggacgagcgaagtaagtaatcgaaaaactttgttctttgttcgtcctatctataagaggagagcatatgaaaaatgtaacccattcttttgtttttttagctcactggccattcgctgggagtttcgggcttaataccgatattttagcaacaaatctaataaatctaactgtagtggttggtgtattgattgtttttggaaagggagtgtgtgcgagttgtctatttcaagaatagattggatctatccggctgcactttagaatatttttagtatttcatttgataaataagaaaaggtgcacgatctcgacgaattacttctgaataacttcagaaatcatatggaagaaccatagcatttcgcgattcattggtaaattcactttgaatctcta

SEQ ID NO: 55010 - DNA, 433 bp, Zea mays
  Clone ID: LIB3068-006-Q1-K1-A8
gcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatca

SEQ ID NO: 55011 - DNA, 342 bp, Zea mays
  Clone ID: LIB3068-005-Q1-K1-G11
cccacgcgttcgtctagttggagcacgcctgtcagtacccgcaagatggcgaactatgcctgagcgcggctaacccagaggaaactgtgctaccagctctacgcgctactgacgtgcagatcgttcgtctgacttgggtataatctccaaagactaatctaaccatatagtagctggctccctacaaaaactccctgatgatacctgtagcccacacgagtcctattgcgtaatgcccatgattaaaaagctcagaggcgcaacgccatcgacctattcttaaactttaaatcacatggactgcactgctgctatcttgaacactgcctcagtatcctaagc

SEQ ID NO: 55012 - DNA, 306 bp, Zea mays
  Clone ID: LIB3068-006-Q1-K1-A9
cggactcgtgggtactaccagaacgggaatgggaggttcagtcgcgtgaacaatggctccgagcaagctgtggccgcgtagaggcatcaaggcggtaggcttacatcaaactaggaagcataaggctacattcaagtgagctgagtgcaaggattattcttagtaggagcattgctgtcagacagcttggttatttttttttgtgccgtgttgggtcgctaagagattagtagttgcagtcgtccgaggatggtaggtgaattttgttgccgctgatgagcttgtctactgggtgttggaccatgg

SEQ ID NO: 55013 - DNA, 200 bp, Zea mays
  Clone ID: LIB3068-006-Q1-K1-B2
atcccttagtttggaggtgtggaggagctgtgtgagaaagtgtggttgaagagtgttgtttcgttgaagagaaaaaaaaaaaaaaaaaaaaaaaaaaaaaaaaaaaaaaaaaaaaaaaaaaaaaaaaaaaaaaaaaaaaataacaaaaaatcaataaatataaatcaaaaaaaactaaataaacaaaatacaaaataaaa

SEQ ID NO: 55014 - DNA, 95 bp, Zea mays
  Clone ID: LIB3068-006-Q1-K1-B5
aaaaaaaaaaaaaaaaaaaaaaaaaaaaattaaaaaaaaaaaaaaaaaaaaaaaaaggaaagataaaaaaaaaaaaaaagaaaaaaactacaaac

SEQ ID NO: 55015 - DNA, 426 bp, Zea mays
  Clone ID: LIB3068-006-Q1-K1-B6
cccacgcgtccgcggacgcgtgggttctacgagaggatatagagaggaagaacagctcggccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttcgttct

SEQ ID NO: 55016 - DNA, 403 bp, Zea mays
  Clone ID: LIB3068-051-Q1-K1-H11
cggacgcgtgggcggacgcgtgggccagaagagcttgcagttactgagagtgtgtgtgagagagaggatgggtggcagcggcagggctgctctgctgctggccctggtggtggtggccgtgagcctggccgtggagatccaggccgacgtcgggtacggttacggcggcgggtacaccccgacgccgacgccggccaccccgaccccgaagcccgagaagccccccaccaaggggccgaagccggacaagccgcccaaggagcacaagccgcccaaggagcacgggcccaagccggagaagccgcccaaggagcacaagccgacgccgtccacgtacaccccgagccccaaacccacgccgccgacgtacactcccaccccgacgccccccaagccgacgccc

SEQ ID NO: 55017 - DNA, 405 bp, Zea mays
  Clone ID: LIB3068-051-Q1-K1-H12
ctcggactgatgattggttttggtgtggtagaatttgatggcaactcctctgttatttgtgggaagatgagatgtagtttattggtgacaacaaaaaggtcaaggttataaaatccatctgaaaaggaccaggcaagactagaggggatgaataggtctgttataaaatttactcaaagcaatggttagtgataggtgcgccagttctaggaaaaaatgtactagcggtgcaacggttctaggcgcaactatgctactatcacaaaatagagcacctcatgaacataattcaaaatctacaacaagaaaagtatattgagtaaattactagtgttcccagtagtgtatagagactatttcatcacttttcctaggatggacgctctagcacaagtagataaagtg

SEQ ID NO: 55018 - DNA, 505 bp, Zea mays
  Clone ID: LIB3068-051-Q1-K1-H3
tctaaaaaaaataaaaaaaaaaatataaaaaaataaaaaaaaaaataaaaaaaaaataaaaaaaaaaaaagggtaatatttaaaattatggaaaataatttatttataatataattttttaaattttatttttatttatattcaattatattattattttaaattgtttattatttttaaatttctattctttttaatttttatttttcttttaattatattttttttatatttttatttcttttttaatttttaattttttttcctttttttactttcttttcctttttattctttttatttttttatttctatatttttttttataatttttccttttcttatttttttttcttttttttttttattatttttttatattttttttatttttttatttattattttttttttttattttttttttatctcattttttatttttttattattttttattattttttacttttatatttttttattttttttttttttttttttt

SEQ ID NO: 55019 - DNA, 223 bp, Zea mays
  Clone ID: LIB3068-051-Q1-K1-H6
ggctcgcgttgcgagtctaacctgacgatggaaactacaatggttgtcggaaggatatggcccgtgtgaacatgaactgtagcctggagtagaggcaaacaccgtggttcgaccaacttaatagccctaatggctggattggtaatgagataataatatcgcgcctatactacaactatctctacatttatgactagattgctgactataggactacagggga

SEQ ID NO: 55020 - DNA, 404 bp, Zea mays
  Clone ID: LIB3068-051-Q1-K1-H9
tcgcccacgcgtacgccattactagtcattggcaacaaaatagacaagcctgaaggtctccctaaacaaaccttcacagaaataatgggcctaaagacgatcactgaccgagaagtggcatgcttcatgacatcatgcatgaactcgaccaacattgattctgtcattgactggctggtgaagaactcgaaaaagaagaattgaacttaaatctgtactagctattaaagcgcacgccaatctctctatttttgcatgtctcatagcattggagctgtaaatcatgcaagaggtattaatcagggatgttgtgttcataattttgttaacctggtttagcagtatgttggtggacagcgtctggtattgagcacgcccgtgctctgaggctgcctcctgtgttc

SEQ ID NO: 55021 - DNA, 438 bp, Zea mays
  unsure at all n locations
  Clone ID: LIB3068-052-Q1-K1-A1
cgaaggcatctccaatctcctcgcccnccacggacctgaaccgagaacctttaccgccgcggcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgcangaagaacaaccgttacaagtagcaagatgtacaaagattataagccctaatacggatgatgccaaatatgttataaatgtaaaac

SEQ ID NO: 55022 - DNA, 455 bp, Zea mays
  Clone ID: LIB3068-052-Q1-K1-A11
gcgcgcaccgccgtcggcccaccgcttcagttggcagttgcgacttgcgagtggctccaacaaggcaacacaatccggcggcaccaacccagcgcggcgccaccggcgacccgtacccccttccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggagacctctccgggctcaccgacaaggagctcggcgtcctcgccgactgggagaccaagttccaggccaagtaccccgtcgtggcccgactcgccgccgacgcctgaactcgg

SEQ ID NO: 55023 - DNA, 357 bp, Zea mays
  Clone ID: LIB3068-052-Q1-K1-A12
cgcacgcgtgcgagccaaccgcttcagttttcagatgcgacttgttagtggctccaacagggcaacacaatccagcggcaccaacccagcgcggctccaccggcgacccgtacccccttccacgcagagcgatggctactgagctgaccgcgacacaactactcgcgtactacggcaccgacccgtccaagcccatctacgtctccgaccgcggcaaggtctacgacgtcacctccgaccgctgcttctacggccccatcggcgcctacgtcgtcttacccgcccgcgaggacagccgcgccctcggctacaactccaaatacaatgccgaccttctcagacacctatccgggctca

SEQ ID NO: 55024 - DNA, 386 bp, Zea mays
  Clone ID: LIB3068-052-Q1-K1-A3
taccgggctcgaccgacgcgtccgcgcagaccagcagctgatcgctcactcttgcagctcgatcattctttagctgctctagctgtagcctctaggcctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgtcgctgagcccgaggcggcccccgtggcggcggatgaagagacgccaaaggatgaagagacggcaaacgat

SEQ ID NO: 55025 - DNA, 378 bp, Zea mays
  Clone ID: LIB3068-052-Q1-K1-A4
cccacgcgtccgcactcccgcccctacgccttacaaacccacaccaaaacccactcccacgcctccgacgtgcaccctgacccccaagcctacgacacctaatccgaccccgccgacgtacactccaagccccaaacctccgacgcccaagccgaccccaccgacgtacaccccttcccccaagccttcgacacctaagccgaccccgtctacgtacactccaatccctaagccaccggctaccaagccttccacgcccaagccgaccccgacaacgtacaccccttcgtcaaagcctacgacacccaagccgaccccgtcgacgtacacaccttataccaagcctacgacgcccaatccgaccccgtcaacgtacac

SEQ ID NO: 55026 - DNA, 370 bp, Zea mays
  Clone ID: LIB3068-052-Q1-K1-A5
actcgtccgaaaaataaaaaaaaaaatttaaaaaaaattttaaaaaaaaaaaataaaaggaaaatatagggatatttaaaaaaaaaaacaatcaatcaaaaaaggcctccctcttttcatgttccaagtttacttactcttcctttccacactctttctctcctttactctcatctcatttcacttctctgaccctcttttttcaacctccttccttctaaaactctgtttttccccatcttaatccccttgctccccatcaccttttctccactttacctaatcactaatagccctttacccttcgctttcctaaacattttcacatcctatttgccaaatggatcactccctttaaacgacctttacc

SEQ ID NO: 55027 - DNA, 257 bp, Zea mays
  Clone ID: LIB3068-052-Q1-K1-A8
cggacgcgtgggctagagttcagtttctgagattgggcaacggcagcgggtcagctcgggaagtttgtgctgggatgccagtttatcccttctagtctattacagaaatgttgttcggagctgagtctattataaacatcttggtctgagtttattgttgagtggtgccagtttttttcaatatacatttatcttaaaaacagcggtactgatgtttttttgtctaaagttaatgagtttgcaatggttctgagtct

SEQ ID NO: 55028 - DNA, 400 bp, Zea mays
  Clone ID: LIB3068-051-Q1-K1-G9
cccaccaatagagccgtgtactataatgatagatctcctccggctgaattgaggcgagacatgccggtgggaactgaagctgccagctaccgcctccccgtttcagctccggacgctgctgcggcagctgcagccaccgccgcgacacaggcccctcctggatatgttcttgcccagatgcatgcgcctccgccaccgcagcagcctccaccacagcagcaaccacaacagccagctcctcagcagattgttgctgctgggaatcaacatttcatccacaaccctgccactggcacctttattccaatccaatcctattaccaccatcctgtccatcagcaggcaccccagaccatgcaaaggcagcaacaggcacctacgttcgacccaaatacaggga

SEQ ID NO: 55029 - DNA, 371 bp, Zea mays
  Clone ID: LIB3068-052-Q1-K1-A9
aggacgcgtggtcggcgacggttataacctgggcatcgccgagcagagcggcatctccgggggcggcttctgcttcggcatgctcccggccacgctcgtcgggtacgaagtcaacgccgacattctgctcgatgtttactggaaccagctggacggcggatgcaagcccgtcgtaggagcacaagacgtggacgccgggcccaccgaagtcgtcgaggatgaggacgtcacgtgacaccgatactcgcacgccaccatgtggcaccttcttctgcgacacgcccagtcacagcaggtgccgatcggctactactacgcatggaatgaagacctcgtgaagccgcccaacggcgtgccacacacaaggaaag

SEQ ID NO: 55030 - DNA, 427 bp, Zea mays
  Clone ID: LIB3068-052-Q1-K1-B11
cccacgcgtccgcccacgcgtccgattgtcgacgatcttgtgtccatcgacactctaatggaggaccaccttacgcaagagcccatcaatgagtacgtccagagttgctacattgtggctttcaacaagatctagagttcagtttctgagattgggcaacggcagcggctcatctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaacagcggtactgatgtctttttgtctaaaataacaaagcattaggctaccttaaaagagtaatagatactctcgccatttactctcacttggttgaatttcttaaatta

SEQ ID NO: 55031 - DNA, 389 bp, Zea mays
  unsure at all n locations
  Clone ID: LIB3068-051-Q1-K1-F1
cccacgcgtccgagcccaccgaattccctgcgattcctctcccctcgcctcctcgtctcggcctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctnctctatcgacagcatcgtgaacggcagcgacgccgtcatggagccggttgttgctggcagcaacacggtagtagcttgtgcccaagtcgagttgcaaacaatgaacgtgcagc

SEQ ID NO: 55032 - DNA, 397 bp, Zea mays
  Clone ID: LIB3068-051-Q1-K1-F10
ccaagatccaggacaaggagggcatcccaccggaccagcagcgcctcatctgtggccggcaggcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccc

SEQ ID NO: 55033 - DNA, 410 bp, Zea mays
  Clone ID: LIB3068-051-Q1-K1-F2
cggacgcgtgggatttcatgtgattcagtgaacagaatatggattccatgattgctatagtgatccgtgtggattgatgaagagtgagctgataatggaattattcttctataaataggaaacttaagattcaaatgctccggaatggaaatgagggaatgtccacattacccggatttagtcagatccaattcgagggattatgtagattcattaatcaaggcttggcagaagaacttgataagtttcccacaattaaagatccagatcacgaaattgcatttcaattatgtgcgaaaggatatcaattgctagaaccctggataaaagaaaggaatgctgtgtatgaattactcacctattcattcgaattatatgtattcgctagattaaattttggtttccatgtg

SEQ ID NO: 55034 - DNA, 468 bp, Zea mays
  unsure at all n locations
  Clone ID: LIB3068-051-Q1-K1-F4
gggaggttcatatatgcatcactgctgcgtcttctcgtactgaagtttgtcctgagcatgtcagcgggcaaggatgtgcttgcccttgcttcacttgaggtggacctctccagcatcgagccagggaccacagtgaccgtgaagtggcgtggaaagccagtcttcatcaggcgtcggacagaggatgacatcaagcttgccaacagtgtggatgtggcatccctgcgccacccagagcaggatgcagagcgtgtgaagaaccctgagtggctggtggtcattggcgtgtgcacgcacctcggctgcattccactacctaattgccgagactttggcggctggttctgcccatgccatggttcccactatgacatttccgggaggatccgcaagggccctgcgccgttcaacctcgaggtccctacctacangttcttggagggagacaaactgctcgtaggcttaaaa

SEQ ID NO: 55035 - DNA, 339 bp, Zea mays
  Clone ID: LIB3068-051-Q1-K1-F5
cccacgcgtccggtgagtgagccggtggccatggttttctatactctgctatgcgtctccgtcgccggcgttcttttcgtgtcccaatctggaaggacgacggacggtacggtggctggtttagctatagacaaaaaaaaaaaaaggtacggccgcgtggtggcggtgctaatatgcttagccacgcgcggttgatctttgagaagttaagcgtgtacgaaatgacagctttgtacgtgtactgtctgctggagtgtgctgtgtatctggtctggatccgatcggcctaatgtatgaaaaaaaggatgtttacgtactaaatggaaaatcattttttcc

SEQ ID NO: 55036 - DNA, 459 bp, Zea mays
  Clone ID: LIB3068-051-Q1-K1-F7
gttcccaccaaaccagcggcaccacccatggcttcggcggcggcgagatccgggctccgggcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttcccttgagacctatttgctgcaacatgaaataagaatgaccaaactcttgtattgacagtgaagttttaact

SEQ ID NO: 55037 - DNA, 459 bp, Zea mays
  Clone ID: LIB3068-051-Q1-K1-F8
cataggtcagttttgggctgatctatgctggcaccccatatcagatttccaggagaggactaggttattgatcactgtgttttcatgtggcattgcacatttgtggtcaactagggaaacagattggtgccgcattgtactttcatgggaccccccctctgaaagagttgagaagtgtacagtcatcggcagtcatctagttagcgctttgtgctaggaggttgtgaccagtggagctctatttggcatattggaatttggaatccggctacattgttgtacagacctttgattgacgtagcttggagaggatgtaggagtgaacagggccatgctttgaagcgaacaagttataggcatatgggagctggggatcatccgagacagatgccgctcgaagtgtcactgtacttgttgtgtggtatccctatagcaccaaagtagatggagatgtgcttt

SEQ ID NO: 55038 - DNA, 400 bp, Zea mays
  Clone ID: LIB3068-051-Q1-K1-F9
ctcccacgcccaagccgaccccgccaacgtacaccccttcgccaaagcctccgcacccaagccgaccccgccgacgtacaccccttctcccaagcctccgacgcccaagccgaccccgccgacgtacactccaagccccaagcctcccacacacccgacgcccaagccgaccccaccgacgtacaccccttccccaaagccttcgacgcccaagccgaccccaccgacgtacaccccttccccaaagccttcgacacccaagccgaccccaccgacgtacactcccacaccgaagccgccggccaccaagccgaccacctacactccgacgccgccggtgtctcacaccctcagcccgccgccaccatactactagaaagcgatgcctaccataccacac

SEQ ID NO: 55039 - DNA, 448 bp, Zea mays
  Clone ID: LIB3068-051-Q1-K1-G1
gggcacttatgattttatttacttgccaattgattttaagaataaatgtaatgtcggctatgcttggatcaacatgaccaatcctcagcatatcattccgttttatcagagttttaatggtaaaaagtgggagaagtttaacagtgagaaggtggcatcacttgcttatgccagaatccaagggaaaacagccctgattgctcatttccagaactctagtttgatgaatgaggacaaacgctgccgtcccatacttttccactcagatggtcctaatgcaggagatcaggaacctttccccacgggttcaaacatccgagccaggtctgggagatcccggacttcttcgggtgaagaaaatcaccatgacatccagacagtcttgaccaacggtgacacttcttccaatggagctgacaattcaggtcccaccaaagatactgagtag

SEQ ID NO: 55040 - DNA, 273 bp, Zea mays
  Clone ID: LIB3068-051-Q1-K1-G11
acccacacactctcatacgcacaatctacacgactcaactgaacagatccatcgactccacaccgacgccactgttacttgggacgctactactactactcccctcctcgctcctcctcctgctacgctcgcgaggcaagcgcacggctacccccatacccatcgaaactgccgatgctcatcaccacgacatgactcaccaactcacccgcccaaatcgaacccctgctgacacgcctatctaagcgttacagtcccatcacggctctccgc

SEQ ID NO: 55041 - DNA, 386 bp, Zea mays
  Clone ID: LIB3068-051-Q1-K1-G12
gctacgcgtgcatggtcgcgtacggcaatgccacctgcttcctcttcatcgtgaaccacagcactgcgctgtagctccgcatcgtcatgcaaggtcaaggcgccgccggtcatccagtgcacatgcatggttagcggcacctgcactgactccgtgcaacgagctagctgcggcacctgaagaggcagatgccgacgcgcctgcagatgccgcttcagcagatggagcctaaagctctacagactcaaataatgcagctagctcactgctcttcatatgctcattgcttgctgcctgctaactagtggtgatacaactattgttgccatgttactaatcagtaatgatgcatctcccttggtcatgactatgtacttacctatgat

SEQ ID NO: 55042 - DNA, 425 bp, Zea mays
  unsure at all n locations
  Clone ID: LIB3068-051-Q1-K1-G3
ccaggatgatcaaggggatttttcgtcagtgagcatggatacagcagtggcgattcggacgctagaggcaacatacagacaatcagctgactctgttgcagttgaatcaatgattgcaaagttgacagagaaggaaggtccttgcttaaaaggtaaaggcagggccagtgatgcagcaagaatcgtggttctgacctggagatcgttgctaattatgtcaagagattggaagtacttctggatcaggcttgtcttgtatatgcttattgctgtgtcaattggcacgatatttaccgatattggccattcactatcatctgtaatggtgaggatttctgcgatatttgcatttgtatcngttgtcgtccttctaagtgcttctggagtacccgctcagatcgatgaagtcaagatttattcccacg

SEQ ID NO: 55043 - DNA, 355 bp, Zea mays
  Clone ID: LIB3068-051-Q1-K1-G4
cccggattgagattgagtggcagcacctgcacgatcaacctaccaagtggcggcgctgccactgagtgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtcccggataagtgatgtgtgtgtgtgtgtgtgtgagtgaacagtgcatctagtaagagaattgttgcgtggtttggtacttggattcttcgctctttagacaagaagtaccatggcatcaaaaaataaaatgtttgattaactt

SEQ ID NO: 55044 - DNA, 459 bp, Zea mays
  unsure at all n locations
  Clone ID: LIB3068-051-Q1-K1-G5
ctacgcccgcggcacggggtccggcccctccgcgtcctgctgtagcggcgtcaggaaccggaagagcgccgccagcacggccgccgacaggcgcgccgcctgcaactgcctcaagaacgccgccaggggcgtcagcggcctcaacgccggcaacgccgccagcatcccctccaagtgcggcgtcagcatcccctacaccatcagcaccttcaccgactgctccagggtgaactaaaacctagaccacgcgcgacgacggccgnctgatcgatcgaccaaccattccgncgtcgccgncggccggatcatcgatcgtcgtcatgatgatatctatcaatctacgcgtgatgatcgatggctacttgtctactgctatgtactactaaataaaatctctccgtgtgtgcacgtacgctngcatgtgcatggtagcatgtatgtacgacgtcgtncatgtat

SEQ ID NO: 55045 - DNA, 447 bp, Zea mays
  unsure at all n locations
  Clone ID: LIB3068-051-Q1-K1-G6
agctgccattgccatctactgacctgtgacctccgcattcccaaacagcccgagcgagcgagctagcagagcggcggcaggcacctccctcctcaaggaacatggcccgcacgcagcagttggcagtagtggcgaccgccgtggtggccttggtgctgctggcggcggcgacctcggaggcggccatcagctgcgggcaggtggcgtcggccatcgcgccctgcatctcctacgcgcgcggccagggctcggggccctccgccggctgctgcagcggcgtcaggagcctcaacaacgccgnccgcaccaccgccgaccgccgcgccgnctgcaactgcctcaagaacgccgncgccggcgtcagcggccttaacgccggtaacgccgncagcatcccctccaagtgcggcgtcagcatcccctacaccatcagcaccttcaccgact

SEQ ID NO: 55046 - DNA, 329 bp, Zea mays
  Clone ID: LIB3068-051-Q1-K1-E9
cccacgcgtccggatcgttgtacttgtatcatactcatgtatacccgattccgagactggttcatctcgtaaattggaagcgatgtttggatgcctatgtatcaagtggatcataaacatccaaacaacgccttaaaatagatgtttcgacattattattttcctgcttgcaatccaggctctaacaacttctcggtcttgtttaaaaaaaaaaaaaaaaaaaaaaaaaaaaaaaaaaaaaaaaaaaaaaaaaaaaaaaaaaaaaactaacaaaaaaaaaaaaaaaaaaaaaaaaaaaataaaaaaaaataaaggactgtctttaaaaa

SEQ ID NO: 55047 - DNA, 453 bp, Zea mays
  Clone ID: LIB3068-051-Q1-K1-C7
gcagctcctccgggggcggcgaactactcctcgtcgccaaaaccctagccctgcttctgtgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctattcttcatccacctggtgaagatcccaatggttatgagcttgcaagcgaacgatggacaccaatgcacacggttgaaagtataggtctgagcatcatttcgatgctc

SEQ ID NO: 55048 - DNA, 458 bp, Zea mays
  Clone ID: LIB3068-051-Q1-K1-C8
gggcgatgaggatgatggagaggaagaagatgacgaggacggtgaaggggacgaagaagaggaaggtgatgaggaggtgactggattctaagcgaggctactcatcacctgtaactttggaagtgtgagttagttgacatactattcacttgtacctcgtgcgatttcttatacgtgtacttgtgtgcgttctatgggacgcactgagcccataaatcgattcgtgactatgtaggtatgtgtagtgctgttgtgtgtaccttgaatttctttctacatcttcctgtggtggcatagaatgcgtgcagtaaggtatggtctaccttctggttgacatgcccttgggtaattattgtcgatatgtggttttggttaaaaataaaattttttttattttttattttttttttttttattttttaatttattttttttattttatttttttcttttttttt

SEQ ID NO: 55049 - DNA, 404 bp, Zea mays
  Clone ID: LIB3068-051-Q1-K1-C9
cggacgcgtgggtcaacttgctattgggaaggaaactgcacgtcgtttggggatgggtactaatatgtacccttcttctgctttactcggacagaataaggatgagtcaattgcttccttgccaattgatgatttgattgagaaggctgatggctttgctggtgtctttccagaacacaagtatgagatcgtgaaacgcttgcaagcaagaaaacatatatgtggcatgactggggatggtgtaaatgatgcaccagctttgaagaaggctgatattggtattgcagtagcagattctactgacgcagctcgtagtgcttctgacattgtcctaactgaacctggccttagtgtgattattagtgctgtgctgacgagtcgggcaattttccaaaggatgaaaa

SEQ ID NO: 55050 - DNA, 202 bp, Zea mays
  Clone ID: LIB3068-051-Q1-K1-D1
cggacgcgtgggaaaaaaaaaaaaaaaaaaaaaaaaaaaaaaaaaaaaaaaaaaaaaaaaagaaaaagaaaaaaaaaaaaaaaaaaaaaaaaaaaaaaaaaaaaataaaaaaaaataaaaaaaaaaaaaaaaaaaaaaaaaggggggcctttttaaaagatccaaatttaatttccttttaatttaaatttaaaactttttt

SEQ ID NO: 55051 - DNA, 409 bp, Zea mays
  Clone ID: LIB3068-051-Q1-K1-D10
gcgcgtttcgaagcgcacctcaccacccagctcgtggatggaggcgcgcattttttccaccatgctgacgaggcggaacgtgccgatgtgcggccggctcagatacaggatgtcttccggcgcgccggccttgacgaattcgtccagcaccttgcggccatagtggtgcggatccttgatctggctgtacagcttgccgtcggaaaacgtcccggcgccgccttcgccgaactgcacgttggattcggggttgagcacgcttttgcgccacaggccgaaggtgtccttggtgcgctcgcgcacggccttgccgcgttcgaggatgatggggcgaaatcccatctgcgcgaggatcagccctgcaaacaggccacacggccccatgccgatgacgaccggacgcaagaaa

SEQ ID NO: 55052 - DNA, 401 bp, Zea mays
  Clone ID: LIB3068-051-Q1-K1-D11
cccacgcgtccgctcgtccaaggccgtcaagtacgtggactccgcgcacttggccgtgcccgagggcgcgcgcgccgtcgagctggtgggcggccgggagagcgcgctcgtgcaggaggtgcgcaccgtgcccgggtggtcctaccgcctcgccttcgccgtgggggactcgggcgatggctgcgcgggctccatggccgccgaggcctacgcggcgcgcgccacggtcaaggtgccctaccagtccaggggcaccggaggatacaagcgcgccgtgctggacttcacggccatcgccaaccgcacccgcgtcgtcttccagagcaccttctaccacatgaagcccgacggcacgctctgcggcccgctcgtcgacgacgcctcgctcgtcggcctgcgca

SEQ ID NO: 55053 - DNA, 384 bp, Zea mays
  Clone ID: LIB3068-051-Q1-K1-D12
aaaaaaaaaaaaaaaaaaaaaaaaaaaaaaaaaaaaaaaaaaaaaaaaaaaaggaaaaaaaaggaaaaaaaaaaaaaaaaaaaaaaaaaaaaaaaaaaaaaaaaaaaaaaaaaaaaaaaaaaaaaaaaaaaaaagggccggcctttttaaaggaccaaattttacttccccttacttgcaacatatttattctttttttgtgtcccttaatttaatttaattgcccttcttttaaaaacgtttcatttggaaaaaccttgcctttaccaaattaaatcgctttgcaaaaattccctttttcccaatttggcttattaccaaataggccagcaccttttgccttttcaaacatttccccaccctaaatggcaatttgaaccccct

SEQ ID NO: 55054 - DNA, 408 bp, Zea mays
  Clone ID: LIB3068-051-Q1-K1-D4
tcgcggacgcgtgggctgacgcgtgggcggactcgtgggttctgcgggccgcgttcgataggtggaatgggaagctcatgaggaaatgaatgaaggggggattacatgtttgtggctggtgattgttgaataatctgtgctgggttttaactgcgcccggatgcctgtactgtctcttattttttttgctagcaatagttatgctgcctgcaacttcatgcctactgtctgtactatttgttttgactgtgtgtaagtctattgttattgatcattgataccctgtcgactgcctctaccctttttgtaaaatattttaatttatttttttatttttcttgtatttttcttttcttttgtttttctttattttagttgttatatttttattttttttttattagtttt

SEQ ID NO: 55055 - DNA, 457 bp, Zea mays
  Clone ID: LIB3068-051-Q1-K1-D6
gcacccgctcatgaattttccaagaatttccttcggagtcatctttgtgtacctgtgatggtcgtggataagatttacaagatgaggatcaataacgataaatgaccttagcattagtcagacgacatcatgatccgtccattttgtacttccatagctttgaatcttgttcgccagggtcttgagcctattgtaagtttgagttggcttctctccccttatcatggtgactctcccaagctcgtcttccaccagttacatcttggaaatcatggtggcgtcattaccctcgtgagagatcttgaaggtattccatatttgctttgtattgtccaagccacagactttgttgaattcattccttcatagggatgcttacaaaacaagtgtatcttgtgcaattttatgaatttgcttaataatcaatacaggattatcagtactattcaaatgcatt

SEQ ID NO: 55056 - DNA, 244 bp, Zea mays
  Clone ID: LIB3068-051-Q1-K1-D8
gtaaggataagtataggaagagtgccactatgtggatgcaaaaggccaaggcagctatggagaatggagggagttcggacaagaatattacagaattcatcgctaagtattctttaagttaattttcaaagatttcgtaaaaaatataattttcaaaggtaaaaaaaaaaaaaaaaaaaaaaataaaaataaaaaaaaaataaaaaaaaaaaatatttaaactttttaaagaattccaatttta

SEQ ID NO: 55057 - DNA, 401 bp, Zea mays
  Clone ID: LIB3068-051-Q1-K1-D9
cggacgcgtgggttaatattggcagcaagctaggatcatcagcatctgagcgtattattacgaaatcgatcggttgccatggcggggatgagagtcggcaagctggcgctggctgcggtgctgctgtgcgcggcggcggccatggccacggcgcagcaggcctccggcgtgcgcgcgacctacaacttctacaacccgcagcagaacaactgggacctcaacgccgtgagcgcgtactgcgcgacgtgggacgccagcaagccgctgtcgtggcgcatgaagtacggctggacggccttctgcgggcccgccggccccaccggccaggcggcgtgcgggcagtgtctcctggtgaccaacacggcgacgggggcgtccatcacggtgaggatcgtggacca

SEQ ID NO: 55058 - DNA, 397 bp, Zea mays
  Clone ID: LIB3068-051-Q1-K1-E12
cttttgagttcttgtcttggttcgttcttgattcttggacgaggtgggatttggagagccaagggcggcgcggcagcggcgggtttctcggtcggactagattgtttccatcgagatggtgccatggtgggcggcggagggcattcgtcgatggaccaccctggcgccaaggacgatggagacggggaagaaagccagtacttctcggacgcggaggaccggtcgtggccgtcgcactcgcgccacgactccaccgcctacgaggactacgtctcgctgtgcgtgtccgcccgcgcgagctccgtcgacgccgacgccgatgccgacggcgaggccgtcagacaacactgcatgaagtcgtcgtgcgtgtcagagggctcgctggacgacgttgacc

SEQ ID NO: 55059 - DNA, 420 bp, Zea mays
  Clone ID: LIB3068-051-Q1-K1-E7
ccggagaattcctcccttgccccgccgtcgcatcctcttcgaagttcgaatcgagatcgcggcgcgatcacccacctcggggcggacaaggagcctgtcgtggagcggccagaggcgggtgaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccgtcaaggtccgcctagtcatgcgccaggctaaaacgcttaagatctgcgcgaaccaccttgtggccttcaccacg

SEQ ID NO: 55060 - DNA, 439 bp, Zea mays
  unsure at all n locations
  Clone ID: LIB3068-051-Q1-K1-C6
cttctgatgaactcctccttgccaagaaactactacactgaaaaggcatcggcacggcacgggcggtgaggatagcgtagcatagcatagcataccgcaggcgctgctggttgacaaatggcaagcttattcccacagctcgcgcagacggagcacggcgtagccggcgcctcccatggcgcgccgagcttcctgttctgcaatggcgcaggtgcagccacggcagactcagcctcgctagagacctcgtccggtgttctcgacacctncccacgaggcggaggcgctgattctggcggtaggaaggcccggacgaagcccagggaagacagcgccagcgccagcgccagcttcagcttcagctctgcgcactccaaggactcgagctcgaagggaagcaccaagaataggggagggaaaagaggcagaagcagcaagg

SEQ ID NO: 55061 - DNA, 383 bp, Zea mays
  Clone ID: LIB3068-002-Q1-K1-D2
cccacgcgtccggacctctgatgtggctgcaccacctgttgctcctactggtgctgattaggatgctgcgccagcttcggttcctaccggtgatggctgggatcaaactgtggcccctgttcctgtggatggcactgttcctccagtggtcgctcctactggttggtaatcagcagcccagcccactgcccaaggcttggagtaggcgttgaggcatcactctgagacgtcttgtgcgggattatttcaaagtatgaatgcccgaagtcagacgacatatttttgtagattatttgctatgctttgtgcactgaatgtttttagggctttttttattgatccggtgcccatagatctgttccttaaaattgtctttatttaat

SEQ ID NO: 55062 - DNA, 127 bp, Zea mays
  Clone ID: LIB3068-002-Q1-K1-D4
cccacgcttcctcagacgcttgtgaaaaaattaaaaaattttttaaaaaaaaaaaaacaaaagaaaaattagaaaaaattaaaaaacaaacaaaaaacacaaaaaaacaaataacaaaaataataaa

SEQ ID NO: 55063 - DNA, 417 bp, Zea mays
  unsure at all n locations
  Clone ID: LIB3068-002-Q1-K1-D7
cggacgcgtgggctcgggcgagctctccagcgcccgcttcagcgagaaggagctgatcagggccatcgaccgcgaggccgtgttcacgtacgcggaggacgcggccagcgccagcctgccgctgatgcagaagctgcgcgccgtgctggtggaccacgccctcagcagcggcgacgcggagcgggagccctccgtgttctccaagatcaccaggttcgaggaggagctccgcgcggtgctgccccaggaggtggaggccgcccgcgtggcggtcgccgagggcaccgnccccgtggcgaaccggatcgcggacagccggtcgttcccgctgtaccgcttcgtgcgcgaggagctcggctgcgtgttcctgaccggcgagaggctcaagtcccccggcgaggagtgcaacaaggtgtt

SEQ ID NO: 55064 - DNA, 426 bp, Zea mays
  Clone ID: LIB3068-002-Q1-K1-E1
cccacgcgtccgcaggccacctgcaactgcctcaagagcatgacgggccggctcggcggcggggtcagcagggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgcgtgtgtcatgcatcagactggcacataataaagaagtagatcatgcacccactagtgatcacttcgtctagtgtccctacgttcaatgtcgtcgtcatcatcgtgtaccttacgtgacatgctgtaacacgtacgctagcagagcagcacctcaatgtccttgggt

SEQ ID NO: 55065 - DNA, 223 bp, Zea mays
  Clone ID: LIB3068-002-Q1-K1-E10
cggcttttaagtgcggctatgatcttttacacatttggatgaagcaacaaattcgtccagactcttggtagagtctagaagaccacgactgatcctcaaaggtaatgaatggaaaaaatagcatgtcgtaataaaatcaatttctttttttttttttaataaaaaaaattctgattttctgggtctagtgaataaatggatagagcctggctctaattctggt

SEQ ID NO: 55066 - DNA, 454 bp, Zea mays
  Clone ID: LIB3068-002-Q1-K1-E12
tcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggccggatgtgggtcctgctcctgttcgattccacgcgcgcacgtatgcgattgtactgctggttgctgcttgatcgatcgatggatcgatgattccatgtacatatttgttagggggatgctgctgct

SEQ ID NO: 55067 - DNA, 412 bp, Zea mays
  Clone ID: LIB3068-002-Q1-K1-E3
cggacgcgtgggcggacgcgtgggtccggacgcgtgggcgctcacgcccccggacccttcggccctctcctccgctcgccggagctccgcgtctccgcccgcgccacaccctaatcctcaatggctgccgcaaggggcattaaccagctcctgaagagaactttctacaaccagtctgctggttcgtcgccgcttttctcatttcggggaaagcatgaagaatcctctgctggactgagagcattggctcttcttggagttggtgcctctggtcttttgagttttgctacaatagcatctgctgatgaagctgagcatggcttggcagccccagattatccctggccacatgctggcatcatgagctcgtatgatcacgcatcaattcggcgtgggcatcaagtttacacgc

SEQ ID NO: 55068 - DNA, 418 bp, Zea mays
  Clone ID: LIB3068-002-Q1-K1-E5
caagaacctcctcgcctcctccattgaccaacaattaagcctccccgaccgccacatctatgaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatt

SEQ ID NO: 55069 - DNA, 437 bp, Zea mays
  Clone ID: LIB3068-002-Q1-K1-E8
cccacgcgtccgtgatgcttctgggggaaaatcaaagggacaaggaaccggaaatgttctgattgttactcttgttgatgcggagacagaaagtagcataaatgctaccatgcttgaggaaggccttgctcggcttgaaagaagcaagagatgggacactagggagaggaagacggctctccagaacctggaacagttccaggagaaggcaaagaaggaaaggctgcggatttggcagtatggcgatgttgaatcggatgaggacgagcaggccccagctgcaaggaagcctggaggtcgtcggtagagctccccaaatgtgagactctgctgggagttatagattcaacttagagggtaccttatttattcggttagaaaacagaacttagtgaggcgaaactttctcggtttgagcacttttgatattccgtttt

SEQ ID NO: 55070 - DNA, 438 bp, Zea mays
  Clone ID: LIB3068-002-Q1-K1-E9
aaaaaaaaattacaaaaaaaaaaaaaaaaaaacaaaaacaacgaaaaattataaaattaaatatacccaaaaaaaataaaaaaaaaataaacaaacaaaaaaaaacaaaaaatacaaaaaaaaaaacataaaaaaaaaaaaataaaaaaaaaaaatacaaaaaaaaaaaaaaaaaatataaaaaaaaacaaaaacaaaaacaaaaaaataaaaaaaaataaataaaaaaaaaaaaaataaaaaaaaaaaaaaaaaaaaataaaaacaataaaccaaataaacaaataaaaaaaaaaaaacaaaaaataaaaaaaaaaataaaaaaaaaaataaataaataacaaaaaaaaataaaaaacaaaaaaaaaaaatataaaaacaaataaaaaacaaaacaaaaaataaaataaaaacacaaaaaaaaaaatacatacaaaa

SEQ ID NO: 55071 - DNA, 452 bp, Zea mays
  Clone ID: LIB3068-002-Q1-K1-F12
gttcatcaaacattatgatgagcatgctctgcggactccttcaaacccattcctgctctgtgtgaggtgctccattgaactgcttgatcacccaaaagattacacgacacctccagaagaacttgtacttctaccagcaagtgctaccctaggtgacctgaaagtacaggcttcaaaggctttccaagaaacgtacctgatgttccaaagcttccagactgaacagctccctgactttccaaacttcagtgatacaacccccgtgaagcatgtgcttggatcaggccagttgcttcgagtaaggggacgttgcactggggattacaggagaattgtacagttcaggatggagaggggtttggagaactggacggtggactgctcatgtggggccaaggatgatgatggggaacggatgctagcttgtgacatatgtggagtctggcagcata

SEQ ID NO: 55072 - DNA, 184 bp, Zea mays
  Clone ID: LIB3068-002-Q1-K1-F4
aacttccaatcaaagatactttcgatctttttaacacccgcaatgcccaaccaaaaagcgtcctcctttatggacctccatgcacatgaaaaacattgcttgcacgtgccgatgctcatcacactgactgcaccttcatcaggatgtctggttcttaattggttcacaaatatattggtgaaag

SEQ ID NO: 55073 - DNA, 363 bp, Zea mays
  Clone ID: LIB3068-002-Q1-K1-F8
cttgaccagcaaattaaagagatcaaagaggtcattgagcttccaatcaaacatccggaagtatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactctttgttatggccagggaacatgcgccatccattatatttatggatgaaattgactctatcggatctgctagaatggagtctggaactggcaacggtgatagtgaagtgcagcgtaccatg

SEQ ID NO: 55074 - DNA, 459 bp, Zea mays
  Clone ID: LIB3068-002-Q1-K1-G10
cccacgcgtccgccaaaagtaccttaccggattcccggagatgaagaagcgacttggggggacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactagaagtggaagagttacacaaagttcgcgaaatgatc

SEQ ID NO: 55075 - DNA, 260 bp, Zea mays
  Clone ID: LIB3068-002-Q1-K1-G12
cccacgcgtccgcccacgcgtccgcccattcgttcgttgacgcatggacggacgcgtgggggttttcgagatcttactcttaaatagatgcaataattctacatcggactatgaaataataatagccagtactataattattaattataactccatatattaaacatcaaaaaacataaaacaataatcctattatgttatccgatgctaatgaatccagagctaaagaataggttcagcactctaaattcttaaaagat

SEQ ID NO: 55076 - DNA, 201 bp, Zea mays
  Clone ID: LIB3068-002-Q1-K1-G3
tgcaatagtcaagaatattgtttttgagtcgcggaagcagaggggataaaaatcttagtcatgtttggactttaactttgttttatgttggaaagtacttgaaagacttttcctgtggtaattctaggcgtaagttgctgtgctggttggggtttactggtgaaccagagtttttctatcccactatgaatttgttacctc

SEQ ID NO: 55077 - DNA, 460 bp, Zea mays
  Clone ID: LIB3068-002-Q1-K1-D12
cccacgcgtccgcgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaagccgagctggctgccatacataggtattgtgtggtgtgtgtgagagagagagaaacagagttcttcagtttgctatctctctct

SEQ ID NO: 55078 - DNA, 304 bp, Zea mays
  Clone ID: LIB3068-002-Q1-K1-G4
gcgcccacgcgtccgcggatgcgtgggcggacgtttgggtactagctgcccgatgggcaggtcgtcactatcgtcgcttttaggttcatatgcccataggtgcttttgcagccgtcgctgatcgggatggaagctcccggcatccacgagaccacctacaactcgatcatgaaatgtgacgttgatatcatgaaggacctgtacgggaacatcgtcctcagtggagggacgaccatgttccctggcatcgctgacaggattagcaaggagattactgccctctcaccgagcatctttaagatca

SEQ ID NO: 55079 - DNA, 455 bp, Zea mays
  unsure at all n locations
  Clone ID: LIB3068-002-Q1-K1-A12
cccacgcgtccgcccacgcgtccgcccacgcgtccgcttccattcgaacccctctccatgtccttcaacgagataaattactatgttgacatgcctgcagagatgaagagtcaaggagtaaccgcggataagcttcagctgctgtcagggatatctggggcttttcgacctggtgttctcactgctcttatgggtgtgagtgggtctggaaagactactctcatggacgttttatctggaaggaagactggaggatatattgaaggagaaatttatatatctggttaccctaagaaccaagaaacatttgccagaatatcaggttactgtgaacaaaatgacatccactctccacagatcactataagggagtccctactctnttctgctntcatgcgccttcctaaggaggtcactgaccaagaaaagaagatattcgtggatgaagttatgga

SEQ ID NO: 55080 - DNA, 287 bp, Zea mays
  Clone ID: LIB3068-002-Q1-K1-A3
cgacccaggcgtacggatctgtaggcccgtccgttgcttacccaccttcagaggtgctacaaaggcaaccgttagtgcgaggccgcggcaaggtactatggagttagtggctacagtgcctgcttaagtttctttgctgttccaagtttagtgacaaaactgacaatggtgtagcaactgggttgtgctgcgaccagtattttcgttttgcctacctgtattgtctagtctgtgtttgcactggtggatttgcagagatgttatcattcaacaattgttctgtggtc

SEQ ID NO: 55081 - DNA, 419 bp, Zea mays
  Clone ID: LIB3068-002-Q1-K1-A4
cggacgcgtgggcggacgcgtgggctccgctccgccattgttgctccttattagtagttcgtgccgcgtggcttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagca

SEQ ID NO: 55082 - DNA, 426 bp, Zea mays
  unsure at all n locations
  Clone ID: LIB3068-002-Q1-K1-A6
cccacgcgtccgcccacctcgccccccccatccagctccgaccctagggtttccatccggcgcttccggaagcttccgaaaatggccaccgacgagctcgcccacgccgtcgcccccgccccggccgggggcgaccactccccggccttctcgttcagcatctggccgccgacgcagcgcacgcgggacgcggtggtgcggcgcctcgtggagacgctcgcgggggacaccatcctctgcaagcgctacggcgcggtgccggccgtcgacgccgagcccgcggcgcgcgccatcgaggccgaggccttcgacgccgcggcctccacgggaggcgccgctgccgccttcgtggaggaggggatcgaggcgctgcagttctactccaaggaggtgagccgncgnctnctcgacttcgtcaagtcccgc

SEQ ID NO: 55083 - DNA, 334 bp, Zea mays
  Clone ID: LIB3068-002-Q1-K1-A7
cggacgcgtgggcggacgcgtgggcaagcaactgcaaagcagcaagctctacggttcttctggactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcg

SEQ ID NO: 55084 - DNA, 382 bp, Zea mays
  Clone ID: LIB3068-002-Q1-K1-B4
gactagttctagctacaagcgggcgcagtctatgccgtctaccccgacgacgccggtgacgcggtcgtggtcgtcgtcgtcgacgactccgcgcggcgccggcaacgtgtggcgcaacgtcttccacccggggtgctatcttttcaccaagggcatgggcgccaacctcttcgaccggccgcagctccatcttctttaccgtctacgactggctctacagctactagaccaggagcaaccaccgttagatcgttcgagatggatggacagtgaataggccatgtttgctggtccttgtggttatctaaaacgcacgcatgctctattatagctagtcatcactatttatatacttgtgtttgtgtattgttgtttttgttct

SEQ ID NO: 55085 - DNA, 419 bp, Zea mays
  Clone ID: LIB3068-002-Q1-K1-B9
cccacgcgtccgctcttcctactcgccttcaacgccggcaccacagccccggccccgtggggttcctgcaccccacccgtcctgcgaggctcctccgccatgccgtcatacgcgcaccaccatagcagccctctggtaaggaacggtgccggccgtgttgtccgtagacgattgagggggacagaaagagattctttggatgtttttctttgtttcctttatttataccgagagataaacaaataaaaaaacccagagacgaaaaaactttttttcttgaaccgccctgcttcccctctggtgttgggaatttgtgattttgacatacgacctgtatgggtatttttccggccggtgaatgatgataccaggatggacgcgctgaagtgtaacaacaactgcgccccgccggaggagac

SEQ ID NO: 55086 - DNA, 169 bp, Zea mays
  Clone ID: LIB3068-002-Q1-K1-C1
acgacttgtttcattgattcttgaagagatctagcttcttttgcaccacaaggtcgaggatgtcttgcagctgctgatcaagctgctgctgcggctcaagctgcaagtgcggcaagaagtaccctgacctggaggagacgagcaccgccgcgcatgccaccgacattct

SEQ ID NO: 55087 - DNA, 453 bp, Zea mays
  Clone ID: LIB3068-002-Q1-K1-C11
gagacaaccgctgcgtaaacgaatccatcgccatggcgtctcgtctcgttgcggcggcggcctcctgctcctccctctcttcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcgggatcaccacaggcataggtggcggagatggagttgtacccatatctgtggcctggcaacaatgttaaataaaaggaatgctttatgttgtgctttcaagttgataaattgtggcaacaagagattttgctttacctaggcaatatattgagaagct

SEQ ID NO: 55088 - DNA, 381 bp, Zea mays
  Clone ID: LIB3068-002-Q1-K1-C12
cccactcgtatgtaatcgactcctcggttttatgggccgcaagttcttcttcggtcacagcttctttggcaatgtaaccacagatcaggtctataagattgttaaaacccttaatgaatgacatgttcccccttcagatgttgtggatgtcgttgtcagcccttcttatgtatttcttcctgtggtcaatatccagctgcgccaagagttccatgttgcgtctcagaactgctgagttaataagggatgtgctttcaccgttgaagtcagtgctgacatgctcgtcaaccttggtgttccctgtgtcattcttggacactcttaaaggaaagctctgctgtgagaatcaaatgaatttgttggatacaaagttgcgtattc

SEQ ID NO: 55089 - DNA, 144 bp, Zea mays
  Clone ID: LIB3068-002-Q1-K1-C7
agcgagccaacaaacttgatcagggacggttgaattgataaaataaacgtggggtccaatataaattatgtggatcacattattatactgacatcacgttggcatgattttggaacttcaataatattatgatgtgctagattc

SEQ ID NO: 55090 - DNA, 394 bp, Zea mays
  Clone ID: LIB3068-002-Q1-K1-A1
ttaccggtcgaccacgcgtccgggcggcctgaaatctggtggtaatgcttatgtgattggagatccagcaagacctggacagaagtggcacgtggtctacgccactgagtacccagagcaaccaatggttaaccttgaaatgtgcatgactggtctggacaagaagatagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttg

SEQ ID NO: 55091 - DNA, 430 bp, Zea mays
  Clone ID: LIB3068-002-Q1-K1-C8
cccacgcgtccgcccacgcgtccggtcccgattgagctcatcaggccggagatgctccgccggaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgtggcgcccgcgccaggttccagaagtcctaccgttgagcgctcggctgcccgctcttgccggacagttgcctgtgttgtcccaacttgccagatcgatgcctgtacccgt

SEQ ID NO: 55092 - DNA, 386 bp, Zea mays
  Clone ID: LIB3068-002-Q1-K1-C9
tgatcgtttcagtatcaacttccacgactcaccactcacgagcgaatacatctggatcaaggcacccagtgaccacacattgctacatagagagagtacacagactgaagcgcacacatcggttcatgcctacgtactctgatcgtggtaacattcatttactatacaccttttatcatctttgttatcttattttctacaccattctttactttttacatgctctattcgttctatcttaaaatactatttatcttttatatttttctattattactcccttttttttcttatttttatatttcattactttttattttttctctcactattttttctttatttattttttttaatttatttatttttttatttttttatttatt

SEQ ID NO: 55093 - DNA, 362 bp, Zea mays
  Clone ID: LIB3068-002-Q1-K1-D10
acgcactcgtccgtcgacgcgtccgtaagcatataaataagtggaggagaagaaacttactaggattcccctggtaacttggagcgaaccgggagcagcccagcttgagaatcgggcggcctagccgtccgaattgtagtctggagaggcgtcctcagcgacagaccgaccccaagttctctggaaagggactcctgtgagggtgagagccccatgctgcccggaccctgtcgcaccacgaggcgccatcaacgagtctctttgtatggtaatgcatgccaaatcgctcggtatactacgtccaatgctaaatacaagcgagataccgatagctaacaagtaccgttaaaaatataaattat

SEQ ID NO: 55094 - DNA, 331 bp, Zea mays
  Clone ID: LIB3068-001-Q1-K1-G10
gtacttcatgagtgacgcttacatggcgtgcgaccagcagtacaaattcagcgtggatgtgaaagaagccgagacagacagtgactcagattgagtccagaggcattcactattgcacagaggagagccgaacccgagttaggggcgtgtgcagtgcatgggacctctgcggagacctggccccaccccaccgtcctgcttttccccggcttccttggcgttcacacgctggctccagtgtctgcaggtgtcgggcacaaaccgtgtacagcattttgaggcgtggtctttgtacctccttttcagtctaataaaatgacttggagaaaaa

SEQ ID NO: 55095 - DNA, 414 bp, Zea mays
  Clone ID: LIB3068-001-Q1-K1-G11
gccaaagatgctaaaactatggaacacttgctctcttctcacacgctactaaagtaatgctcaagattctccaagccaggcttctacagtatatgaactgtgaactttctcatgctggatttaaaaaaggcacaggaaccagacatcaaattgcctacatccgctggatcatcacagatgcaggagagttgcagacaaacatctatttttgctttattggctatcccagattctttcactgtgtggatcacaaaataatgtagaaaagtcttaaagagatgggaataccagaccaccttatctgcttcctgggaaatctgcatgcaagtcaagaagcatcagttagaattggacatggagaaacagactggttccaaatcaggtaaggagtatgtcaaagctgcatattgtcac

SEQ ID NO: 55096 - DNA, 254 bp, Zea mays
  Clone ID: LIB3068-001-Q1-K1-G12
ttctggaagcccttcaagtaccagggcctgaccattggggtcaagaaggagatgccccggagcacgctggactccttcatgcagcccttccagagcacgctgtggctgctggtggggctgtccgtgcacgtggtggccgtgatgctgtacctgctggaccgcttcagccccttcggccggttcaaagtgaacagcgaggacgaggaggaggatgcgctgactctgtcttcggctatgtggatctcctggggcgt

SEQ ID NO: 55097 - DNA, 175 bp, Zea mays
  Clone ID: LIB3068-001-Q1-K1-G3
gaatttgttaatgcaccacacaagtgcggaataaagactgattcaacatacaaggtagcattacatattgtaggttagcattacagcattatgcagtttcacacaattcatgttagcttgtatgttgaatttgttaatgcaccacacaagtgcggaataaagactgattcacatt

SEQ ID NO: 55098 - DNA, 421 bp, Zea mays
  Clone ID: LIB3068-001-Q1-K1-G4
cgaaaccagaggtggccggagctacagccaaggaccactgacatgtctgagttagagaaggccgtggtggccctcattgacgtcttccatcaatattccgggagggaaggtgacaagcacaagctgaagaagtcagaactcaaggagctcatcaacaatgaactttctcattttttagaggaaatcaaagagcaggaggttgtggacaaagtcatggagacactggacagtgatggggacggcgaatgtgacttccaggaatttatggctttcgttgccatgattaccactgcctgccacgagttcttcgaacacgaataaggaaaagaaagcagcggagctgtttctgcagcagagacggagtttgaccaggggaacacaggcagggcttgcagggctgtaggagctgagctttccgtgt

SEQ ID NO: 55099 - DNA, 317 bp, Zea mays
  Clone ID: LIB3068-001-Q1-K1-G5
ctccgctcccgcgagtaacttggctccgggggctccgctcgcctgcccgtacgccgcccgccactcaggaccgcgccgtcggcctctgcctcgagcagaccccttccgacggccctcgctgcgcaggctgggacgcctctcccccctccgcccccgccgcggaaagttaagtttgaagaggggggaagagagagaaacatggacatgaagaggaggatccacctggagctgaggaaccggaccccggcagctgttcgagaacttgttctggacaactgcaaatcaaatgatgggaaaattgagggcttaacagctga

SEQ ID NO: 55100 - DNA, 221 bp, Zea mays
  Clone ID: LIB3068-001-Q1-K1-G6
agaaatgttaaaaatatacacatttgatactactaaagcttgaaagaagttttcaaggtgtaactttatgcaaggtgcagtccataatatctagtataggctctcaaaactgctgaaaattttatcctgaatcacgactgtaatgtctaccacttggaaccagtgcctcgtctgtaatcccatacattaagaaagttgctcatcatattccaaactatttt

SEQ ID NO: 55101 - DNA, 348 bp, Zea mays
  Clone ID: LIB3068-001-Q1-K1-G7
agaaatgatcgacagctacacagtgaatactactgtagtttgcaagaagtacacaaggcgccactgatggcacggggcataggcataatatcttgtttagacgtgtcaaagactgctcgaatattttaaacctgaagcacgactgtacatgtattcatacgtggaaccagtgcgctcacctgtaagcctcatacactaggaacgttgcacatcttattcgcaacgaatatcgttcagcctggtatctatagagcctaactctgtagaagagatcgttagctaaacattatgtctgttgtaactcagataaggatctccacttctgatattgagtactgatattttttc

SEQ ID NO: 55102 - DNA, 351 bp, Zea mays
  Clone ID: LIB3068-001-Q1-K1-G8
gataagctcgcagctcccatgtatctactcagcttgcagaactacacgagcgaacttgtgcagggccatcgcatgtatcttgttacactctcaaaactgtcattattttaacctgagcacgactgtaatgtctaccatctggaaccagtgactcacctgtaagctcataccctaggaacgttgcacatcttattccaaacaatatcgggctgtctggtgatctttagagccttactctgttaaagtgattgtcagccaaacattatgacggatgtgactcaaattagtgtttcccacttctgtatttagtaccggtatttttttttgaagtggcatatgtgactattttaa

SEQ ID NO: 55103 - DNA, 416 bp, Zea mays
  Clone ID: LIB3068-001-Q1-K1-G9
cccagtcacgcctgcggccctctcccctcctctgaaattccccagtgggcatctcctcggtgccactaaaatccaccagcccagtaaccaaggggctggtgttaatccagaccccctccccaagtgcttccgagattaaaaccgcttcatcgggaggtagtgtgtgttcttttccagaactgggctccacagtggtgatggtggaggtggtggtagcagacccagtgaagacagtttcttgcaagctccagcaactcaacagtttctcatctgctgggaacatgggttcccatgtagcaagtcgtacgtcgtgccctgttctccttagctagttaaactcacgagctgtgttttacaactaatccttaataactatggtaattaactgtgactgtgggttttttaaaatctgtcat

SEQ ID NO: 55104 - DNA, 361 bp, Zea mays
  Clone ID: LIB3068-001-Q1-K1-H11
cggacgcgtgggcggacgcgtgggaaacgaatcgccagtccaggttcgaagcacagagtccaagagactgttctatatatcagtgtctcttttgctgtctcgtatacagggttattgttaccatctttctaaattccatatataatgcgttagcatactgtattgtttttctttctggcttacttcactctataggctccagtttcatccacctcattagaactgattcagatgtattctttttaatggctgagtaatactccattgtgtatatgtaccactgctttcttatccattcatctgctgatggacatctaggttgcttccacgccctggctattataaacagtgctgcgatgaa

SEQ ID NO: 55105 - DNA, 245 bp, Zea mays
  Clone ID: LIB3068-001-Q1-K1-H12
gtctctatttgctagtctcatatacactaatcattgatcaccatgctttctaaatgttcatacatacatacttttacctaccgaattgggtattataactagttactggactatattgaactcatattaatctatatcatgctaaatttatgtaagctatgtgtaccaaacatgtattggaatcttagtaagctataatatccccagcacagctataccctcacatgaaaaaagacataaaaggg

SEQ ID NO: 55106 - DNA, 107 bp, Zea mays
  Clone ID: LIB3068-001-Q1-K1-H2
ggtttctgaaaaacacattatgaaaaaaacacaagagtctgaatgtatgttaatccgtaatccctggctgattatccctgtgttactaataaatgtcttgcaacaat

SEQ ID NO: 55107 - DNA, 425 bp, Zea mays
  Clone ID: LIB3068-001-Q1-K1-H3
tgtgttcagaacacttacggttggacaaaaatcatctaacacaaagtgttgaatatctgatgtaatttgttgagtatggtattgaaagtgaaaaccagaacagttgtgtaggtatggaatggttgtaagtgtattagttgtttgttgtcactatcaggtggctgggagctgaggctcccttgctgtccagcatgacgagagaacattgtaccacatttcactagcccaagaaaaaataaaaattctagctagatatggtttccactgaaggtgtctcgctttcacaccattataatgtcaaaaactcaggttgaaccattgttaagtcggagactgtctaaatttattatgtagatgtttattaccaggtaagttttagttaaatctcactcttatccagctgtttcccttattagaaaaataat

SEQ ID NO: 55108 - DNA, 351 bp, Zea mays
  Clone ID: LIB3068-001-Q1-K1-H4
tcccgaccgaccacgcgttctataatgattgcaactgtatctatttatgactcttgtgctgcgttgctagccaaatcggctataatccctgcactcattgagttgctaaatgctcaacaagaagatgatgaatttgtttgtcagataatttatgtcttctaccaaatggttttccatcaagccacaagagatgtcataatcaaggaaacacaggctccagcatatctcatagatcttatgcatgataaaaataatgaaatccgaaaagtctgtgataatacattagatattatagcggaatatgatgaagaatgggccaagaatattcagagtgagaagtttcgctggcat

SEQ ID NO: 55109 - DNA, 411 bp, Zea mays
  Clone ID: LIB3068-001-Q1-K1-G1
tgattatctttaatcagtttttataagcaaattccattgttcctgctattggaacgtaacactgtttacacagcataattgaagttgcaggggagacaggctaaatctgacttcatctgtactcactttcactaagcattgaatggccttaccactcttctgcaagatggaggaagactgcaaaacttagtgcccatcacactgaaggaaggggtgtggctcttttcctgcttctgtactgctacctaactttgtggttagctttggattttaatatctgtatctgctttagattcaagcccataagttttgaagtgacttcagcttcattgtgaaatagctctcttcatatttcatagctacatttcaacaatgctgaactttctactttgatttttagatactttattt

SEQ ID NO: 55110 - DNA, 345 bp, Zea mays
  Clone ID: LIB3068-001-Q1-K1-H8
tgtaaaaatactgaatcaccatgctgtatacctgaaacaaatataatattttaaattgactgtgctttcattttaagaaataccatggactaattcaacactttttcttttgattaaaataaaggattttagcaggaacgtcctgcttattaatggtggcaaccaactggactgtcaatgcttcctgcctcactctgcggtccattctgatatatcttatgcatgatatataatatgtggcttctaagagctgtgataatacattagatatcacaacggaatgttaattagaatgggccaggataattcacagtgatacggatcgctgaaataactttcaatgac

SEQ ID NO: 55111 - DNA, 269 bp, Zea mays
  Clone ID: LIB3068-001-Q1-K1-H9
ggcattagtgctagatactagaaattttcatttccctgttgctattgatcagagagacaggcgttaattaaaaacaaatgtaagaaaggaaagttctcaccctgttagtcggtatctgtgtcctctgttactgaatcctctttggtctccctgttctggctggcatctgctctgctgctccactcttctccgtgtgacatcctgacttataccgacattatcatcgtacaatcttctcttttctcgtcatcttatgtggtgcaggtctc

SEQ ID NO: 55112 - DNA, 387 bp, Zea mays
  unsure at all n locations
  Clone ID: LIB3068-057-Q1-K1-B4
gttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgncgaataaaatgctgtacttatatgcacgcacgttagaaatgcattagtgtctggttgatgtgatnctgtgtgtgtg

SEQ ID NO: 55113 - DNA, 411 bp, Zea mays
  Clone ID: LIB3068-057-Q1-K1-B5
caaacacttgctatgcccgctcctcgccgcgcactgctcagcacgccgtgcccgtgagggcatggacgcgagcgcggccaccgccaggcgcaagcgcaagcgccccgacgccgacaacaccggcgacgccaccgccgccgccgccgccgccccggccgccgtcgacgaggcctacgacgccgaggtcgaggagttctacgccatcctgcggcgcatccgcgacgcctcccgccggctgtgcggcgccggcgcccggcccgccccgcgggcgccggcgtggcggcccagcttctcctgggaggacttcgcgaccccggcccctggcgcgccggcgcctgagacctcgacgcccggcgccgtgcatgagccggcgcagccgcggtccgacgagcctgtagccgtcgtccgcgc

SEQ ID NO: 55114 - DNA, 151 bp, Zea mays
  Clone ID: LIB3068-057-Q1-K1-B8
gactatgcccttcgatcccataatacatgattacttaatggatcgcactaccttcgcgccaatgactcaccatacaaatacatgccctatccacttccgatagtacaatacgtccctaccctggaggacactcgtaacgcctaattataat

SEQ ID NO: 55115 - DNA, 441 bp, Zea mays
  unsure at all n locations
  Clone ID: LIB3068-057-Q1-K1-B9
gggtgtgtcgaaatatatagtggtggatttctttcattaaaaataaaatatacagatggggagaaagcttttattctcaaagcgttgataaaaagccgagcgaaaaccacgtgcacacggcggagtcacagaagcctgacgaaactttaaaagctcctgtgtttgatatgtcagaattagaaaatcttttctcagctgcactgccaagttcagattcaaggcgttcagataagtcaggcagtcgtgcatctgggtcgaaaccagagaaaattcatcttattgatcttcgccgggctaacaattgtggaatcatgcttaccaaagtcaaaatgccactgcctgacctaatgagtgcaattctggctctggatgatactgntctggatgctgaccaggtggagaaccttattaagttcactccaactaaagatgaaattgaac

SEQ ID NO: 55116 - DNA, 132 bp, Zea mays
  Clone ID: LIB3068-057-Q1-K1-C11
taaaaaaaaaaaaaaaaaaaaaaaaaaagttaaagattaaaaaaaaaaaatataaaaaaaaagaaaattgtaaatttttaaatgctactaaatatataattatatattctatcctattatttaatttttttt

SEQ ID NO: 55117 - DNA, 437 bp, Zea mays
  Clone ID: LIB3068-057-Q1-K1-C12
gtcccagtgggtcaaggctatggtttgactgaaacctgtgctggagcagctttcactgaatgggatgacacaagtgtgggtcgtgttggtccaccacttccttgctgctatgtgaagcttgtttcatgggaagaaggtggttacaagatttctgattatccgatgccgagaggagaggtcgtggttggcggacacagtataacaaaaggctatttcagcaatgaagcaaagacgaatgaagtatacaaggttgacgagaggggtatacgctggttctacactggtgatattggccagttccatcctgacgggtgccttgagattattgacaggaaaaaagatatagtaaagcttcagcacggagaatatgtgtctcttggcaaggttgaatcggctctagcaacaagtagttatgtggagagcatcatggtctacgc

SEQ ID NO: 55118 - DNA, 218 bp, Zea mays
  Clone ID: LIB3068-057-Q1-K1-C3
tctcacataaccgtagtcactctatagctattactttcaacaaaccccaacttcctttagggactgattcattatataaaaggctgacgcattctctgccctccgatcctataattcatgataacttgaccgatcacactgacttcatacctataactcatcattcaaattactgccctatcaactttcaatggtataatatagccctaccatattat

SEQ ID NO: 55119 - DNA, 450 bp, Zea mays
  Clone ID: LIB3068-057-Q1-K1-C7
ggtttctatacgaccaccaaaggatggttctttctttaagaaccttccaaaatctagtgctatcaagctgattgattttgggagtacaactttcgagagccaagaccacaattatgtggtgtcgacaagacattatcgtgcaccagaagttatccttggtcttgggtggaactatccatgcgacttgtggagtgtgggttgcattttagttgagctttgttcgggggaagctctctttcaaacacatgaaaacttggagcatttggctatgatggagaaggtcttagggcctctcccaaagcatatgattgtcagagctgatcggcgtgctgaaaagtacttcaagcgcggagtaaggttggacttgccagagggagcggcctcacgagagagcatgaaggcagtctggaaaatgcctcgtctgcagaacctttgtgattgcacatgtga

SEQ ID NO: 55120 - DNA, 362 bp, Zea mays
  Clone ID: LIB3068-057-Q1-K1-C8
ggtcgatactagcttaactgacaagagacagatcgcccatgagcatgtccacgcgagcggactccaccacgcgccagctgctggtcgccgcctgggaaccggcggctaagcctagcaagctgagctcgcacctcacgctgccgtcgatcgtacatgcgcggaccggccccgctcctcgcgtccacctaggaggcgtagcaggcgcctaaggggatcgtgaccccgcatgattgccccaccacggcggacccgatctccaagtgatgcacaaccggcctgatccccatggcgcacttgtacaagttttacaccatcacatagacctacaccaccgagcacgtgctatagatgatcaccggagg

SEQ ID NO: 55121 - DNA, 276 bp, Zea mays
  Clone ID: LIB3068-057-Q1-K1-C9
acgcccacgcgtccgaaaaaaaaaaaaagaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaataatttaaaaaataaaaatattttaatttaaaaaatttaaaaaataaatatttttttttaatttaaaaaaatttaaaaattagtgggttattttaaaaa

SEQ ID NO: 55122 - DNA, 293 bp, Zea mays
  Clone ID: LIB3068-057-Q1-K1-D1
cccacgcgtccgcccacgcgtccggggattcaaaggagcagagggacatctatgggatcaaggacaacctgatcaggttcagcattggagtggaagattttgaggaccttaagaatgatcttggtcaagccctcgagaagatataagctccaatccatttgcattaataaagttatgaagtgatggttgtctggatcttgtagagatttgtgatgatacatgagctgttgactgcgaataagttctcttgtgcttattttattctttgaattcaataagctgtgggttgctgt

SEQ ID NO: 55123 - DNA, 392 bp, Zea mays
  Clone ID: LIB3068-057-Q1-K1-D12
atgcgaaaaaaaaaaaaaaaataaaaaaaaagattaaaaaattaaaaataacataaaaaaaaaaaggaaaaagtgataaattaaaaagttataatgaaaaataaaataaaataataaataataataaaattattaaatcatttatatttatatttttcttattaattattataaatacttatcttatttttaaaaaatattttttataattttttcatattattcttttatattactaatttttttataatatacttttattttattctataatatccttatacttttttttttttaattttactaattttatttttatttatttaattttttattttttaataatttatctcatattccttctttttaattataattattatttttttttt

SEQ ID NO: 55124 - DNA, 399 bp, Zea mays
  unsure at all n locations
  Clone ID: LIB3068-057-Q1-K1-D3
cggacgcgtgggccagcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggngcacaagcagggggacatgctgctggtggtgccgcaaggcgcgcacgcggtgcggctgggcaacgaggcg

SEQ ID NO: 55125 - DNA, 240 bp, Zea mays
  Clone ID: LIB3068-057-Q1-K1-D6
aaaaaaaaaataaaaaaaaaaaaacgaataacaaaaacaaaaaaaaaaacttaatgatccgacaaaacacaaaaggaaagacacataaatcaaaaaataaggcctactcttttaatagctccactcttctttccccttacttcacatatactagattttctatcacctcccttaaatctattcaactgctcgagctttaacaacttccaaattttgaactccttgcccattcctacctta

SEQ ID NO: 55126 - DNA, 425 bp, Zea mays
  Clone ID: LIB3068-057-Q1-K1-B3
cccacgcgtccggagatgaagaagatcgcctgcgccgtcctcgtcgccgcctcggcgggcaccgtggcgctcgccgcggaggctccggctccggcccccaccagcggctcctccgccgtcgcgcccgccgtcggcgccgccctcggcgccgccgtcgcctccttcttcgcctactacattcagtgagccggccgggcgcccggaggccgacgaagagacgaatgggagagagtgagacatggctgcgcgcataccgatgcgtgggcatgttttcgattcgacacaccttttgtcctctttaatctttgttcctctgtctccttaacttaacgaattgatgcatgccgctgatgttcttcccctgagagagggattaacacttgtatcatttcatccgttggcatttgtttgaatccattcaacaa

SEQ ID NO: 55127 - DNA, 436 bp, Zea mays
  Clone ID: LIB3068-057-Q1-K1-D7
atagtgaaaacaaatgaagggctagatcggttctttgatagagaacttgagatattgggaagtgttaaacatcgctatttggtcaatctccgtggttattgcaactccccttcatcaaaacttttgatatatgattatcttcaaggtggaagtctggatgaagtgcttcatgaaaaatctgaacagttggattgggatgcacgtattaacattatacttggagctgcaaaaggcttgtcttacttgcatcatgactgttcgcctcgaataatacatcgtgatattaagtcgagcaacatcttgcttgatggcagtttcgaggcccgtgtatcagactttggacttgcaaagcttttagaggatgaagaatcacatattactacaatagttgcaggaacatttggctaccttgcaccagagtatatgcaatttggca

SEQ ID NO: 55128 - DNA, 51 bp, Zea mays
  Clone ID: LIB3068-057-Q1-K1-D8
tcccggtcgaggccgcgtacgcccacgcgttcggttctagatcgcgagctt

SEQ ID NO: 55129 - DNA, 304 bp, Zea mays
  Clone ID: LIB3068-057-Q1-K1-E1
catcaccagctgccattgccatctactgacctgtgacctccgcattcccaaacagcccgagcgagcgagctagcagagcggcggcaggcacctccctcctcaaggaacatggcccgcacgcagcagttggcagtagtggcgaccgccgtggtggccttggtgctgctggcggcggcgacctcggaggcggccatcagctgcgggcaggtggcgtcggccatcgcgccctgcatctcctacgcgcgcggccagggctcggggccctccgccggctgctgcagcggcgtcaggagcctcaacaacg

SEQ ID NO: 55130 - DNA, 394 bp, Zea mays
  Clone ID: LIB3068-057-Q1-K1-E11
ccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgac

SEQ ID NO: 55131 - DNA, 281 bp, Zea mays
  Clone ID: LIB3068-056-Q1-K1-F3
ctatacatactaaatactatgagagagctagcctgccacatcttctgcttcttcaagagagatcttcttaaattattctatcttccacagctgctgcaacacctgatatgtttgtttgtgttgttattaattattaaggatagctagctcacctttattatttttaataataattcttatctgtacttaactatatcaatcatacttatttatacacttatatttatttgttttaccgtaacttgaatgcttataaaatgtaatttcattgtcttcttttt

SEQ ID NO: 55132 - DNA, 245 bp, Zea mays
  unsure at all n locations
  Clone ID: LIB3068-056-Q1-K1-F8
ngcgagggtggtggtggcggctacggcggctgcggcngcggcttgaaggactggtgtgggggcccatcctggcttcngccganttatcttatctatctatagtatcgngttaccggtcgcttctgtcaccgtgttagtgtccgttctacctttggattaggtgttggtacccctgttgttccctttggttgctcccgctatgaaacgagacgagagaagaatgagcaaggtttttgttcgcagct

SEQ ID NO: 55133 - DNA, 287 bp, Zea mays
  Clone ID: LIB3068-056-Q1-K1-G1
ctctgatgctgctggatctgggagatgagccatgactacacactcagggggcggggctaactatccgccgccagcccacatacatacgaaacactaacagagagctagcccccctcagatgctgcttctccaacacacacctccctaaagtattctatcaaccaaagccgctgctacacctgatatgtttgtttggggtgttattaattaggacggactagctagctgatctatattatcgtacacaataatgctacgctgtacctatctataacaagcacacaaat

SEQ ID NO: 55134 - DNA, 400 bp, Zea mays
  Clone ID: LIB3068-056-Q1-K1-G12
gaaccggaggaacgaggatggaggatgactcgccgctgacgaagactatgagagggtggggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaata

SEQ ID NO: 55135 - DNA, 171 bp, Zea mays
  Clone ID: LIB3068-056-Q1-K1-G4
acttgagacgctccacgtggcccatcatttcaaagactccggcgagcaagcctacaaggggttcgccctagctgacgtcttcggcgcctccaacttcaacgacgagcgcttccaagatagcggctgcgttttccggagttactaagggggctatctcaccgccgaccactc

SEQ ID NO: 55136 - DNA, 271 bp, Zea mays
  unsure at all n locations
  Clone ID: LIB3068-056-Q1-K1-G8
ctctgtgcaagatgcagactttgttcangttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagngatctttgttatccatcttcaagctctgaggacatgctttaccctgctgagctcccattcatgattgatcttgatatcact

SEQ ID NO: 55137 - DNA, 413 bp, Zea mays
  Clone ID: LIB3068-056-Q1-K1-G9
ggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaaggccgccagggcgctcacggccaagatgctgctggggctcaacgtcggcgtctttggactcgccgcgctcgccaccatggtggtctccagcgccggcctccgcgtgcgcgtgctcggatggatctgcgtcagcgtcg

SEQ ID NO: 55138 - DNA, 263 bp, Zea mays
  Clone ID: LIB3068-056-Q1-K1-H12
aaaaaaaaaaatatataaaaaaaaattttacacccaaagaaaaaaaaaaaaaaaaaccggggccaataaaaaaaagggggccgcactcaaaaaacctccattttacttacccatacattcaaccttttccctcttctattatgtctcctaaactaaaatccctgaccccaaacttttaaaccctatacttttgaaaaacctacggataccccaacttaatctccttttcccacataccccctttgcccacaagcttaacacct

SEQ ID NO: 55139 - DNA, 385 bp, Zea mays
  Clone ID: LIB3068-057-Q1-K1-A1
cccacgcgtccgcccacgcgtccgcccacgcgtccgtcgatctgcaagtctcgctacgtgagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggag

SEQ ID NO: 55140 - DNA, 358 bp, Zea mays
  Clone ID: LIB3068-057-Q1-K1-A11
cgacccacgcgtgcgcccacgcgtccgcccacgcgtccgcccacgcgtgcgctactccgtcaccctcaccgtggggggatgggtactggttttactgggagccgcattaaggatccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgattttaacgaccaggccgaccccgaaagctagcttggaccaaaaaaaaaaaaaatatctaattg

SEQ ID NO: 55141 - DNA, 416 bp, Zea mays
  unsure at all n locations
  Clone ID: LIB3068-057-Q1-K1-A3
gttcgacgccacgcgtccggccggagctggtgggcgtcctcggcgcgtccagtaagccccccgaggcgcgggagatggcgggcgagtcgctgtgcgccctggtgaccgtgccccgcaaccggaagcggttcgtccaggaggaccgcgacgtggcgcgggtgctgcagctgctgggccccgacgaggagaaggagaagcccgcgccggcgaggcggttcctgctgtcgacggtggcgcacctcacggacagcagctccggccggaggaagatcatgtcctcggagcacgtcaggtaatacagtacgatacgaacaacacgcacacgtagccaatcatcacgtgctcatcaattatcgctgcagttctcagttnttttttttggaaaaaaacaaatgcttgtggtctcgtggcaggaa

SEQ ID NO: 55142 - DNA, 113 bp, Zea mays
  Clone ID: LIB3068-057-Q1-K1-A4
cggacgcgtggtaaaaaaaaaaaaagattaaaattaaaaaaaaaaaaaaaaaaataaaatgtaaatgtaaaaattaataaaataataaaaaattaactctaaaatattaaaaa

SEQ ID NO: 55143 - DNA, 428 bp, Zea mays
  Clone ID: LIB3068-057-Q1-K1-A5
acgcgtccgtgcctcgacattcttaaggacaaatggagtcccgctcttcagatacgtacagttctgcgcaggtaattgcttattttatcgtctgtttggctaaatagctgtgatggtgggtggtatatgatgatgtactctgcattgtatcaatactgcatccaatttttggcttgcatatggttctagcatatcagtgtgctaccacactgcccccctgacaatatttggtcttcagcattcaggcacttctgagtgccccaaatccagatgatcctctctcagacaacattgcgaaacactggaaatcaaatgaagctgaagcttttgagacaggtacttgtagttgcagtaaacacagttatgaacatagtgttggtatggtttctgcttcacgtctatattacagatgtcctaacatggcagtc

SEQ ID NO: 55144 - DNA, 457 bp, Zea mays
  unsure at all n locations
  Clone ID: LIB3068-057-Q1-K1-A6
gccatggattgcttcttgtgccccatgtcctgctgcgacgacctcctcgtcctccacggcgccggcggacaggccggcaccggcagctgctgcggctccacggccagcgacgagtacgggtccagcgaggaggacggcgccacgtggggcagcctgtggaacctcgacggcgccggggaggtgtgcacgctgtggtagagatcgattcgctaacctgccgctgccggccgtactgcagcggcaagccgcgcgcatgccgttctgcttgaggggagggaacagccgaacaggtgatcgtcgtcgtcgtcgtcgtgtggtgctggtggataaggacggaacggaacaactgctaccgcgtacgttcactttgcagccgcatcactgcatcagcagctataccgcgcgccgnctgagccgaggacacgtgtgtcgttaagctccggtgaaccgaactttt

SEQ ID NO: 55145 - DNA, 404 bp, Zea mays
  Clone ID: LIB3068-056-Q1-K1-F10
ggtgacgtgagccgccccaaccccatgaccgttttctggtctaagaccgcacggagcgtgacttctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatgga

SEQ ID NO: 55146 - DNA, 430 bp, Zea mays
  unsure at all n locations
  Clone ID: LIB3068-057-Q1-K1-A7
tgaagactcgtgttattggttgcccaaagactatcgatggagatctgaaatgtaaggaggtaccaacaagctttggatttgatactgcttgcaagatatactccgaaatgattggcaatgttatgactgatgcaagatccacaggaaaatactaccactttgtgaggcttatgggtcgtgctgcttctcacattacattggaatgcgctttgcaaacacaccccaatgctgcactcattggggaagaggttgctgcgaagaaagaaacccttaagaatgtcacanactacattactgatatcatctgcaagcgtgcagatcttggttacaactatggtgttatccttataccanaaagcctgattgatttcattccaaaagttcaaaaactcatcgcggaaatgaatgaaattttagcacatgatgttgt

SEQ ID NO: 55147 - DNA, 420 bp, Zea mays
  Clone ID: LIB3068-057-Q1-K1-A9
agcaacagcaaccactctggcgccaccttccctcggtcgtgcaacgcgttccagctcatggcgtccatgtcctccgggttcgacctgtcggggctgttcgagagcgagcagaagaccgcgaccgtgttcacggcccgcgcgccggcggccaccgtggtggagaagctggagtccgtggcgcgcgccctaggattcgaggtcaccagggggaaaggctggaaggtgaggatggaggccaaggccgagggcacgaacggacggctcgcggccaccgccgaggtgctcgaggtggccgtggacgtgaccgtggtcgagttcgtgcacgacgccggggacgcgctggactttaacaagttctgcgccgtcgacgtccgcccggggctcacggagatcgtctgggcgtggcagggcgacagcccc

SEQ ID NO: 55148 - DNA, 246 bp, Zea mays
  unsure at all n locations
  Clone ID: LIB3068-056-Q1-K1-C1
cagactcntgggcgaacgcgttacgccttcctttttttttttttttccacacgacattgctgttctccaatgactcatcttaacacacctcccttatattttaacaaacatgcctccccaaccaaaattcacacctaacaatggttttccaccttatcaatctctttaaatacattcctcatagccaaacatatttgttttccactcttttcaatttacactaaccataaaattttattctaaatt

SEQ ID NO: 55149 - DNA, 309 bp, Zea mays
  Clone ID: LIB3068-056-Q1-K1-C2
ttagcaatgttgcatgagatgcataaactgcctgaactaagaagagacaatcatgcgcaagttgtattaactaataatcgcagaagggcttcttacacagcgctcgaaatacaagcaacatggataacatataatgatttcaactcaaatcaaataacacttaccataaagtcttatgctaataggaacgtgatttgacaattattccattatatctagagagtaaatgcttggtaacatgaaaatagaacaacttttaaatcattatttctatgaccatttcatttaacttcatagtaaaaattaggc

SEQ ID NO: 55150 - DNA, 416 bp, Zea mays
  Clone ID: LIB3068-056-Q1-K1-C4
ggcaggattccggcgtcgctcacgatgttcaccgagctcaagcacctctacgtcgccggcaaccggctcagcgggcgcgtgcctccggacctcggccggctccggatgctcagccgcgcgctgctggcgcgcaaccggctgtcgggccccatcccggcgtcggtggcgtagctgccccggctcgccgacctcgacctctccgagaaccagctgacgggcgcgatccccgagggtctgggtgccggccccgggaatagcggcgtgctcacgacgctgtacctcggccggaaccggctgtcgggcggcgtcccggcgagcctgcttcggagcggcgggctcgggatgctcaacctcagccggaacgcgctaggcggcggcggccccgacgcgttcacgccgagctgctacttcatgct

SEQ ID NO: 55151 - DNA, 235 bp, Zea mays
  Clone ID: LIB3068-056-Q1-K1-C7
aagcattctgctgaactttccaaccgtttagacaagcaaaattaatcactaatggaaagatattttacaatggtgcatgagttgcataaactgcatgtacaagaaaagacaatcattcgcaacttttattaactaaaaatcacagaacggctagctcccaatctctataaataaaatcaacatggataacataatatgagttcaactttaaactaaaaacattaaccataaattt

SEQ ID NO: 55152 - DNA, 219 bp, Zea mays
  Clone ID: LIB3068-056-Q1-K1-D1
aagactccttgtcaaacgcttttggatattaaaaaaacaaaatcaaacactaagggaaggtatatttatcaatgttccatgaattacataaaacttcatttaataaaaatagacaatcattcacaacttttattaactaatttatatcagaagttctttttctaatatctctagatataaaatcatcatggttaaaatattttgttttcaatttaaaac

SEQ ID NO: 55153 - DNA, 398 bp, Zea mays
  unsure at all n locations
  Clone ID: LIB3068-056-Q1-K1-D11
aaagagggaatagtgtgcatggttcggtggggattccctggaataaaacgtcncatcttccttcaattccttgtgcgggatatccaatcaattagaattcaggttaaagagggtctttatcctcgtcgtatcctttatatggaaatccggggccagggggtcattcccttgactcgtactgatgagaagttttttactccacgagaaattgaacaaaaagctgccgaattggcctatttcttgcgtgtaccaattgaagtattttgagtaccaattgcaattttttgcaattgtaaggggattttcgagtatttatctaaagtaaaggaaggaacaaacgaggataagagaaaattgcttcgaatttgttttgtccaaatgagatatatggcatacta

SEQ ID NO: 55154 - DNA, 420 bp, Zea mays
  unsure at all n locations
  Clone ID: LIB3068-056-Q1-K1-D12
tccggggaaccccttccgttcgctccaggggcggaggaaggggagctcgacgcacccaatgggcccgcccacggaacgcgccgncgccgncgncgtcatcacatcacagaggcctcgccgtcgtctcggatattccccgccgtaggaccagtttccctccagctgccggagaccatgtcgggcggcctggacatgtccctggacgacctcatcaagcagtccaagtcccgacccaaggacagcccggcgtccttgtcggggcctgcccgccgcgcgccacaaccccgccgcgccgtgccctacccaccggccgctcccaaggcccgtgccgncgccgactcgccctacggggtctactccaagcacatcgccgcgatagcgccgcccccgctggccaaagcaaggtcgcttgagacggga

SEQ ID NO: 55155 - DNA, 384 bp, Zea mays
  Clone ID: LIB3068-056-Q1-K1-D4
cccacgcgtccgattacatgtggggcaactcctgcaatggaaatactgagttggtgtggggctgatccaggaaatgcatttcttgtgccatcaccttactacccgggttgggatagggacataaaatggcgaactggtgttgagttgatacctgttccttgtcgtagtactgataactttaatgtcagtgtcactgctcttgaaatagcttacaaacaggcaaaaaagcgaggaataagagttcgtggggttctcatatctaacccttcgaacccaacgggaggcattgtgccaaaagaaatactgcatgaccttctacagtttgctgcagagaagaacatacacttaatttctgatgaaatatttgctggttcaacatatgga

SEQ ID NO: 55156 - DNA, 433 bp, Zea mays
  Clone ID: LIB3068-056-Q1-K1-D5
cccacgcgtccgcggacgcgtgggcgctctgcagaagctggacctgagctacggccgggtgtactggccgctccccaagggacacggcgtcatcaagcacgggtgcaagccgtacgcgcacaaccagtgccgcaaagggaccccgctcgcgggctgccaggacctggagtggagtgagtgagccggtggcggccttggtttctctgctctgctctccctcgccggcgtgcttcacgatcgtggtgtgtgtaaggaactaaggacgacggtgcctggtttaggagtttagctatagacgaaagcacgtacggccgcgtgcctggtctagctacgcggcctggttgatcttgagcagttaagcgtgtacgaaacgacagctgtgtacgtgtgtactgtctgatggagtgtgagaagtacttggtgtatttggtat

SEQ ID NO: 55157 - DNA, 117 bp, Zea mays
  Clone ID: LIB3068-056-Q1-K1-D6
cttgcttgtactttataatgatttcgtcatatggttctcaatatttgctattgttagtgatgttagcatcataatcttgagtactacacaatactaatatagtacatactttttgtt

SEQ ID NO: 55158 - DNA, 428 bp, Zea mays
  unsure at all n locations
  Clone ID: LIB3068-056-Q1-K1-D8
agatgataaaggcaaaatgcccttaaatcatattccaggaggagctggtagcgagaaggtgctgaaactcctcactcatcatatggaagagcaaagaaaacggaaagctctcatgtcatgcctcgaagggaaagcaatgtcagagtttgaagaggcaatgtcacaaattgttggattgcaggagctaaaaatgcaattgcgccgatgggcacgaggaatgttttttgatgagaagcgacgggctatgggcttggggattgctaaaaggagagctccccatatggcatntcttggcaatccaggaactggcaaaactatggttgctcgaattcttggaaagctcctacacatggttggaattcttcctactgacaaagtaactgaagttcagcgaactgatcttgtggagaatttgtggggcatactgg

SEQ ID NO: 55159 - DNA, 412 bp, Zea mays
  Clone ID: LIB3068-056-Q1-K1-D9
cgtttccacagcagccagcacacatttccctttggcggatcgaaggagggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaagacgaggatgcaggtcggccatacaggaagttcctgtaagcggcgtccagggctgcagaatacgtcgattcctcgaccggggcttcgaagaggggagtttctattcagtttgtatcggtattgttttagtctgaatctgatgaagcaatttggaatgcttgattattgtgcctgat

SEQ ID NO: 55160 - DNA, 415 bp, Zea mays
  Clone ID: LIB3068-056-Q1-K1-E10
gaagaaaggaatccctcctacgcggaagcgaagagattcgtcgcctcagccgcctctgtgctcagatctgcggcggagcctcgccggcggcctgcgcccgcggcgccgccgatccaagatgccttcgtgcgtgcagggctgctgctgctgctcgtccctgcgccttctcccccgcgacgacgcgctctcgtccccctccgcctgcgcgcaccgcctgaagccttggtcttggcgtgcccaatcccccacctcgtcctcctaacgcttgtccccgcccgctccccaccctgatctacctgtctctacccttccctcctccatttctacatctccccgttgctgctctgctcctgctgccacaagagtattcgccttcaatcgttgctcgcgcctgtcatttcgtgccgcacgccga

SEQ ID NO: 55161 - DNA, 381 bp, Zea mays
  unsure at all n locations
  Clone ID: LIB3068-056-Q1-K1-E11
cccacgcgtccgcacgctcgagacgagagccagctctcccagcacacgagcacatggggtccaccaccctcctcgctgtcttcctgctcgtggctgcgtccgcagcgccggcgcggtcttgctcacctcgcgacctgcaggcgctgttgagcgtgaagcaggcgctagggaacccggcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggngctgacgggccccatcccgg

SEQ ID NO: 55162 - DNA, 395 bp, Zea mays
  Clone ID: LIB3068-056-Q1-K1-E12
gcccaagaggagaaaatgctaatggcaagatcttctaaggataaatttgaacatcttcaaagccagtatgtagatttgacatcagaaaacaatgctctcaaaactgaaattgaagaactgaagtccagactcatagagttgcagagaactcaagaaattgttatggttcaacatgttgaagaatgccaagtggctgaagataagatcagaactacaagggagaattcagaagttactagaagattctacctttgctgaaaatcacaagcaagagttgcttcaaaagattttgaagctagaatcagataatcaggaactcctaggacaaatgcagtccattatggaagagaaatcaaataatgctgaatctctgcatggagagataactaagcgtg

SEQ ID NO: 55163 - DNA, 419 bp, Zea mays
  unsure at all n locations
  Clone ID: LIB3068-056-Q1-K1-E4
cccacgcgtacgcccacgcgttcgcgcactcgtgcgcccacacttccncccaggcgtgcggaaaaagcgggcagattgccacggcctttgtttatgccgcatccaccttcctgctttcttttctgctaggaactctagtgtattctgtgccagtttgggaaaagcattataaatgacctattgcaacttccagattcaacattttaccagatggcttaaatgtgcaatgggaaagagagcatcaacttcctgaacaaagtacaagatacagagccaagacctcaaaggttcacagatgcaaaagagagcatcaacacaaacgtttgcagaatggacccacagaaccatctatatacctggctgggaaaaacagnagtaaacttgcttagtagaatatgtagtggcgtggaataattttt

SEQ ID NO: 55164 - DNA, 309 bp, Zea mays
  Clone ID: LIB3068-056-Q1-K1-E6
ccgcctgggacgaagccatatagtagatctagccatgccatgtccactgcgctgcctgcgaacgcgttcgccggtgcccctgcccgtggtctttatcatcttaccaaccacgagactttgcttctaaaccagaggctccatctgtgtgccgccttgttttactagaaatccttttttattttatcctttttcacttttcctgcctagtttttttccttatcctgccattgtacaaacaatttctccagtgcttgtagcttgtggacttgggttgtccaacatgtcatgaatacaaactgagtttgcttc

SEQ ID NO: 55165 - DNA, 184 bp, Zea mays
  unsure at all n locations
  Clone ID: LIB3068-056-Q1-K1-B6
cggacgcgtgggcggacgcgtgggatcttgattttgttatctatctggtgtggagtttttagttgttcatggtgtcanacatgttgcancgtcagtgttaagtcaggaagtgcctgagtatgcacctgttcagttattatgttttgatatggtttctcaatttcttaggataactctgtagtct

SEQ ID NO: 55166 - DNA, 374 bp, Zea mays
  unsure at all n locations
  Clone ID: LIB3068-056-Q1-K1-F1
cggacgcgtgggcggacgcgtggggtgtggtcctcttccagccgtcnatcattggtagtgaggctgctggaatccatgagacaacatacaattcaatcatgaagtgtgacgtggatatcaggaaggacctctatggtaacattgtgctcagtggtggttcgactatgttcccgggtatcgctgatcgtatgagcaaggagatcacttcccttgcaccaagcagcatgaagatcaaggtcgttgcaccgcctgagaggaagtacagtgtctggataggagggtcgatcctagcctcgctcagcactttccaacagatgtggatatcgaaggaggagtacgacgagtctggcccggcaattgttcaccggaagtgc

SEQ ID NO: 55167 - DNA, 249 bp, Zea mays
  Clone ID: LIB3068-015-Q1-K1-B6
gcgctgacgcatgggatcccaactccaactctacctctctctttcgcctggcaaatcctcggcggggcgggagcctgcttattcaccggcgcggctgactgcttcttcgactacgcggatgcctgctgcagacgcgacgcggcagcctaccggtcgaacggatccgccgacgaacggatctcctgcgcctgatacatcttttgcacgcggactaccgattggaccgatctccgttgcctggtatatcct

SEQ ID NO: 55168 - DNA, 325 bp, Zea mays
  Clone ID: LIB3068-015-Q1-K1-B7
cgacgcacgggtcactcgacgcgtgagctagctgtataagtcgagtatagcttgatctacacaagagacaaagcagggcacggacaatgtccctcgcctcctcgtcctccgtcgctgctcctgctcctggccgccgacttcgctatcatgagcgccaacacgaccaccttcaccatcaccaacaactgctggttcaccgcgtggtccgcggccaccccgttgggcgccggcactcagctgaacccgggcgcaacgtgtaccgagaacacgccctacgtcaccagctactgccccgtgtagtgccgcaccggcatgctccttaaca

SEQ ID NO: 55169 - DNA, 296 bp, Zea mays
  Clone ID: LIB3068-015-Q1-K1-B8
aaaaaaaaaaaaaataaaaatataaaataaataaaaaaaataaaaaataataaaaagggaagggaactaattattaaacaaaacaaagggcctgccttatttagaggactccaggattttctgttcgccgtacccttacgacggccatactatttggtatagcggatctctattcgaattgatttcccgtgctttatcaatctttggcttgcgaactccctggtggtccgatctttagtgccttggatatacttcgccttttggcttgcttctttatcggcgccgaggcctgatcc

SEQ ID NO: 55170 - DNA, 458 bp, Zea mays
  Clone ID: LIB3068-015-Q1-K1-B9
gggccacatcatggtctgcaagatcgccgagaagtacctgtcggagaaggcggcggcggcggtgaaggcgttgctgccggagtcggcgggcggggagctgtcggcggtgtgcccgtgggcggaccaggtgcgctggcactaccactgggccagcccgctccactacgccaacaccccccaagtctgcaacttcaagttttctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttcgaagatgacgagggcggtaacaccatcaccgtccactggtaccggaggaaagcgaaccttcatcacgtgtgggatgtcagca

SEQ ID NO: 55171 - DNA, 418 bp, Zea mays
  unsure at all n locations
  Clone ID: LIB3068-015-Q1-K1-C1
cggacgcgtgggccaccatcgatctgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgngagcntgaggtgatcccactccgctgggccatgnctggcgcgctcggctgcgtctttcccg

SEQ ID NO: 55172 - DNA, 171 bp, Zea mays
  Clone ID: LIB3068-015-Q1-K1-C10
ctcacgcgtacgcctacacctatctttcttttccatactacagcctctcttctctgcaactcgtactactacaacttccttatctttcaacacatcttccatcccatccacatttcccacatcatactaatttaccacctcaacatcccctacaatccctccttttacacc

SEQ ID NO: 55173 - DNA, 333 bp, Zea mays
  Clone ID: LIB3068-015-Q1-K1-C11
cggacgcgtgggcggacgcgtggggtgatattggttgggacgaaaatccatgctttctggtttcatgtcacatgcaacttgaagcatgcctacctgcttggttaacccgctgtcagcagcaacgatggagttcaaggcagtggatcttccactagattattttgcaaaagggcctttgctggggtttttaagggaccaaatgcactgggaaccattcctttggaaaagcttttcttctctggtggggaaaatttctgcttggcctgaaggctattgccggttggccaaagtgtgaaagactactagaagtgtgctgatagcgtatttacttgc

SEQ ID NO: 55174 - DNA, 248 bp, Zea mays
  Clone ID: LIB3068-015-Q1-K1-C12
tgatcaggggcctggtgccaactgacgttgccgacattgttacattgcccagatgctgttcaccttggacacctgatacgactatgactactaccgcgcgtacactgaattatgtccttcggattttcaaaggatctctgaggcgcatcctacaccgagcaatgtgcagatctatttcttcctctgtaccctacctttggctaaaccgattcctagaatgacaggactttaatcataaaagataactc

SEQ ID NO: 55175 - DNA, 359 bp, Zea mays
  Clone ID: LIB3068-015-Q1-K1-C2
cccacgcgtccgaataaaaatacacaaaaaattataattaaaaaaaaaaaacaaaaataaaaaagaaagcaaaaaacataaaataaaaataacaataaaaacaaaaaaaaagcaaataaaaaaaatacatcacctttgtcacttccaataatgagctatcagttcaaactttatcataactcctatcgattctcaatatatatgcccaaatccatgcgagacgctagtgattataatttctacatcttcttactacctagacttgctacaacttacctgcctctcttcaaagagttttttgttaacagatttgaagtctccctggttctgcctgaatttacttctgtaacgctttccat

SEQ ID NO: 55176 - DNA, 433 bp, Zea mays
  Clone ID: LIB3068-015-Q1-K1-C3
cttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaagaac

SEQ ID NO: 55177 - DNA, 444 bp, Zea mays
  Clone ID: LIB3068-015-Q1-K1-C5
cccacgcgtccgcccacgcgtccgggacgagcagggcggcgggggagaaggcgaggacgggcgtggcgcccgcgcggcggcatcccgcaaggtggcctccctcttctcgcagaagggcaagaaggggcccaaccaggacgccgtcatactctgacagggattcggcatggatgacggcctgttctgcggcgtgttcgacggccacggtcgttgcgggcagttcatcagcaagctggtgagggactacctaccgttcatgatcctgagccaccggaacgcgctcctcatgggctccgacgactacgactacgacccggtcttcagcgacgcgtcggcgtccgcgtcgtccacggacggcagcgggcattcgtagccggcgccggctcacctgctggaggagtggcttggaggcctgcgccaactcgttcaaggccatggacaagg

SEQ ID NO: 55178 - DNA, 262 bp, Zea mays
  Clone ID: LIB3068-015-Q1-K1-C6
acgcccacgcggtgcgccacgcgtccggctcgcgtcggcgcaaccgcaaatctggccaacggccgccgaccgatcgaccccgcttgccctcggcgcggccaggcgcagcaattcaagtgcatcaccgttgctacttccataacgtgctaacagtcaaatttgtcaagctactgttgatgctccagatatagtagaaaaccatgggagaagttagtgatgataattccaacatgtcctttctaaaaagaatcgcttcaagtga

SEQ ID NO: 55179 - DNA, 443 bp, Zea mays
  Clone ID: LIB3068-015-Q1-K1-C7
ctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcagactggtgagatccggtgcgccatggatcacatcctcgaggccgagaggaagggcgagatcaaccacgacaacgtcctctacatcgtcgagaacatcaacgtcgcagcgatcgagacgacgctgtggtcgatcgagtggggcatcgccgagctggtgaaccacccggccatccagcacaagctccgggaggagctcgcctcggtgctgggcgccggcgtgcctgtgacggagccggacctcgagcg

SEQ ID NO: 55180 - DNA, 339 bp, Zea mays
  Clone ID: LIB3068-015-Q1-K1-C8
ctgacgcgtagagcggaacgcgtgggcggacagcgtgagcggacgcgtgggagatgtggtaacgcgagaactgctattatgcatgcagcagccgtaagcattgctactagggtttcatgcggggcgaagcaattggtctatgccgcctgaacgcacggcggaatctgttaggcctacccgagctgcgtacgacggcagataaggcagacgtcgtcacggcaatgccggatatgcttgctgcggacccagcttttccagcgccattcacgccaaccaattgggtccacagacagctcgtctgttcagggtgctggaactttctcatgttgccagattgtg

SEQ ID NO: 55181 - DNA, 453 bp, Zea mays
  unsure at all n locations
  Clone ID: LIB3068-015-Q1-K1-C9
cccacgcgtccggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcngccggcaagcgctgaacctgaacctggtgggc

SEQ ID NO: 55182 - DNA, 441 bp, Zea mays
  Clone ID: LIB3068-015-Q1-K1-D1
ccacgcgtacggcgcgcttgagccacgccatttcattccactggcggagctcgaccgcgagggccgagcgggaacatgaacccctgcggggtcttgtacacgtaccggcggctcttgtactgccagaggccgaggaccggctcggtgtctccgaggacgccggcctactccagggccttgcgccgggcgggctactgcatggactcgtacacctcccaccgcgccttgttgaacatcatgccgtgccccttgtgggacgtgatctccagcacctgcagctcgccttcgcaccgtacgcggtactggatgcagcccaccacgatgcgcccgccggtgctctggctgtaccactgcagctcgcgtacctgcctcttgaccagcacggccatgatggagatacgcatgctgcttctagctgattcgttctcgttgctatagcgg

SEQ ID NO: 55183 - DNA, 457 bp, Zea mays
  Clone ID: LIB3068-015-Q1-K1-D10
cccacgcgtccggcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgaccgacccgtcgccgccgccgtcgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgagaagagaatgagaagacaaaagctgagaacaaggctgctaagaaagtatccgctattctttcatgggaaaacacaaagaaagcaaacatagaagctgaactgaagaagattgaggaacaactggaaa

SEQ ID NO: 55184 - DNA, 321 bp, Zea mays
  Clone ID: LIB3068-015-Q1-K1-B5
gacccgttggctaactctatagctcgagtattgcttgctctccacaagaaacaaagcagagcaccgacaatttcctacgcctgctcggcctcggtcctcctgctgctcctggccgccgccttggctggcatgagcgccaacgccgtcaccttcaccatcaccaacaactgcgggttcaccgtgtggcccgcggccaccccggttggcgggggcacgcagctgaacccgggcgggacatggaccgtcaacgtgccggccggcaccagctcctgccgcgtgtggggccgcaccggctgcttcttcaacggcaacaacgggagc

SEQ ID NO: 55185 - DNA, 169 bp, Zea mays
  Clone ID: LIB3068-014-Q1-K1-H1
acgcggaagggagcttcgaggcggtccgccacttctcgttgatcgggcgggctgagccaatgtgacaggcctctatggcgcgaacgcactatacatcttcctggctggctgcaagcagactcccgctcttctaagctccattggtactctaaatcattaattcctcata

SEQ ID NO: 55186 - DNA, 459 bp, Zea mays
  unsure at all n locations
  Clone ID: LIB3068-014-Q1-K1-H4
cttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgtcagggctgccgggatcaagccggaggtcgccattaccatccccaagcgctgcaacatggccgaccgncccgtcggctacaagtgcggagattacacgctgccctagctgatgaagacgtcgtcaacgagaccgtgcgagtcaagtgcatgaacgaatgccattatgccatgcaactatg

SEQ ID NO: 55187 - DNA, 462 bp, Zea mays
  Clone ID: LIB3068-014-Q1-K1-H7
cacacacacgcaggcagcagtcaagcggccaacctctgtttcacaccgtacatgcgtgccacgcccacaccgcagcccccgatgtcgtcgcagcgcccgggccgtcaccagcgccgcgcgtcgcagagcgtgttcgtgctcccagagaacctggcctccctcgacgtcgacgcggcggccgacgcgggcgccaaggccggcgggccagaaggcgccggcgccggcgccgagcagcaggcgaggccgcccgcggggcgtcaccaccgccgcgccatgtccgtggccgcggccgtggcctccagggagcttgagctgatcaaggaggacctcggcagctacaactacaaggtcggcgcctgagagagagagagagagaggagccggcacgctgcgtcatgtgtatagagcttgtgggttaaccgtacccagagctggctttgatcgacgattaacagtggctta

SEQ ID NO: 55188 - DNA, 247 bp, Zea mays
  Clone ID: LIB3068-014-Q1-K1-H8
gagcgacctgcggtgcgcgccccgccgggcaagctctaactccaccaatcatgccgcgcgcgccgacgccgccgcgccgtgctggcccccatcggcccagtgctgcaccatcggccgggatcctgggaccgagttgcgctatgcgatgaaactcggctgctgtcatctcgcgaacaataatgtagcgcggcggctatgggtcttagccgcacatgcagcagtgcgtgcgttatacatcgccagacgg

SEQ ID NO: 55189 - DNA, 357 bp, Zea mays
  Clone ID: LIB3068-014-Q1-K1-H9
gcgttcgtgaggttctccggggttcggtttcgtgggtgagcggatcgagatggcggcatcggatgttgagtaccgctgcttccacggcggactgcactgaaccacagacgaccactccctacacaacgccttcagcacctacggcgaagtcctcgagttcaagatcatcctcgatcgggagacgcagaagctccacggctactgcttcaccaccttctccacggaggacgcgatgcagaacgccatcaagggcatgaacagcgaggaactggacagacgcaacatcaccgtcaactaggcccagtcccgatgaagccgcggatgcagacgcagctgcaggtactgctgtagccgatg

SEQ ID NO: 55190 - DNA, 391 bp, Zea mays
  unsure at all n locations
  Clone ID: LIB3068-015-Q1-K1-A1
gtgacaggagcaggaagcgtggatcgcgaccggctgcgacgtcgacgcgcgccgggcggaggtggaggagacgcgcgagcaggctgctccggcgccggtcgagccgtgcctgtcctcgttcgtggacatgtcggagatcttccccgccagcgtcacgctcagcagcggcggcgacgtggacaatagcggcaacaagccagacgaggaaacggccccgcgaccgcagctgttggccacgacggcgctggtgccggtgacggaaaagaagggcggctacgacgtggcccaccccgaccgcggcacggtgatctcgcgctacaaggagaagcggangaacaggatgttgagcgggcgagccggagtagtggtagctccgatcgacaccacagtc

SEQ ID NO: 55191 - DNA, 456 bp, Zea mays
  Clone ID: LIB3068-015-Q1-K1-A10
aaaaaatcattggcttatcaaattctctatcgagccgtgaaaaagattcaacaaaagacagagacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatc

SEQ ID NO: 55192 - DNA, 264 bp, Zea mays
  Clone ID: LIB3068-015-Q1-K1-A11
aacacaccatcgactgatcaaattctctatcgatccgtgacttagatacaacaattgactgtgacaaatccactattggtttcacgatcagcaatacgtatagtaactcccaatttatgaatctaatcaagacgtaatagcaaaccatcgactcccaaagttccgactgacataggacctaaacatggaagagcacttgccattcgtaaactattaaaatcataccaaaaccgtccaggtcgaaatatggctttcaaattaact

SEQ ID NO: 55193 - DNA, 422 bp, Zea mays
  Clone ID: LIB3068-015-Q1-K1-A12
ctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagc

SEQ ID NO: 55194 - DNA, 254 bp, Zea mays
  Clone ID: LIB3068-015-Q1-K1-A2
gtgacaggagcaggaagcgtggatcgcgactggctgttacgtctacgcgcgccgggcggagggtggggagacgcgcgagcaggctgctccggcgccggtcgagccgtgcctgtcctcgttcgtggacatgtcgtagatctttcccgccagcgttattctcagctgcggcggcgacttggacaatagcggcaacaagccagactaggaaacggtcccgcgaccgcagctgttggctcacgactgtgctggtgccg

SEQ ID NO: 55195 - DNA, 458 bp, Zea mays
  Clone ID: LIB3068-015-Q1-K1-A7
ccgacgccccgcaatttttcgcgttgccattttctccccaatctgtcggctaccgcgcgtcgctgctgtttcccgcgttgttttgcccacgcactcagtttagttggcagcggagtggaaagcgacgacggtgagagagaaagtggaggcggcggatgaaccgtcgaagacagtatgctgtcaacgacgacagtgacaagcagctgatgcgggagatcctgtccttcaccggtgggatgccgcaatggcagatggccgcacccgaggaacacgacgtcgacggcggaagggagcagcgaggtgcgttcgaaggagcaggtccacaccatcgtccaattgacgtcgacgaatcagatccacttgttgcttccgtgttcccttgcaacgacgacctatctgcaacaatggagctcgcgcccaataggaatggatacttttcgaggatgatggatgacaat

SEQ ID NO: 55196 - DNA, 453 bp, Zea mays
  Clone ID: LIB3068-015-Q1-K1-B12
cggacgcgtgggttgaagtttttttgcatttcaataagccatttccttttgaagaagcagcatctccagagcatgtcatagttgctgagtctatttgcaagattttgaggacgttttatcgtgttattgaagtcatttctgcctctagttctccgacagcaaacatgtacttcaatgagatatggaaagtgagaacagtcttgcaagaagaagcatcaagtgagcatgcagaaatcactgcgatggtcgcagagatgcaggaaacattcaatgagtactggcaacattcatacttatggttatgcatacctgttatcctagaccctagattcaagttcggtttcattgagttccgtctgaaacgagcttttggattaaaatcagcaagctacttatctggcatacgtgaaacactccaggaactcttcaatgaatactgcagtccagtggatc

SEQ ID NO: 55197 - DNA, 393 bp, Zea mays
  Clone ID: LIB3068-015-Q1-K1-B2
gcaaaccaatctgtgccaccacaattaaaagaaatggcccttcgtggaggatatggtggaagatcacgtcgatggacatcttctgatgactcttatggtagtcagggatatggtgctaaaagatcaactgatagtttcaataacagcagcttcggcaaccaggccggtggtggttcaagctttcactcgagcttccataacagctccagtggcaatcagttcggtggtactaccagctttcatggcagctatggtaacagcagccagaacaatcagacaggtgacaatccgagctttccacccagcttcagtaacattcagtccggggatggtctcaggtttcaatgaaagttctattgatcacgccgaaaggaccagagccgatcaaaccat

SEQ ID NO: 55198 - DNA, 443 bp, Zea mays
  unsure at all n locations
  Clone ID: LIB3068-015-Q1-K1-B3
cggacgcgtgggctagctctatagctcgagtattgcttgctctccacaagaaacaaagcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccgcaccggctgctccttcaacggcaacagcgggagctgccagacgggcgactgcggcggcgcgctggcctgcacgctgtctgggcagccgncgctgacgctggccgagttcaccatcggcggcagccaggacttctacgacatctcggtcatcgat

SEQ ID NO: 55199 - DNA, 334 bp, Zea mays
  Clone ID: LIB3068-015-Q1-K1-B4
cggacgcgtgggatcccaactccaactctccctctctctttcgcctggcagatcctcggcggcgcggcagcctgcttcttcaccggcgcggcggcctgcttcttcgacgacgcggaggcctgcggcggacgcgacgcggcagcctaccgggcgaacggatccgcggacgaacggatctccggcgcctgatagatcttcggcgcgcggcctaccgggtggacggatctccggtgcctggtatatcctcggcgtcgcggcttgcttcttcaccggcgccgcggcctgattctttgacggcacggcggcctgccggtcttctccaggcgggcagatg

SEQ ID NO: 55200 - DNA, 456 bp, Zea mays
  Clone ID: LIB3068-014-Q1-K1-G8
aatcccccgccgcgttcccccgcacgctttgacccataaagtcgatccatctccgagcaccaagttgaacacgcgatcccattcccattctcttgctcaatacaacctccggctccagcaagccgcagcgccaagcctagaagcggagcgcggaacacacgaggccaggaagaggaggtgctgccgtccccgcgccgccgctgtgggagtgcggggaatggggcggcacggcgtggaccagatcggcgctgtggcagcgttcgtctgggtcaccctccttcccttgctgcttgtgtgcgtcgtgtggccgggcgcccaggccggccatacaagcgagtaccggcgccaactcggctccgccatcgacatgccactcgacgccgatgtcttccgccctcccccgggctacaatgcgcccgagcaggttcacatcacacaaggcaatcatgatggcac

SEQ ID NO: 55201 - DNA, 386 bp, Zea mays
  Clone ID: LIB3068-014-Q1-K1-E3
gtaatcggagttgttccatatgttggtctcaacttcgctgtatatgagtccctcaaagactggctgctccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggctggagccatgctgactctattgttactgggcaaagcaaagaagcactccagtacaatggcatgatcgatgcattcaggaagactgttcgtcatgaaggagttggtgctctgtacaagggtcttgtgccgaactcagtcaaggtggtgccctcaattgccattgcatttgtgactta

SEQ ID NO: 55202 - DNA, 515 bp, Zea mays
  unsure at all n locations
  Clone ID: LIB3068-014-Q1-K1-E4
tcgtctcgggctcgtcccttggccttacattggttccattgggctcagaggtctgttnctaccttggagactctgatgtcggttagtgagtaccgtaccgggtcgttggaccgggtattnncggtccttccgnngattttcaagggggcctgccgtggggccgcatccgtgatcactcgtcgcgaaaatgttgcggtgctttcttcnctggccgtctggaacccttaccttccggcttgaactntngattccagggcttggcgtggcccgttatagccatgaaaagataatctcttttcccgagggcccctcgcccgggcgtctttccggacttttcctaacngnntcgccgtcttggcctgccacagtcccggcttcnngggaaatcttaacncnncgattcccttttcgggtgaacgnnngcgtgatcgcgctatcttgccgggttttcccccggtcccttagggaatcggctttacccatgttgcaagttgccgttcacatgggaacctttc

SEQ ID NO: 55203 - DNA, 428 bp, Zea mays
  Clone ID: LIB3068-014-Q1-K1-E5
cccacgcgtccgcggacgcgtgggcaccgatacaaatacaacgcaccgtccatctgtccctccctccctccctccccctcgcaccgccgcgggacacgaacacgcgagccacccaaccggcccgaacccgatcgcaccgacgaggtggatcccaggggaaggctcctctttaccgccgccgatggacgtgggcctcggcggcgcgggtagttccggcagaggagggggagggggccggagcgggagcgggggcggtcgggacagcccgttcgctctcggcgggggcggcgcgtcggcggctgcgtggacccggctcgtcagctccggcgtggaggacgagctggtggctgcgtcgggaggaagaggaggaggtggaagacgcgcgggggcgagagcgggaggcctgccgcagggccactttttggacg

SEQ ID NO: 55204 - DNA, 162 bp, Zea mays
  Clone ID: LIB3068-014-Q1-K1-E7
ccgaaccgtgtccggacccctgtgctgacccccatgctactcgtataccgccagtgggacgctgtacacgcatctacgcttacgaagcgctgattgcgaaggcctacgtctaggatatgcgcacggagctcgaattctctggccaggaccttacagcgacgt

SEQ ID NO: 55205 - DNA, 291 bp, Zea mays
  Clone ID: LIB3068-014-Q1-K1-E8
cggacgcgtgggctaggccagcagctcctgctagctcgtccacaataaatgctcggcgtggcaccctcgcgaaaccaagagtttactgactagtacgagctagctagcatgcagtaataataatcatcgtaataataataataaaacgacggggctgagccactttgttcgacctgtatgaataatgaaacaactgtatgttccctcggtacgtaattgtgtatgcttgtgcttgtactttccgtttgcagcatgggtttaacatcgcagaaatcaagaaatttcgagaac

SEQ ID NO: 55206 - DNA, 454 bp, Zea mays
  Clone ID: LIB3068-014-Q1-K1-F11
cccacgcgttcgtccacgcgtccgtccacgcttccggcagaaccttgaagttaaagggatagaggatgagagaaaggctgcattggctgcccagtttgcagcagaagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaaggaggcagctctgctagaagcagagaggactgtgcaaattgctatggcaaaagctgctatggttgacgatttgcaaaacatgaaccaagagttgatcaagcaaattgagatctgccatgaagaaaataaaatcttagataagctgcatcgccaaaagattgcagaagttgaaaagctttaccaaactgtg

SEQ ID NO: 55207 - DNA, 341 bp, Zea mays
  Clone ID: LIB3068-014-Q1-K1-F12
ggcagcagccatggcggaggagcccgccgatgtcgagacctcctccagctacgatgacgaagtcaccggcctaacggcactcgatccgtcacatcatcttaccaccggatccacccaggaacgcatacacttgtacccacactaaggttccagagcctctcttactacacgagaaataaccaaaatttccttaaaagtaacgatttttaactctcaccattgaactaccactcattctacacatgtaaagtcatttcagagattcgatctatagtcaatctaaacatgctcttgtttctcctcttagatctgcaagctctttcctttgtctctggcttcgc

SEQ ID NO: 55208 - DNA, 321 bp, Zea mays
  Clone ID: LIB3068-014-Q1-K1-F2
acggccgccctttcttttattccttgcaatgaattccatccatactatccattacatggtccagacatggacaaattataaagaagaaaccacacagatgaacaccctatctcgttcacacaccttacccacatgaaaccaccatcacaaatcagagattgctgctacgctcttctttcgcctacaatctgccaagcaaaacgtatgattccctgtaaaccgacatccctattagctcacccacatcactcaatcaagaactgacttgtttaccggcaacatgcaaatcataagccgaacactcctaactgcgtcttgccc

SEQ ID NO: 55209 - DNA, 422 bp, Zea mays
  Clone ID: LIB3068-014-Q1-K1-F6
cccacgcgtccgcccacgcgtccgcttccattctcatttgagaatgcgaatacaaggagggattttgtgtttgggaaagtccgaagaaaaaaggatttggaatctaccttttcttttgctttttcccttataaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagctgctgtaagttttcgatgaaatctttactattctgcctgccaaattgaatgatgtattcattccaaaaa

SEQ ID NO: 55210 - DNA, 422 bp, Zea mays
  Clone ID: LIB3068-014-Q1-K1-F7
cccacgcgtccgcccacgcgtccgattccattctcatttgagaatgccaatacaaggaagggtttcgtgtttgggaaagtccgaagaaaaaaggatttggaatctaccttttcttttgctttttcccttataaaaataactcaatcaaaatccaattatctactctacaagaatgaaatgcttgttatgcctaatatacttagtttaacctgtatctgttttaattctgatctttgtccgactagctttttcttcgccaaattacccgaagcttatgccattttcaacccaatcgtggatgttatgcctgtcatacctgtactcttttttctattaacgtttggttggcaagctgctgtaagttttctatgaaatctctactattctgcctgccaaacttgaatgatgcattcattcccaaa

SEQ ID NO: 55211 - DNA, 311 bp, Zea mays
  Clone ID: LIB3068-014-Q1-K1-F8
aaaaaacataaaaaaaaacaaaaaaaaaaaatactaaaaatacaatacataaaaaaaagcaaggacaaaaaaaaaagaaagaaaacaaaaaaaaacaccaccataaaaatcaaacacattacccaaaaaaaaaccaccaacacaaacaggggattccttctaccctcttccatttacttcaatcttccatgcaacgcatatgctccgtttcagccctacctacctaaaaacctaccccccccactcaaaacagaacctactccaaaacccgcggcattccaaacataatcccctctcccccaaatgccttt

SEQ ID NO: 55212 - DNA, 442 bp, Zea mays
  Clone ID: LIB3068-014-Q1-K1-F9
ttcacgcgtccggccacgcgtacgtccacgcgtccggcagaaccttgaagttaaagggatagggtgatgagagaaaggctgcattggctgcccagtttgcagcagaagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaaggaggcagctctgctagaagcagagaggactgtgcaaattgctatggcaaaagctgctatggttgacgatttgcataacaagaaccaagagttgatcaagcaaattgagatctgccatgaagaaaataaaatcttagataagctgcatcgccaaaagattgcagaagtgaaaagctt

SEQ ID NO: 55213 - DNA, 362 bp, Zea mays
  Clone ID: LIB3068-014-Q1-K1-G11
cgggcgtcgactcactcattcgatcacgcattctcacacacttgctttaccctatttcaactctagctcaaatgaccagcacttgtctagacttgagaccatcatgaaatgcaaggtatctgaagcgaaactgttactaaactggccgatgatgccagctatgaggtacacagctaccatcaaatcttacttaccaagacccacaaactatatgacgagtacgccacgaatgtggcaaatctgctctttcatgaaactgatgagaaaaggacgtacaaagttgaagagctgtagacgctcgataactcgcactacgactaccacaagattaagctgcggatgcaaaccgaaatgcagggctt

SEQ ID NO: 55214 - DNA, 274 bp, Zea mays
  Clone ID: LIB3068-014-Q1-K1-G12
gcaagatgtgtctgaggaagctgtcgctgctttggataaaatagaagacgccctcgggaaggtcaacgagggtccattctcccttggtcagttcagtctggtggacattgcgtatgtaccattcatcgagaggtttcagatattctatttcaaccttaagaacttttatatttccaaaggcctaacccacccttaaaaattcaatggaggaattgaccataatggatccttccccccagactaaccaggacccacagtttttactggaccaacc

SEQ ID NO: 55215 - DNA, 206 bp, Zea mays
  Clone ID: LIB3068-014-Q1-K1-G2
tcgtctcggctcatttcgtcgcgtcatgtgctacgttgagccatcattatgagtgctggtgccctgcattataagcctgtactgagtgccctgtttgtttaaggttcagggtttaggaatttgtgttcactcttactcactttggatttgcggtggtatttgtttgcttgagttatattgaggtaaatttaaacgttcatgatttc

SEQ ID NO: 55216 - DNA, 84 bp, Zea mays
  Clone ID: LIB3068-014-Q1-K1-G6
cggacgcaaaaaaaaacacaataataacaaaacaatactttgaatttaaaaaaaaacacaacaaaaaaaacaaaaagaaaatct

SEQ ID NO: 55217 - DNA, 459 bp, Zea mays
  Clone ID: LIB3068-014-Q1-K1-G7
gcagttactgagagtgtgtgtgagagagaggatgggtggcagcggcagggctgctgtgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacaagccgcccaaggagcacgggcccaagccggagaagccgcccaaggagcacaagtccgacgccgccacgtacaccccgagccccaaacccacgccgtcgacgtacactcccaccccgacgccccccaagccgacgccacccacatacacttcccgccctacgccccacaaacccacaccaaaacccactcccactccttcgacgtacacctcgacccccaagccttcgac

SEQ ID NO: 55218 - DNA, 180 bp, Zea mays
  Clone ID: LIB3068-014-Q1-K1-E12
gggcgcccgccgtgttgtgcgtacgtatttacgtatacatgtatgtatgtatatgcgcgcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 55219 - DNA, 317 bp, Zea mays
  Clone ID: LIB3068-053-Q1-K1-F10
attattatatccaaaactatagttgtcctggctgaattgaactcaaaagggtttgtttgggaaaaaattgtcccaagattggatcgcttgttaaagctcaatattgatattgaagtgttattgcttaaaaaaaaacctgaaaaaagcaaaaaaaaaaacaataactaaacaaaattatataaaaatgaacacctcacaatgatgacatccttgaatgtactaagacccttataaagctcaagtgtacagaatacaactctaattctacgaaaatggagaccattttggtaggcccattttgtaccatgctaaattca

SEQ ID NO: 55220 - DNA, 418 bp, Zea mays
  unsure at all n locations
  Clone ID: LIB3068-053-Q1-K1-F11
aagaaggcacgggagatcggcgtgctctgcgacgccgaggtcggcggggtcatcttctggggcggcggcaagctctatgactactgctcgcccaggacctcgctgtccaggatcttggagaagtaccagaccaactccgggaagattctgtggggtgagaagcacaagaacctgagtgcagagatcgacagagtcaagaaggagaacgacaacatgcagattcagctcaagcatctgaaaggcgaggacctgaactccctgcagcccagggagctgatcgctattgaagagggcctgcagaatgggcagaccaacatgcgcgagaagcagatggactactggaggatgcacacgacgaatgggaagatgctggaggacgaacataagatactgacttttangatgcaccaacaggctg

SEQ ID NO: 55221 - DNA, 293 bp, Zea mays
  Clone ID: LIB3068-053-Q1-K1-F12
taccactcttccgcccactcttccgatatattaaaaaaaaaaaaaagaaaaaaataaaaaagagaaaaataaaaaaaatataactactaataaaaaaaaaaaaaaaataaataaaatataaaaaaaaataccaaacaaactctaaaaaagattctctaaaatacaaaaaaaaaaaaaccttatttcataaaatcaacagagttaatatttattacgactacatgcatattcatctcactcatctaaaatgctattacctgaactccctgcaattaatgcagcttatctctatt

SEQ ID NO: 55222 - DNA, 394 bp, Zea mays
  Clone ID: LIB3068-053-Q1-K1-F2
gcgtagatcgcgagcggctgccttttttttttttttttttgtttttattttttgtcttttttggggatttttggtggggtaaggacacttgaatttataccagaaaaagaagaaagagagagagagagagatgattcagcggaaatcctacaattgtgcctacatgttcctggatgttttacatgctaccatgcatgttattgcctagcttgattcgatctgtgcacactgactgccagaaccagcattaaaagcgtttgtagtcctagagggacttacgcaagctacgcaaccgaacgggtacgtactaacgctagctagtcagcccttcagatggcctttaactcgggggcaaaaagtcgttcctgtccaacgaccatggtaatatggtcct

SEQ ID NO: 55223 - DNA, 399 bp, Zea mays
  Clone ID: LIB3068-053-Q1-K1-F4
aaaaaaacacgtacacaaaaagataaaacattaaaaaaaaaaaaaaactaataaaaaaaaaagggaaaaatgccgaggcgttctacatgacccaagctaacttacacagccatgcgcaagctaacgttttctatacagtaacctaacaccaattaattggacttcgttctaaaagctcgtgactgtgaaaaccatgcgttaacaaaaattaaaggccttgcgcatacataaggcattcgcaaactggctaaatagcgattaggcccccaccaatagctattacaaacagttccacagactgaatcactaatgggaccccccatgtaccggcgcataaatcacataatctgagatgtaaacccccagcatgcccggtaaaattacaactaccctaccgcc

SEQ ID NO: 55224 - DNA, 448 bp, Zea mays
  Clone ID: LIB3068-053-Q1-K1-F5
cgaagcttgagcagagggagccaaaatggtgaaggacacgcggtactgcgacgtgctgggcgtggacccgtccgccaccgagtccgagatcaagaaggcgtactacgtcaaggcgaggctggtccaccccgataagaacccgaatgatccgcaggccgcggagaagttccaggaactaggagaagcataccaagttctcagtgaccctacacagcgccaagcttatgactcacatgggaaagacggcatctcaacggaggggattatagatcctgcaacaatttttgcaattctgtttggtagtgagctttttgaggaatatattggtcaactggcaatggcatcaatggcttcacttgataattttggtgaagatgagcagattgatgcaagaaagctgcaagagagaatgcacgctgttcaaaaggatcgggaagaaagacttgca

SEQ ID NO: 55225 - DNA, 452 bp, Zea mays
  unsure at all n locations
  Clone ID: LIB3068-053-Q1-K1-F8
cccacgcgtccgcccacgcgtccgcccactcgtccggcaggtgttaggtgttttgcgcctgtgttcatgtgagtgctttctctacatattatacttgcgtcctgacaatcctataggttcctgtttactggcaaaccataagacggtgtctaacaattcactcatatgatcatctaatacactgttttgcactgtacattgtgcaattcgcagattgaaatttgaatataggtacaaggatgggtaaacactggagatagctagcctaaagatgaattttagatatattatgtatgagatagctagcctaaagagggagttttagatatattctgtagttgatattcgagtggtcatgcagttacgatccctcatgtttagagataaatgataggaagacaccttgtctttcgntcatgtttaggttgaagtttagaaattacgatgtatat

SEQ ID NO: 55226 - DNA, 163 bp, Zea mays
  Clone ID: LIB3068-053-Q1-K1-G1
ctaccctcccagtacacctaagaaattatagcgctcataacaacacatctgatgtccatacaatatcatccaataacatcatagtatctacctcatattgtacaagaatccgacatcgcagaaattacaaaatgaaacactctgaagaattaatacaatcata

SEQ ID NO: 55227 - DNA, 158 bp, Zea mays
  Clone ID: LIB3068-053-Q1-K1-G10
cccactcgtccgttcgcttctgtcaccgtgttagtgtccgttctagctttggattaggtgggggtacccctgttgttccctttggttgctcccgctatgaaacgagacgagagaagaatgagcaaggtttttgttcgcaaaaaaaaagacaagacgat

SEQ ID NO: 55228 - DNA, 440 bp, Zea mays
  Clone ID: LIB3068-053-Q1-K1-G11
cggacgcgtgggcggcgccaccgcgctgcgcgtcgcgatggccgagggccacgcggacgcggccaggttcctgatcttgaacggggccagcgtggacaaggcgagcctcgacgacgacgacggctcaggttcaggctccggctctggcgccgcgcggctagcaatgtcgcccaccgagctgcgcgagctgctgcagaagcgggagctcggccactcgataacgatccacgactcgccagcggtggtcccgaacggcggctcgtcggggcacagccgtccaggcagattacagagcacaagttcggacagccagcgctggcctcgggtgagcgtatacaagggccaccctttcctcagaaaccgcacctctgaagctggcaagctgatcaacctaccaggcaccatggaagaattcaaagtcatcgtcggtgagaaactga

SEQ ID NO: 55229 - DNA, 417 bp, Zea mays
  Clone ID: LIB3068-053-Q1-K1-G12
cggactcgtgcgctgtgccacctcactgcttttctcgatggccgagggccacactaacggtggcagcttcctgatcttgaacggggccatcgtggtcaaagccagcctcaacgacgactacggatcatgttcatgctccagctctggctccacgcggctagcaatgtcacccaccgagctgcgcgagctgctgcagaagcgggagctcggccactcgataacgatccactactcgccagctgtggtcccgaacggcggctcgtcggtgcacagccgtccaggcagattacagagcacaagttcggacagtcagcgctgtccttgggtgagcgtatacaagggccaccctttcctcagaaaccgcacctctgaagctggcaagctgatcaacctaccaggcaccatggaagaattcaa

SEQ ID NO: 55230 - DNA, 286 bp, Zea mays
  Clone ID: LIB3068-053-Q1-K1-G2
cccacgcgtccaccctttcgtccgcccactcctcctgcaagtgatacgtcatttctcctcgttacatgtcactgctttctctacatattatacttccgtcctgacaatcctacacatacctgatcactggcaaaccatatcacagagtctaacaattcactcatatgatcatctaatacactgtattacactgtacattgtgcaattctcagattgaaaactcaatatatgaacaacgataggtaaacactgactatagctagcacaaagatgaacattatatata

SEQ ID NO: 55231 - DNA, 454 bp, Zea mays
  Clone ID: LIB3068-053-Q1-K1-G3
caaggccaacatcgacggcctggtgttcgccgtgaagaagatgaagtgggacgcctgcgaggagctcaagatccggcaaaaggttaaccacagcaacctggtgaagctggaggggttctgcatcgactcggcgacgggcgactgctacctggtgtacgaatacgtggagaacggatcgcttgacctgtggctgctggaccgcgaccacgcgcggcgcctgaactggcgcgcgcgccttcacatcgcgctggacctcgcccacggcctgcagtacatccacgagcacacctggccgcgcgtggtgcacaaggacatgaagagcagcaacgttctcctggacgcccgcatgcgcgccaagatcgccaacttcggcctcgccaagacgggccacaacgccatcaccacgcacatcgtgggcacccaggggtacatcgcccccgagtacctcgccgac

SEQ ID NO: 55232 - DNA, 298 bp, Zea mays
  Clone ID: LIB3068-053-Q1-K1-G6
caagaaccgaccggctcatacccttctgccttcgatgcgctcatggccggaactgaccgggggcagcactacaagccgagacttaaaacaaacaacagagctcaaaccaagccatcgctctcaatacataaacataagacaacatcatactattcccgtcctatcgattaggcattataaatcggagtaatgaacaatactcacacccgggagccttcatataaaatagtgacatatcaaattctaatagttagaaacgactatcacatggtaaagcctgatcaaaggaaattatgat

SEQ ID NO: 55233 - DNA, 247 bp, Zea mays
  Clone ID: LIB3068-053-Q1-K1-G7
ggctaaccgaccggcttgacccttatgaactttatgccatggtctccggaattgctcgacgcgtgctttcatccgggctactctgatcaaattctagagcccaaacatagccatcggtccggatacattaccatccaataactctatactatcgccctccaattcacttgcacttcggcactggcataatcattactcggttcaccgacggctattcatcatctatcttcagacccgaatgctcttg

SEQ ID NO: 55234 - DNA, 464 bp, Zea mays
  Clone ID: LIB3068-053-Q1-K1-H1
tgctgacgtaccctcacatatccagcatgacattcagtatggaggttacaatacatcatccgctccaacttcacgataccctaaccaaagcactgcaccgacaatgcacattcccaacacatgcaaccagcaaccatcgccaagcttatttgctccaggaaaccctgcgttgacacactccaagaattccatggtcttttcaagcgcattatccagccccatccggcggagcctgcaaccttaccacctatagcaagacggtgatgcacggtactttgcgaacggtgcaagccgcgacgtgaaccccacggcttcgaatgattcgtccatggacatgcactcggacagcccagctcatgactcttactgagcagctcccaccaaccaaccgcaagagcaacacttcaagtgtaagaagtctgctgtcacagccttccgaggcctagtaataatattcaatttaa

SEQ ID NO: 55235 - DNA, 461 bp, Zea mays
  Clone ID: LIB3068-053-Q1-K1-F1
gttccctccggccgcttccgcctccctgccctccctttccccagatccgaagccattaagggcagcggatctgggctcggggcgcgtccgcggcatctgggcaagcgagtggtagagcccgcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcagattccgggcagtcacgggaaggatgatgctggactcctctgactgtgcctctgctgccgccgacgcggagacggggcaagtgcagccgcagcgccgcgcggtgggggccgtgcccctggcgcacgacggcggctacgccagcggcggatgggagagagaagatggcaaactgagttgtggatactcaagt

SEQ ID NO: 55236 - DNA, 278 bp, Zea mays
  Clone ID: LIB3068-053-Q1-K1-D11
cccacgcgtccgaaaaaaaaaaaaaaaaaaataaaaaaaaaaaaaggggaaaaaacaaaaaggaaaaaaaaaaaaaaaaaaaaaaaaaaaaaaaaaaaaaaaaaaaaaaaaaaaaaaagggacagaataatttaaaagaacaaagctaacatacacatcaaactaactccaaaactcttcaaaagagtaaacaaatataaattaattgaccaaatttaaaaaaagagtgaaacttaaaaaaccctgatttcaccaaactaaaccccatgcaacgaaaa

SEQ ID NO: 55237 - DNA, 442 bp, Zea mays
  unsure at all n locations
  Clone ID: LIB3068-053-Q1-K1-D12
cccacgcgtccgcccacgcgtccgcccacgcgtccgctcctcccaggcgcatccaagggggtccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggactngtcagttccaaaagcgaccagngtgaaggctatagccgaaatatttgc

SEQ ID NO: 55238 - DNA, 459 bp, Zea mays
  Clone ID: LIB3068-053-Q1-K1-D3
agcgaacaggcaaaaaggagaggccgagaagcgctttagcgataagagtggtgcacccgtggcggcacggcatgggggccacggcgtactccgtggcgctcctcggcggcgcacgcctgccggccgacctcctccctcggcgcagcagcgtgtgccaccaccagcttcgcctacaagacgcaccgaggctctacctgcaccgtgccagggccgcttccgaggacacgtcggcctacggcggcgacgagctcatcgaagacctcaaggcaaagtgggacgccgctgaggacaagcccaccgtcctcctgtacggcggcggcgccgtcgtggcgctatggttgacgtccgttgttgtcggcgccatcaacgccgtgccgctgctccccaagatcctggagctcgttggcctcggctacaccggctggttcgtgtaccgctacctcctcttcaaggaaagca

SEQ ID NO: 55239 - DNA, 317 bp, Zea mays
  Clone ID: LIB3068-053-Q1-K1-D4
cgtcgacccactcgtcctcgaacgcctcgtacaaaaaaacacccagttctgagtcggaagtttgactcccgcacaacggggcaacacaaaacgggtacaacatcacatccctccgacatcatcctgaagaccgcactcatcacaccagcaccttgtagcattaccgcatcaaccgacaccatcaccaccttaacctacaaactcaccgctacactcaatgcacctccccaacttacatatccatgacacctacttctcttgcctacattagctcattgcacacactcaggcaaccttggacacctgatacgacaatc

SEQ ID NO: 55240 - DNA, 322 bp, Zea mays
  Clone ID: LIB3068-053-Q1-K1-D5
gttacttcaagatggaaatgggcaagaacatgtgcggtgttgctacgggtgcatcctaccgtattgtcgcatgaggcccttacgaaatgttacatggtctgtttggcatcaataatgcatgtttaacctgagcttggcgatgggttatacagaacggaaactctgtttgtgaatagaaaatcatgaagggaaggagttgaccggacccctacttgtacgtctccccggctgtgtaggtagattgtcagttggggttccgaagtactctactcatacgtgtgtatgacagtttatttatgaaacaaaatacgcattgatcgtt

SEQ ID NO: 55241 - DNA, 377 bp, Zea mays
  Clone ID: LIB3068-053-Q1-K1-D8
gtcggcggccagcggcgagaggaggaggggtgggtcagccatgacggggaaggcgaagcgtaagaagcacacggctaaggacatcgccgcgaagatcgactcggcgacgacgaaccggggcggccgcaaggccgggctggcggaccggctggcgcaggacaagggcaggcatgcgaagctggcgtgcccgctctgccgtaccccggcgcccgacatcaagtccatgcagatccaccactaggcgcgccatcccaagctcccattcgagccggagaagctactcaacctgcactcctccgcccccgctgctgctgttgccgacgacgccgccttcgcctccgctgccgaggccaccacctactagcccaagccctgcg

SEQ ID NO: 55242 - DNA, 369 bp, Zea mays
  Clone ID: LIB3068-053-Q1-K1-E1
acaaatcaaactcaaaccaccctttaacgtttaactacacacgatatacgtgctctacagagtcatcatataagagagaactccgttatgcttgaccctatgcccactctcgaaacaaactcgacacgtgacaaagaattccgacccgatcggcccaagttaaataccactactattaacaatgagttacttatcccccggttccgaagcgggacatacgtcccatatcttgaatacaagggccatcctaattgcgcccatccgctcggactacatctacacgtctaaagttattctcatactctacatatagtaaaagacaacacaggtgtccttagatgatcacatcgacaacacaaatcccttggc

SEQ ID NO: 55243 - DNA, 315 bp, Zea mays
  Clone ID: LIB3068-053-Q1-K1-E10
aaaacacataaaccaaaaaaacaaaaaaaaataaaaaaaaaaaatgagagaaaaaaaaaaagcgtaaatactaacaaaaacaatactcacaaggccatgacctccaccctgctcaccctttacttctctatcatccgacctaattctacttatctagcctctcttctacaaatttaaatcctatgcaatctttcacctttaccaactttaaatcccttgatacacctaacgttaccatctatctctttaatcccatttatgcattcacctatcgccctaccatataacgaacccattcttacttgcgaaccttac

SEQ ID NO: 55244 - DNA, 296 bp, Zea mays
  Clone ID: LIB3068-053-Q1-K1-E11
aaaacgcatgcacctttaaccaaatgcaagattatagtcctgaataggcgaactaacatgcgagatccattaagcagcgatcgatccagacaactgataccacactaatcaaactctacatgctcgcaaattacccaattcttacacatctaggtctacataacaaatatcaataccatgcacattagaccctgacaatcataataaccccaatctaaatgacttaaataggatccattgtaccgcaaatctattgccatcattcggaatcattccagatccaatcccgtatattt

SEQ ID NO: 55245 - DNA, 441 bp, Zea mays
  Clone ID: LIB3068-053-Q1-K1-E12
cggacgcgtgggcggacgcgtgggtcctcctgctcggactcctcgggcgggaggccgctggcggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgactgcggctggtgcaacccgccgcgcccgcacttcgacatggccgagccggccttcctccgcatcgcgcagtaccgcgccggcatcgtgcccgtcgcgttcaggagagtgc

SEQ ID NO: 55246 - DNA, 461 bp, Zea mays
  Clone ID: LIB3068-053-Q1-K1-E2
cggacgcgtgggccgctgcctccgcgtttcgctttccccccgtcttcccaagcctttgctgggctcttcgctggggattccctctgctcatggccgggagagggaaggcgatcggctcaggggccgccaagaaggccatgtccaggagctccaaggccgggctccagttccccgtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgtgacaacaagaagacccgcatcgtcccgcgccacatccagctcgccgtccgcaacgacgaggagctctcccgcttgctgggcacggtgaccatcgccagcggcggtgtcatgcccaacatccataacctgctgctgcccaagaagtctggcggc

SEQ ID NO: 55247 - DNA, 403 bp, Zea mays
  Clone ID: LIB3068-053-Q1-K1-E3
cggacgcagtcgtccgacgcctcgtaaaaaatttacccaaccaaattaacgggcttgtcctggtctcatagaagggggaccccgttgatcttgactctaatacgacttgtaaaatgacttgagacctgtaaaataagcgtgagcctaagctctcaagtcaaataccactactactaacgtaatattacttatttcgtgaatcctaagcagttcaccgtccgtccttttggctacaaggcccggtctcttcgtgccgatccggactaactacatcttcatgtctaaaagcatgctcaatactcacatttattaaacgataacacaggtgtcctaacatgaccatatcaagaacagatttctagtacctaacaaaatgctaaatgctcgtcacattctcaatttc

SEQ ID NO: 55248 - DNA, 408 bp, Zea mays
  Clone ID: LIB3068-053-Q1-K1-E4
ctcgaaccatcgtccgacacgcgtccggcgtatttgccgtggagatttcaggcctgcggcgaggattgcaccttgtgaatccgcggagaaggcgaccagctgcaccatggcctacagactgctcaaccgctacatcaggcataaccgtaccgtagctgccgatctaggactcgctatcagaactgaatcctatgcatacaggacctagacagacatccaaaagggtgagacgctgaaagagaccatggatctcttcccacacatcgctacattctgctcagatgctgccactaacgaagccctcgatacgaggtaaccagagaagcgccaactgactatcccatatggcggtaaggtccttcagttacatgactttcctgctgataatgcacacgaccatgatcaaat

SEQ ID NO: 55249 - DNA, 213 bp, Zea mays
  Clone ID: LIB3068-053-Q1-K1-E6
cccactcgtccgagctttaccacaaccaatttaacaaactcttccgagtcatcttacatggaaaacttttatgatcatgactctaataccactatccaaatgactatatacctataacataactatgaccattagctcccaagtcaaacaccactacttttaacgaaatatcactcattcccttaatctcaagcattacacctaccctccttt

SEQ ID NO: 55250 - DNA, 453 bp, Zea mays
  Clone ID: LIB3068-053-Q1-K1-E8
cccacgcgtccggcggagttgcggtggagatttgaggcctgcggcggcgatggcacctgcggaatccggggagaaggcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggagacggtgaaggagaccatggatctcttcccccagatcgctggattcggctcggaggctgccacgaaggaagcccctgatgcgagggagccagagaagcgccaactgactatcttctatggcgggaaggtccttgtgttcgatgacttccctgctgagaaggcaaaagacctgatgcaaatggccagcaagggttcatccgtagcccagaaccctggcctgctgcctccttccacagctgc

SEQ ID NO: 55251 - DNA, 360 bp, Zea mays
  Clone ID: LIB3068-053-Q1-K1-E9
cggacgcgtgggccgggggccagttaaagatggtggtatggtatggtagcggcgttgtgggagatgcgtgatgggaccatggttacggaccatgatgatgacgctgcgttccatttagctctctgctgcctgcttctgtattaaagaagtggttcgatgtctcagaactgaatacgatgcaaagaggacgtcaacagacatggaaaaagggggagacagagaaagagaccatggatctcttaccccagatcgctggattcaaaatgggaggctggctctaaagaagccaatgttacgaaggagccatagaagcgccaactgactatatagtatggcctaaatgaacttgtgggccatgac

SEQ ID NO: 55252 - DNA, 398 bp, Zea mays
  Clone ID: LIB3068-053-Q1-K1-C7
cggacgcgtgggcaaaaaaaaaaaaaaaattataaaaaaaaaaaaaaaggaaaaaaaaaaaagaaaaaataaaaaaaaaaaaaaaaaaaaaaaaaaaaaaaaaaaaagggcgccccttttatcgtatccattcttacttccccttccttccaacttcttacctcttctttattgccccctaatttcatttcactgcccgtctttttacaacttcttcccttgcaaacccctgccttttcccaacttattcccctttcaccacatccccttttcgccaattggcttaatcccaaaaaccccctaaccgatcgcctttcccaactttttcccatcctaaatgccaaatggacccctccttttaccggccctttaacccctcctgttttggtggttacccc

SEQ ID NO: 55253 - DNA, 390 bp, Zea mays
  Clone ID: LIB3068-053-Q1-K1-A3
taccggtcttgaattcgtggcgacgacgcatccgtacaagattcatatgttcttgcgtacagagctataactctaaaagcatgcggacctaaccgagacaacaatgctactagctatgtgtgtttagagcgagcgagggaaaaaagaaaacatctaagatatactccaacatcttcgtttgattaacccgcccagtaaagccatgggtactaattatagagcggtcatttctctagtactcctcgtgtgcatcgctagccgatcgaccttgggtgccgctgaaactgacgtttaacagaatcgctcgtcagtccctttgatgtttgtgttcggtgattcgctggtcgatgtcggaaacaataacttcctgccgacttctgcaccccgtgc

SEQ ID NO: 55254 - DNA, 459 bp, Zea mays
  Clone ID: LIB3068-053-Q1-K1-A4
gagcttcttcttcttggccttctctgcttcgctgttcttgttcttgagatcgcgctttctgaccggggagtgccgtgccggagatcctgaaaagagacacacaccacacaccacggttgcgcgcgagaagtccgagacatggacagggagcagatgaggatggccatcctgaaccaagaacggatcttcagacaacaggtacacgagctgcaccggctgtaccacgcccagaagcagctgatgacgcagcaggcgcagacggttcctgctccggcggtcgtcgacgccgagccgagaccgagaccgacgcagctggatatctggtgcggcgagagggcgacagcaagtcctcagcagcacatcatcagcttccacgaggccgcagcacctgcggctgcgctggccaaggaatgcaaccttgagctgacactggcgaccggccggccaagcagcagcagc

SEQ ID NO: 55255 - DNA, 449 bp, Zea mays
  unsure at all n locations
  Clone ID: LIB3068-053-Q1-K1-A5
cccacgcgtccgcccacgcgtacggagctccaactctaaaagcatccgtcccttggcagcggcaacaagctactagctatgtgtgtttagagcgagcgagggaaaaaagaaaacatctaagatatactccaacatcttcgtttgattaacccgcccagtaaagccatgggtactaattatagagcggtcatttctctagtactcctcgtgtgcatcgctagccgctcgtccttgggtgccgctgaaactgacgttgagcagaagcgctcgtcagtccctttgatgtttgtgttcggtgattcgctggtcgatgtcggaaacaataacttcctgccgacgnctgcacaccgtgctgcatctgcgtacggcatcgacttcccttctggcaccaacggcgccgtctcaagacggttcacgaatggctacaaccttgccgatttagtcgcgcg

SEQ ID NO: 55256 - DNA, 412 bp, Zea mays
  unsure at all n locations
  Clone ID: LIB3068-053-Q1-K1-A6
cccacgcgtccggcagcagccaattcgctcgagttcagatcgagcgcgcgccaagcaagtggtccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggtgggcctggtggcgatcgcgatcgcgcacgcgctggcgctgttcgtgggcgtgtccgtcgcggcgaacatctcgggcggccacctgaacccggccgtgacgtttcggctggccgtgtgcggncacatcaccatcctgacgggcgtcttctac

SEQ ID NO: 55257 - DNA, 436 bp, Zea mays
  Clone ID: LIB3068-053-Q1-K1-B1
acgcgtcctacgagctttcgcacgcaagtgtcaagagaccaaacgggggacatggctcgggcgcaatctgccgtagcggtcgccgtggtggccgcggtgctgctgctggcagcggcggccacgacctcagaggccgtcatcacctgcgggcaggtgagctccgacatcgcgccctgcctctcctacgcccgcagcacggggtccggaccctccgcgtcctgctgtagcggcgtcaggaacctcaagagcgccgccagcaccgccgacgacaggcgcgccgactgcaactgcctcaagaacgccgacaggggcgtcagcggcctcaacgccggcaacgccgtcagcatcccctccaagtgcggcgtcagcatcccctacaccatcagcaccttcaccgactgctccaaggtgaactaaaacctataccacgcgcgac

SEQ ID NO: 55258 - DNA, 194 bp, Zea mays
  Clone ID: LIB3068-053-Q1-K1-B2
gaaagtatctcaaggtacggcaaatgtcagtgttctgaagctgaggccctttatcatttctggttcaaatttcgaaggatgatctgcaacattgttttgtagtgtttgtattagggagatgcccatcttcacatcaatgttcagaagttatgtgcgctatgagatttaaattatgagctgccagattgttttgt

SEQ ID NO: 55259 - DNA, 450 bp, Zea mays
  unsure at all n locations
  Clone ID: LIB3068-053-Q1-K1-B5
ccgagtcctacgagcagtcgcacgcaagtgtcaagagacgaaacggtcgacatggctcgcgggcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgtctgcaactgcctcaagaacgccgccaggggcgtcagcggcctcaacgccggcaacgccgccagcatcccctccaagtgcggcgtcagcatcccctacaccatcagcacctncaccgactgctccagggtgaactaaaacctagaccacgcgcgacgacggccgcctgat

SEQ ID NO: 55260 - DNA, 431 bp, Zea mays
  Clone ID: LIB3068-053-Q1-K1-B6
ggccgatctgggagaagcccccgaagcccttcaaagtactcccccactgctaccactagagcgtgtcgatggccaacctctgcaagctgcacggatggagagtcagggagaccccgcgccgcgtcttcgacgccgtgctcttcatcaacgagctcgacatccttgacatccgctggcacgagctgagcccctacgtctgagagttcgtgctgctggagtccaactcgaccttcaccggcataaagaaggacctccactacagggagaaccggcagcggttcggcttcctcgagtcgcggctgacctacggcaccatacgctggaggttcctgaatggagagaacccgttcgtggaggagtcttaccagagggtcgacatcgaccaggtgatcaagatacggggcatcgaggactacgacctgctgatcatg

SEQ ID NO: 55261 - DNA, 451 bp, Zea mays
  Clone ID: LIB3068-053-Q1-K1-B7
cgctctcccacccgctcgggcatccgccacacggccacaccaacactgcactccaccgcggcccgccacagtcctcctcctccgtcgccgtcgttcttcagcggcgccttcgcttccccagcacggtaccctagcatcagcgattcagcgctcaatacaagccaccgcggccatggcgcccgcaccggcagctctctccgcggccaacgccctctcgctgctcgcgcccgctagagtctcctccggaaggtggagcagcctgtccgtctccgtctcagcccggcccgtgaccggggtggtgtctgtcgcggcggccacggcgcagaggaggctggtcgccgcggcggcggcgacggagatggcgcccgcggcgagcggggaagaagggagcaagccgttcgtggaggagatgcgggcggtcgcgatgaagctccacaccaaggaccaggcc

SEQ ID NO: 55262 - DNA, 479 bp, Zea mays
  Clone ID: LIB3068-053-Q1-K1-B8
cgtcgacccattcgctgctcgaaacacgcgtccgcacaacttgctaagctagccggatacgccatccctgacaaactgggcgctgaaacatggagcgcactcttccgcatatcacatctcttaactatgactcctggtccgcgaaaatgctttgttttaatcaaacatgacaaatgcactcgtttcatcaagcatttagacggtcgtttcactcccggtgaaagaactacagggcgactatcccgccgcactttgtttcggtcaagctgagtctcctcacgcctatccatgccttactcaactgctgacctgtaacatcgaaacggtctgctgtacgtcgagtggtacgcttgagcaaacaatctacagcctattcaccgatcaccagtgcccaattgccttgccactcgctgagcattgacccgcagctatttaccttgcgcacacgacacccgtatatactccaactcgggcgtttc

SEQ ID NO: 55263 - DNA, 461 bp, Zea mays
  Clone ID: LIB3068-053-Q1-K1-C1
cccacgcctgctactaagtgctctccagcttttccgtcaactactaaaaccaactaacacagataaaacaccacgcggcatgctcacaatgtcgacctggacaggctcaacaagatgctacccagcatctacttcaagctatacaacatgaagggggacatcgccatgtggcataactccttcgactcctgctacgacaagctcatccttgtcaccacgcccacctagtgctactactgcatcgaccccaacaccgtctgatacgtgcccatgcgctcctgcgtaactgctcccagccccaaatacaggaagctggatctcaacgccacgcccaatctaccccagatgctcatcgtcacgccggatctcattatcctagctcctgtcagcatcgcttacaccttcaaacatgacgacgcccggattaagcttaaggtcaatcactacaagacgctaatgcc

SEQ ID NO: 55264 - DNA, 246 bp, Zea mays
  Clone ID: LIB3068-053-Q1-K1-C12
tgctctttgtggactcgcaaaaaaaaaaaaaaaaaaaaaaaaaaagaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaataaaacaaaaaataaaaaaaaaaaaaattcactagaaaaaaaattaaaaaaaacaaatattagaaaatcacaataatattcaaaaatt

SEQ ID NO: 55265 - DNA, 220 bp, Zea mays
  Clone ID: LIB3068-053-Q1-K1-C2
ctcctcgctcgacccactcctactcccacgcctaccagttttaccataaacccttactaccactaatcacgggactataacattgcgagcactagcccaacatcacattgcatcaccatactaaaataccgtccaacttcttcctcataatcaaccacacgcattccaatagcacctaccacttctaaatcagctattccactcccgacaaacgcaccct

SEQ ID NO: 55266 - DNA, 455 bp, Zea mays
  Clone ID: LIB3068-053-Q1-K1-A2
tcgaggactgcacatggttgctggcaattcgctcgagttcagatcgagcgcgggccatgcacggggttccgccggccgcgaagagcgcaatcatgcacgacaagatggtgaagctcgccttcggaagcgtgagcgactccttcagctccacctccatcaaggcctacgtggccgagttcatcgccaccctcctgttcgtcttcgccggcgttggttccgccatcgcctacgggcaactgacgaatggcggcgcgctggacccggtgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctg

SEQ ID NO: 55267 - DNA, 381 bp, Zea mays
  Clone ID: LIB3068-007-Q1-K1-F7
cccacgcgtccgattacatgtggggcaactcctgcaatggaaatactgagtttgtgtggggctgatccaggaaatgcatttcttgtgccatcaccttactacccgggttgggatagggacataaaatggcgaactggtgttgagttgatacctgttccttgtcgtagtactgataactttaatgtcagtgtcactgctcttgaaatagcttacaaacaggcaaaaaagcgaggaataagagttcgtggggttctcatatctaacccttcgaacccaacgggaggcattgtgccaaaagaaatactgcatgaccttctacagtttgctgcagagaagaacatacacttaatttctgatgaaatatttgctggttcaacatat

SEQ ID NO: 55268 - DNA, 261 bp, Zea mays
  Clone ID: LIB3068-007-Q1-K1-G1
gcggcgaaatcagagaggtcttcagtgttactactatgatgttcttggacgtgtttgattttgaatctgcttttatatatatatatatatatataattttcctacggaggtgggaggaggagaggtggacgaagaatagtgtaacgatgataatggtggtggttgagggcctgaaacgatgaacacatggggttgggttgggtgtatgtatctgtcacacgcagcttttgtgcaagactattatactacatcgctggtccc

SEQ ID NO: 55269 - DNA, 334 bp, Zea mays
  Clone ID: LIB3068-007-Q1-K1-G10
tcccacacatactaaaaaattataaataattaaaaaaaaaaaaataaaaaaaagaaaaatttgttaatataaaaaaggataaagtacaaaaaaataaaaactaatatacaccaatataaacataattatcttcaattctctgttcactctattataaccttctgactttgaaaaacttacttttttctacttaatccaactttaaacatagtccgtttaattcaattctttttaactgaacaattctgtacctttcccactttataacattttgtcagacttcctgtttaatggaattcatcttttatcggcacattcatctctacattctttt

SEQ ID NO: 55270 - DNA, 302 bp, Zea mays
  Clone ID: LIB3068-007-Q1-K1-G11
ccactcgacgcacacatcccaaacaaaaccctaaaaaaatttttatgattaataaaaaacattcttggccaaggctatttgtacaaacttaatggcattaaggccaaaattttacactcttactatgaaataccaataccccctactttccctattaatcactacttcgatcccgaaagccccacaatttgaccagcttactatgatggtatcccatgctaatttatccagatcgattaattgctattagcactctaatttattcaaattaacaacagccggacacactaaccggccaatta

SEQ ID NO: 55271 - DNA, 367 bp, Zea mays
  unsure at all n locations
  Clone ID: LIB3068-007-Q1-K1-G2
cccacgcgtccggtccaattcggtgcctggctaactccgcacgtcttccccccttttcgctcccccgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcctaagttgagtattaacagactcgggcggttcgtgtcgctgggcgctcggaggccaccggccgacgacgacgaccacagcactggcaaatacagcagcagctcctgcaacaatggcagccctcagatggcattccatcatggcagcaactcctnctatccctggcacccgc

SEQ ID NO: 55272 - DNA, 429 bp, Zea mays
  Clone ID: LIB3068-007-Q1-K1-G3
caccaacagattcgtctcctcgcctccgccgggtttcgaccagaacgccgccgccagccgaccagtgattcctgcgggcactggtctccgcctaggtcccaggaggccaggaccgcctccggccctccgcgactccgtcggtccaccgggactggcttgccgctgccaggggctccatcgcccagtaccggctccggtacacaagcggaaggcggccgagtaccaagacgcagcagcagcgcgaggcgcctggtctccacctcctctgggatcaccacccaagaaaagggtgcgcggcgcataggcgaccactgagattttattctctatataacatttggcttgcaaatatctcaatgtcaagtgtttcaaattctattgctgtgggtcttccaagctatgggctatatctagagacaaggttctcac

SEQ ID NO: 55273 - DNA, 301 bp, Zea mays
  Clone ID: LIB3068-007-Q1-K1-G4
cacaaacagacgcgctttcgctcctcactcgggtttcgaccagaacgccgtcatctggggaccggggattcctccgggcactgatgtgcggctaggtcccaacatgccaggaccgactgcggccctccgcgactgcgtcggtccaccgcgactggcttgccgatgccaggggctccatcgcccagtaccggctccggtacacaagcggaaggcggacgagtaccaagacgcatcagcagcgcgaggcgcctggtcttcacctactttgggatcaccaccccagaaaagggcgcgcggcgca

SEQ ID NO: 55274 - DNA, 300 bp, Zea mays
  Clone ID: LIB3068-007-Q1-K1-G6
ggcatgtgtctggttggaagagacgctaaagaaatttgaccgcatactggttggcatatggcactcccaggactttctgaatggtgtgtgcactaacatcatccatatgcagaacaagaagctaaagttatatactgggaattatgaccaatacattcagacacgctccgagcttgaagaaaatcagatgaagcagttcaagtgggaacaagagcagattgcatcaatgaaagagtacattgcacggtttggccatgggtctgcaaagcttgcacgtcaagctcagagcaaggagaaaac

SEQ ID NO: 55275 - DNA, 341 bp, Zea mays
  Clone ID: LIB3068-007-Q1-K1-G8
gtcgggcgttcgtaccactacggttcgggttcgggttcgtgaggttctccggggttcggggtcgtgggtgagcggatcgagatggcggcgtcggatgttgagtaccgctgcttcgtcggcggcctcgcctgggccacggacgaccactccctgcacaacgccttcagcacctacggcgaagtcctcgagtccaagatcatcctcgatcgggagacgcagaggtcccgcggcttcggcttcgtcaccttctccacggaggacgcgatgcggaacgccatcgagggcatgaacggcaaggagctggacggccgcaacatcaccgtcaacgaagcccagtcccg

SEQ ID NO: 55276 - DNA, 450 bp, Zea mays
  Clone ID: LIB3068-007-Q1-K1-G9
cacagagacatcagagagcggtcctccttgtgagtctgagctgaagaggaggaggaggaggaggagaagcagcggcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaagatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcaaggcgcgcacgcggtgcggctgggcaacgaggcgtcgatccggcagcgcctggacgtggcgcgcggcgcctactacgccatcacgttcagcgctgtcgcgacgtgcgc

SEQ ID NO: 55277 - DNA, 417 bp, Zea mays
  Clone ID: LIB3068-007-Q1-K1-H1
gcggtaaaaatggagagcttgatgaggcccaaggaattgtaaatcagatggtggataggggtggtttgcgtgacaccacaacgttcaacactctcattgttgctctgtgctcacagaatcgacttgaggaagcattggaccttgcacgtgagctaactgtgaagggactttctccagatgtctatactttcaatattttgataaatgccctttgcaaggtaggagatcctcatcttggcattcgattgtttgaggagatgaagagcagtggatgcgctcctgatgaagttacatacaacattttgattgatcatctttgctcaatggggaagcttgtaaatgctttggatttattgaaggagatggaatccaatggttgccctcggagtacagtgacatataacacaataattgatg

SEQ ID NO: 55278 - DNA, 267 bp, Zea mays
  Clone ID: LIB3068-007-Q1-K1-H10
gccgcccaaggagcacatttctaccattgtagcactgtcccaagcctctgagtccgtccgtggagctcaagccgactccgggcacgtacactcctagccccaaactcactcctccgacttacactccaagcctcaagcctactacacactcgacgctcaaacctacctctccgacattcaccctttccccatatcctattactcctaaacctaccccaccgacttacactcattcatcaaagccttctactcctaatcctcctacac

SEQ ID NO: 55279 - DNA, 203 bp, Zea mays
  Clone ID: LIB3068-007-Q1-K1-H11
aattcccaggcaggcaggttttcgaggattgcaggaagaccgaataccgatgcgtgctggggctcgttactggaactttacagtaccccaaaatctcatatccttcctgcccgcccgcccgttcccgtctactcgtcgttcttgtcttccgcgctccaccttctttttctcctacttcatcttaatcggatactctcatattc

SEQ ID NO: 55280 - DNA, 450 bp, Zea mays
  Clone ID: LIB3068-007-Q1-K1-H12
aaaatggatatgccccactgcaccttcaagacccgtgtcagtgtttggcgggttccccgccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgcaacttgctttgcccatggaaaatatgggaatggcaaaccattccctgtgaacctaagtcttgccgttggtcttagtggctggcttccatgtgccaggaccttgaagaacagaattgaagcctcaccagagtgtgcacaaaaggcttcatcaatacctcttttgctctgtcatggaaaagctgatgatgtagttgcctacaagcacggggagagatctgctgg

SEQ ID NO: 55281 - DNA, 258 bp, Zea mays
  Clone ID: LIB3068-007-Q1-K1-H2
gcgcatcgtctttgtgcttatgagcatggggatactcccatgcttttggcgcgcaccaactgggaacgtgtaagacgtctcgtggaccaagccatattactcgcgatggagagaagccttcctcgacaatgtcttgttccacatcatccagttctatgtcaaggagttgcctgacaacaccttagacttcttcaccctgtactactgtgttcctcgtcacctacccaagcctgtctacgaatccttctatgtcattct

SEQ ID NO: 55282 - DNA, 236 bp, Zea mays
  Clone ID: LIB3068-007-Q1-K1-H5
aaaaaaaaaaaaaaaaaaaaaaaaaaaaaaaaaaaaaaaaaaaaaaaaaaaaaaggaaaagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactaaaaaataaaataataacaaatataataaccttaaaaaaaaaaaataaaattacataaaaaatataataacataataataa

SEQ ID NO: 55283 - DNA, 374 bp, Zea mays
  Clone ID: LIB3068-007-Q1-K1-H6
cacgtcttcagcaaggcagagttccatgtgcttatcctcggagttcataaggctggcaggacgaccttgctagaaaagttgaagtcgatctacttgaagggagaagggcttccgcatgatcgtattgttccaacagttggccttaatattgggcgtattgaagatgcaaatgtaaagcttgttttctgggatctgggaggccagcctggcctacgaacaatatgggagaaatattatgaggaagcccatgctgtaatatatgttatcgactctgcttctgcatcatcatttgaagatgctaaatctgctctcgagaaagttctccgtcatgaagatctgcatggagcgccaatacttatatttgcaaacaagca

SEQ ID NO: 55284 - DNA, 405 bp, Zea mays
  Clone ID: LIB3068-007-Q1-K1-H7
tgttcttggtggatgcaggccttggtaccccaaaaatttgtatgcaagatgagcttacaggactgccaatcaagcgagccaccaggtttgagaataaggtgggatccaagaatgtagtggctggtgaatcactgatcaaaaagcggatttttgagagattcttcatcgatctagtggccggtgaatcactgatcaaagagcgagcagccgccgggtttaatgattttgtgggatccctggatgtagcggctggcgaaccgcttcttcttccacaaagattcagacaaaaccgagcttggatagaactgaagaagatttggcgaacgaagaaaaaggtaaaagggtttcaaattaataaaatagaaggaggttattcaatatccattgcaagttttattacctttc

SEQ ID NO: 55285 - DNA, 487 bp, Zea mays
  Clone ID: LIB3068-007-Q1-K1-F5
gtttcggaatttcccgggttcgactgcacgtcgtctcgctgtacgtcgtgggatgttgtgaggaattcgttaattcaatgagtgtgtacgggaggagactgtatgtcaggcgacaaatcagaaacgtgaaagcaaggtgttgagatattaatagcatggtagttaagagatctatacaattagatcttatctacatcctccggagtatcgtaaaccaaggtatatctgatatgcttggtcagcattctcgagtaatctcctcagctcggtggttccagcctgaagatagcaggtagctgcagtagcttgcggaatcttctactggtacatggacaactgtttggactgatggacttaccagtcttgatcgttacaaaggacgatgctatcacatctagcccgttcctggggacccagatcaatatatctgttatgtagcttatccattagacctatttgaagatggttctgttactaacatgtttac

SEQ ID NO: 55286 - DNA, 214 bp, Zea mays
  Clone ID: LIB3068-007-Q1-K1-D1
acaccgcgcgatgtgcggtgctctttcggccgctggaccctaccttcggctgaaccgattccagggttggcgggccgttaagcagaaaagataactctttccgaggcccccgccggcgtctccggacttcctaacgtcgccgtctgccgccacgttccggctcgggaaatcttaacccgattccctttcgggtgactcgcgtgatcgctctatc

SEQ ID NO: 55287 - DNA, 451 bp, Zea mays
  Clone ID: LIB3068-007-Q1-K1-D12
ggcaagcaccaatcagccagcagtccagcacaatatcatgaacaagcgtgaggtcgccgcggcggtggctgcgctcctggcgctgctagccgcatcatcgacggccggcgccgtgacgttcgacgcgacgaacacggcgtccgatacccccggcgggcagcggttcgaccaggccgtcggcctcgactacgccaagcaggtcctggccgacgcgtccacgttcatctggaacaccttcgaccagcccagccccgccgaccgcaagcccgtcgacgcggtgaccctcgtcgtcgaggacatcggcggcgtggccttcacgagcgccaacgggatccacctcagcgcgcagtacgtcggcggctactccggcgacgtcaagaccgaagtcaccggcgtgctgtaccacgagacaacgcacgtgtggcagtgggacgggcagggccaggcgaac

SEQ ID NO: 55288 - DNA, 342 bp, Zea mays
  Clone ID: LIB3068-007-Q1-K1-D2
gaacctcctgcctcctccattgaccaacaattaagcctgcccgaccgccacatctattgggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaag

SEQ ID NO: 55289 - DNA, 370 bp, Zea mays
  Clone ID: LIB3068-007-Q1-K1-D6
cccacgcgtccggtcaaaccaaccgcgatccgcgaatccgcgggagaggaggggaggggggcgggggcatggagttcctgcagggccagaggctggagaccacgctggccgtcgcgggcgccgtcgttgccgtcgcagccggctccgcctacctcttcctccgcagtaggaagcccaggggatgcctagaccccgagaacttcaaggagtttaaacttgttgagaagaggcagctgagtcataatgttgccaagttcaagtttgcgctcccaacacctacttctgtattgggtcttccaatcggacagcatataagctgcagaagacaggatgcttctggccaggaagtgatcaagccttatacttcaac

SEQ ID NO: 55290 - DNA, 422 bp, Zea mays
  Clone ID: LIB3068-007-Q1-K1-D9
gtcgctgccgcggcggccgtcggcgccggcggctacgtattccacgagcgggacgaggggaagaaggaccacagggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtg

SEQ ID NO: 55291 - DNA, 421 bp, Zea mays
  Clone ID: LIB3068-007-Q1-K1-E1
gcgcccacgcgtccgtccacgcgtccgtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgtcggcgccttcgcactctacgagaagcacgaggcgaagaatgaccccgagcacgcgcacaggcacaagatcatggaggaagtcgctgccgcggcggccgtcggcgcctgcggctacgtattccacgagcaccacgagaag

SEQ ID NO: 55292 - DNA, 278 bp, Zea mays
  Clone ID: LIB3068-007-Q1-K1-E11
cccacgcgtccgcccacgcgttcgaaaaaaaaaaaaaaaaaaaaaaaaaaagaaaaaaagaaaaaaaaaaaaaaaaaaaaaaaaaaaaaaaaaaaaaaaaaaaaaaaaaaaaaaaaaaaaaaaaaaaaaaataaataaaaaaaaaaaaaaataaaaaaaaaaaaaaaaaaataaatatattaaaaaaataattaaaataaaaaaaattgagttaccttataaaataacctaactgaaaaaacaattttaaaacccaactaaattatcttataggaaat

SEQ ID NO: 55293 - DNA, 423 bp, Zea mays
  Clone ID: LIB3068-007-Q1-K1-E7
cccacgcgtccgcccacgcgtccgcggacgcgtccgcccacgcgtccgcaaacagagctgcaactctaaaagcatccgtcccttggcagcagcaacaagctactagctatgtgtgtttagagcgagcgagggaaaaaagaaaacatctaagatatactccaacatcttcgtttgattaacccgcccagtaaagccatgggtactaattatagagcggtcatttctctagtactcctcgtgtgcatcgctagccgctcgtccttgggtgccgctgaaactgacgttgagcagaagcgctcgtcagtccctttgatgtttgtgttcggtgattcgctggtcgatgtcggaaacaataacttcctgccgccgtctgcaccccgtgctgcatctccgtacggcatcgacttcccttctggcaccccc

SEQ ID NO: 55294 - DNA, 323 bp, Zea mays
  Clone ID: LIB3068-007-Q1-K1-E8
cccactcgtccgcccactcgtccgcgcactcgttcgcggactcgtgggcggaggcgtgggctgacgcgctgggggactcgaggcaactccacgcttgatgggtgaacggctgtggtggaggacatgcgtcgtcagctgctgacctatggacgaagaattactaccccagagctttttgcaagaatagatgctgttgatgcaaacactgtgaagcgtgttgcaaaccgattcatctatgatcaggatgctactattgctgctatgggaccgatccaaggacttgcagactactactggttcagacgcctgacctacatgctccg

SEQ ID NO: 55295 - DNA, 360 bp, Zea mays
  Clone ID: LIB3068-007-Q1-K1-F1
gcggtgagagagaggatgggtggcagcggcatggctgctctgctgctggccctggtggtggtggccgtgagcctggccgtggagatccaggccgacgcctggtacggttactgctgctggtacaccccgactcctactccggtcaccccgaccccgaagccctagaagccccccaccaatgggcctaatccggacaagccgtccaatgagcacaagccgtccaaggagcactgtcccaagccggataatccgtccaaggagcacaagcctacgccgtccacgtacaccccgagccccaaacccactccgtcgacgtacacttccaccccgacgccccccaagccgacgccaaccacatac

SEQ ID NO: 55296 - DNA, 425 bp, Zea mays
  Clone ID: LIB3068-007-Q1-K1-F10
cggacgcgtgggcggacgcgtgggcggacgcgtgggtccgcgaatcacatgcgcgtctgtctcagcttgctgcgctgcacgtaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgtcaacggcgccaacgggagcggcacctacatc

SEQ ID NO: 55297 - DNA, 179 bp, Zea mays
  Clone ID: LIB3068-007-Q1-K1-F11
tgctggcttgtgctccgcctttccttcctacactggttcattaggtctctgcggggttctggttgcagaccttagcgcatcgagatggcggactcgcatgttgcgtaccgctgctttgtcggctgtctaggctcggccacggaccaccactcactgcacaacgccttcagcacctaccg

SEQ ID NO: 55298 - DNA, 448 bp, Zea mays
  Clone ID: LIB3068-007-Q1-K1-F12
gtttatagttgagactgtaatactcatctctcacttgttttctgtcaagggggtgcaagaaataccaattaatctggatgtttatggcttttctggtaaatatgggttgacagaaattatagcttctggcttgagctgggtggtttcagatcttgtccagtgccaaccagtgtgtatatatacatttttaaggtcttgtaacctagataattagtgtcaacttcgaggctgcgagtccacaccttatctaccgtgcttgtctctttttctttatttacacatgcatttattttgcctcttattgcattatgcccctttcaggatgaaagatgctcgaagttgaaaatatacccaatactgcagaaggtttaccttgaaagaattttgaggaaaccagaaattgatgcatttgcagaggagcttatgccgcatcaagaaagctttatta

SEQ ID NO: 55299 - DNA, 380 bp, Zea mays
  Clone ID: LIB3068-007-Q1-K1-F3
gaaggccacagcggcacagcgccagcggcaacagtcaccagaccaccactaccagtctagcacccggctgacctgagcgaccccttcgcttccactccactgaagcgggccaaaagaaggaaagaaggcgggcaagcgacaggaaggaggagaagccatggcgagcgacggcgacgggaagggccgggtcgcgacggcgccgggggcaggagggtacggctacggctacggctacgccggcttcgagggggaggaggaccggaagtggtggccgtggctggtgcccaccgtgatcgtcgcatgcatcgccgtcttcgtcgtcgagatgtacgagaacaactgccccaagaaccggagccagctcggcggcgactgcgtcg

SEQ ID NO: 55300 - DNA, 316 bp, Zea mays
  Clone ID: LIB3068-007-Q1-K1-C9
cccacgcgtccgcccacgcgtccgcccacgcgtccgaaaaaaaaaaaaaaagaaaaaaagaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaataaaaaaaaaaaaaatttacattacataaaattcaaatattaaatatataaaaaaatagccaaaaagataaaaacaaatcgccattataaaaaaaatcacaaccggaaa

SEQ ID NO: 55301 - DNA, 395 bp, Zea mays
  Clone ID: LIB3068-006-Q1-K1-H11
cccacgcgtccgcccacgcgtccggcagcatcacaagcaaactgaagtcactcacagctcggcagcttccatccagaaaggagaaggaaacaagctagtggacaaccaaccatgatcagcgccaagaagattgctcatctcgccaagaagtggcagaggatggctgcacaagggaggaagcgcctcgccttgggggcggcagcaaagcaagccgacgagtgctgcagctatgtggcgagcaagggccactgcgcggtgtacacggccgacggggcacggttcgaggtgccgctggcgtgccttagcaccccggtcttcggggagctcctacaaatgtcacaggaggagttcggcttcacgggcggcgatggcaggatcacgctgccctgcgacgc

SEQ ID NO: 55302 - DNA, 436 bp, Zea mays
  Clone ID: LIB3068-006-Q1-K1-H2
cccacgcgtccgcccacgcgtacgaaaagtttcggcggccttctccatgaacacggtggcttcgctgcctttggcgccgcgcctgctcattaagccctccctcgcctgcttctccagaaaggacgtcggccgctatggcgggatcaaggtgtacgccgtgctcagggaagacggggccgagttcgcccggaacaacaacctggaggccctgttccaggtggacgaccccgggccgcgggtgcccgtcaagaagttcctggacgtgaacgaggctctggaggtggtccgcttcgacatccagtactgcgactggagggcgcgccaggatctactcaccatcatgcttctccacagcaaggtggtggaggtcctcaaccctctggcgagggagttcaagtgcatcgggaccttgaagaaagagctcgacgagctacag

SEQ ID NO: 55303 - DNA, 227 bp, Zea mays
  Clone ID: LIB3068-006-Q1-K1-H5
aaaaaaaaaaaaaaaaaaaaaaaattaaatataaaaaaaaaaaaaaaaaaaaaaaaaagaaagggaaaaaaaaaagagaaggaaaaaaaaaaaaaaaaaaaaaaaataaaataaaaaaaaataaaaaaagggccttcccttttatttaacccaattttcctttcccctcaattcaactcattaattttttattatgttcacctaatttaatttcatattcttttttt

SEQ ID NO: 55304 - DNA, 434 bp, Zea mays
  Clone ID: LIB3068-006-Q1-K1-H7
caagttttgaaaactgaactgtaagatggcatcagcagagctttcccgtgaggaaagtgtggacatggcgaagctcggcgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagat

SEQ ID NO: 55305 - DNA, 104 bp, Zea mays
  Clone ID: LIB3068-006-Q1-K1-H9
gcgacctatggacctgcatcagactgctccccctaagttggccgatatttatgttacatagaatggtagccctggtctatggttaatgaacgcgctgtacaact

SEQ ID NO: 55306 - DNA, 281 bp, Zea mays
  Clone ID: LIB3068-007-Q1-K1-A11
tcccacgcgtccgaaaaaatttaacacctttacaaaaaaaaacaaccaaaaagaaaaaaatgaacactaaccaaccgtactaagcttctacaccatacctaaaattcactcacaaacataacatccctcttattaaaaactaaacccaatctattgaccgtaaactatctaattcttacactacgaaatctcttccatttcccaatttatttcctttatttataccgacacattcactaattttcaaactcttatacaaaccaactcttttttttgaacct

SEQ ID NO: 55307 - DNA, 370 bp, Zea mays
  unsure at all n locations
  Clone ID: LIB3068-007-Q1-K1-A12
cggacgcgtgggcggacgcgtgggaaaaaaaaaaaaanagaaaaaaaaaaaagaaaaaaagaaaaaaaaaaaaaggaaaaaggaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaatgaaaaaaaaataaaaaaaagaacatattttaaaaaaatttaataaattaaaaaaaaatggatttaaaaaaaaaaaataaatttaaataaaaaagatattattaaaaattaataaaaataataaaaagataataattaataagaaaataaaaaaatttaaaaatataaaaaaataaaaa

SEQ ID NO: 55308 - DNA, 391 bp, Zea mays
  Clone ID: LIB3068-007-Q1-K1-A4
aaaggattccatcgtgttgctgagagtcttgatgatctcattcttgacataccatctgcggagtctgaatttcagttgttggtatcaaaagccatttctgagggatggttagattcttcgtatgtgaactcaggtgtcaacggaagcgttgaagacgatgaacatgagaagctggctaggtacaagagggaggctgtatccataatacacgaatactttctctctgatgatacaacagaggtcatccgtagtgtcaaagagcttggttatccggaatacaatccgatcttcgtcaagaagctcataacaattgctatggaccgcaagaacagggagaaagaaatggcatcggttcttcttccttcattaaacatggagctgttctcgtctg

SEQ ID NO: 55309 - DNA, 334 bp, Zea mays
  Clone ID: LIB3068-007-Q1-K1-A5
acgacgatggcggcgaacccctcgcgtcctcatccgaggcggctcgcctcgaggccgtgctccggcgtctcacgcgcggatgaggtccggatccgggtgcaccaggtcacgatccggggctgcgcccgcacgcgccgcgccgcggtcgaggcggcggtcggcccggacgtgtcgcgcgccgtcaccgtgcgggacctcgtgcgcgccgccgtcgccgctggtgaccggctccgttgcctcggcgccttcgacacagtctccatcaccctcgacgcggcgccgtccgggatccctggcagcgctgtcgtcgtcctcattgatgttgcggaggccc

SEQ ID NO: 55310 - DNA, 395 bp, Zea mays
  Clone ID: LIB3068-007-Q1-K1-A9
cccacgcgtccgcacctgtgcattctgatgctgacactaaaaaggaagcaggtgcagagggtaccgatggagccgctgatgatacatcaacgcctgctgattgtacacctaaaccaaagcgaggccgtcctcctggcccaaagtcatcacagaagaaggctgctggaaaggatcaatcttcaggttcagatttgaaaaaggtcaatgaggctggtgatttagccggaaagttggcgaaacgaccagcgaaggatgagaagtccacaaagaaggctggtgaaggagaatcatctaagaagacccaaaagtacaattcaaaacaacagaaggatgaaaacctatctgaggatcctgccaaggatctgagcttaaaggaaatgataacgccaaaatct

SEQ ID NO: 55311 - DNA, 444 bp, Zea mays
  Clone ID: LIB3068-007-Q1-K1-B12
caaggattggagagagaagcgggatgagttcaagaagaaggttaggcaatgtgtccgcaggtctcaggaaatgctgtgaaggaggaacatgggggagttgaatgagtctgcaatcggtgtgctgcaattcacaaccaattatctcatgccatcattcttttgctttcccctgtatattttttcaaccggtgtcactcgtatagtggtgttgggtctctttagacaaactcgggacggttgcttatcctaaaaattcgattgtactgcgtggcatgaaatgatcgattcgaagaatattttgaacatgctgccacctaatcaaaaaatttcatgtttaaaaaaaaaaaaaaaaaaaaaaaaaaaaaaaaaaataaaaaaaaaaaaaaaaaaaaaaaaaaaaaatattatattattaaataaaaaaaaaggggcggccgttttaaa

SEQ ID NO: 55312 - DNA, 163 bp, Zea mays
  Clone ID: LIB3068-007-Q1-K1-B7
aaaaaaaaaaaaaaaaaaaaaaaaaagaataaaaaaaaaaaaaaaaaaaaaaaagaaaaaaggaaacatacaaaaggaaaaaaaaaaaaaaaaaaaaaaaaaaaaaaaaaaaaaaaaaaaaaccaaaaaaaaacgtcaaccttaactgggaaacccttttcat

SEQ ID NO: 55313 - DNA, 448 bp, Zea mays
  unsure at all n locations
  Clone ID: LIB3068-007-Q1-K1-C10
attatcttactgttggctgctgctcgccattgctgaccacactcacagcaggctccctgcccctcgccaccaggagctagcccgttgcttgcaagcctcgccaactgccgctatatatacgcatacaagcgcgcgccgcgcacgcgcagcacgcaatcagaacagtggttgctggagagcgcgcgggccgggcaaggagcaaggacgagggattgtcgatggtgttcttctgcttcctggtggagcagcggcggacggtgcggagcagcaagccggcggcggggatctgctcgcgctgcggcgggtgcgccagcgtggcggacatggagaccgccaccagggtctgctacctgctcaccgtgcaccgncgcacctggcgcgccatcatctgcaccttctgtggcgccatgctcaagtcctaccgncactacaggctctactgactctc

SEQ ID NO: 55314 - DNA, 438 bp, Zea mays
  Clone ID: LIB3068-007-Q1-K1-C12
cccacgcgtccggtcacttgctctccctccaacaagctaattaaggccggtgcatccctgttctagctcgttgcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgtcacaagatcgaggaggaggtcgcggcggcggcggccgtcggctccggcggcttcgccttccacgagcaccacgagaagaag

SEQ ID NO: 55315 - DNA, 378 bp, Zea mays
  Clone ID: LIB3068-007-Q1-K1-C4
ggatttccggatgtagtccaaccagtagggtggtgcatatcaatcctaacacaaggctaggtcataaatccgtgccatgcaaatttgtgaagagcggagttgttagcaaaatgaagccacctaggatctacattttgtccatgcacatttcgtttttcttggtcatacttaccttagagtagcaatgtagtagtggaaatgccttaacagggtttagtagcatggaaatgttttggtggtaaattaatgaattaatctgagatgtactagtttgtagtttgcacataccgtcgtgtcaatgtcttttatattgaaaaaaaaataataaaaaaaaaaaaataataaaagaaaaattaaaaatttaaaaattttaataac

SEQ ID NO: 55316 - DNA, 395 bp, Zea mays
  Clone ID: LIB3068-007-Q1-K1-C5
gctatagctagctctgcaacaagagagaaggaggactaccctgcgccggccggcctagggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcatgcggcagcggccaaacaggaagcggc

SEQ ID NO: 55317 - DNA, 237 bp, Zea mays
  Clone ID: LIB3068-059-Q1-K1-G8
gggaagacgactcacatctcgccactcgattacagctagatcgagggagtaagtgagagtgagagccatgacagagctgctcgacacggccgtgaccagcctactacacctgccggaggtgctggaccggctcgccgacgcatacggcgaccggcggtcggccggccaccacgcggcgcacggtcacggtcacggacgcgttcacgggctcggcggcagctgcggatcgccggtgga

SEQ ID NO: 55318 - DNA, 365 bp, Zea mays
  Clone ID: LIB3068-059-Q1-K1-G9
cccactcgtccggggttggcttctcctcttttttcggttcgggttcgggttcgtgagggggtgctttgttcggcttcgtgggtgagcggatcgagatggcggcgtctgatgttgagtaccgctgcttcgtcggcggcctcgcctgggccacggacgaccactcccttcacaacgccttcagcacctactgcgaggtcctcgagtccaagatcatcctcgatcgggagacgcataggtcccgcggcattagcttcgtcaccttctccactgaggatgctatgctgaacgccatcgagggcattaactgctaggagctggactgtctcatcattaccgtcaactatgcccaatcccgctgctgtcgt

SEQ ID NO: 55319 - DNA, 440 bp, Zea mays
  unsure at all n locations
  Clone ID: LIB3068-059-Q1-K1-H1
ccgaacccggactccggcggcggcggctcctgcgtctccaccgagtccgacgaggacgcctcgtcgcgttccccggacgtggtgcggcgtagcctgccgcaggagcgcgcggtcctcctggagcgggagccctcgctgccgccgtcgcaggccgtggacggcggcgacgacgacgacgacgacctggacgccacgtggaacgccatcatgcagaagacgcgcccggcggctccggcttccacccctccagctccagctccagctcccgctcccgccgcgcaccatcagcaacggccgtcgccgagggcccgggacccgtcggtcggcgccgaggagatgaaccggcggttcgacgacttcatcaagaagaaccgcaactccttcggccggcaataggcgacctccgttacgatccgaccaccttcccgncgtacgatgcg

SEQ ID NO: 55320 - DNA, 290 bp, Zea mays
  Clone ID: LIB3068-059-Q1-K1-H11
ccgaaaaaaagaaaaataaaataattaaaaaaattttatattacaacaaaaaaaaaaacaaaataagaagactatcataaagcctacgggggcataaaataaaagcttccttccccatgcttccaacttcatacctatgtccacgtgtcacctaattccaattccactgccctaagctattacaacttacatactggaaaaaccttccctttccccaacttaatcactttgcacctaatcaccattcctcaatctgatcttcattgccaaaaaccccaacccaatccccc

SEQ ID NO: 55321 - DNA, 396 bp, Zea mays
  Clone ID: LIB3068-059-Q1-K1-H2
cccacagcgtgcgtggactcgtgggcggacttgtgttctgaccggctgccacgactacatcagttccggtctcgcgcggcggtcgccggagcgagcagagctggcgcaaggcccgttggatccgccggcgccaagattaatgacgccgatgtagccaaacagatccagcagatggtgcggctcatccgccatgaggccgacaagaaggccaacgagaactccgtcttcggctacgaggaatacaacattgagaagctgcagcttgttgaagctgagaaaacgacgattagaccagactatgaacgcagagagaagcacgttgaaatacggaagaaaaatgagcactctatgcagatgaatgcttctcgcataaaaagtcttcaagctcacgatgat

SEQ ID NO: 55322 - DNA, 460 bp, Zea mays
  Clone ID: LIB3068-059-Q1-K1-H3
cccacgcgtccgggccgacaaggacaagattttcgtctgccagaaaaagctttgggcaggaaggcagtgactagagaggatcatccttcttccttccgagtataaaaaagtaggcatccagatcggccaacaaggcaagaggcgcttcaatacacatggaagatgagcgagtacttctgatacaaagagtgttcggtagttattatcaaaataaataagccgagtaaaactccatataggatccaacagttaccatttttcattaatcacagtttaattctttttctgtaccgacagtttgtacgcgaggaatgggtcaattcatataccatggtgagcaaatgtaagtttactccacactagatgtgtatagcttggttggtgctactgctatcgatgtaatagcgggccacgtatttacttcacatgttctgtggatcaatatactatgactgatgtc

SEQ ID NO: 55323 - DNA, 353 bp, Zea mays
  Clone ID: LIB3068-059-Q1-K1-H4
aattccgacccacgcgtacgcggacgcgtgggtaccatctcggctgcgactgtcgtttgaagctgacggtcttgtgtttgggggcgattaagtagctaattctgagattggccatctgatttctgagatgagctcccatgttcataatatttgcgctgtgctaaatgaggtataatcaataagtgcttatgctccaattcttttatggtgaccatctaaaatagaaaacagtatgacaattgctatgtcatcaaacatgatcatcatggcaaatcttatatcccaagctgtttatatgctcaacaggccgcacttgaagaaatctatatcagtttgaggaaaactccagctga

SEQ ID NO: 55324 - DNA, 454 bp, Zea mays
  Clone ID: LIB3068-059-Q1-K1-H5
gtcgtggagggtgttctggagggtggcaagttcctgtctttgaggttgtgctcaggcgtggtgtgaggtgctgatccaagcccatcaagcagcacttgcctgacagtggtttccatattcgttgcatggcttgcaagggaggggaagctgtctgtgatcggaccactatccatctaatcatcaaggcggaagcaagttgtcctaccattcccgatgctctcatagtggtgatcacgcggtacaaggggaggagtttctgcatgctatcctagtttgctctggacagaggtgagtgtgcattgagattaagctttgctctggacagagggaggccaaagtaagtttgggggaagccttccaacttggcaccgcgttgcaggatcgaggtgaattaaccggctcgatgttgtgggtcaacatgaatgggaacaagggtgctctcatcgtaattgat

SEQ ID NO: 55325 - DNA, 410 bp, Zea mays
  Clone ID: LIB3068-059-Q1-K1-H7
gacccaacgtacggcccgcgtccgttcactcgtacggttagctttcggcatcccgtccccgtccgcgccgaccgactccaccttttcgtcggcgcgtcagcgtcgcagctccactgagcgtgcgtatcaccggcgggaggcaagggcaagctgtggtcgcgatagcgtccgctgacgcacgcttggcggggatcgcctacttcatccgcgtcatccccgacttccccaagccagagatcatgttccacgacatcacgacgttgctgctcgatcccaacgcgtttcattacaccatcgacctctttgtcgagcggtacaaggaccaatggatcaccgtggctgctggcgttgaagctagacggttcatttttggtcctcctatcgctttagccattggcgcaaaatttgtg

SEQ ID NO: 55326 - DNA, 430 bp, Zea mays
  Clone ID: LIB3068-059-Q1-K1-H8
cccacgcgtccgcggacgcgtgggttctcactgagacgggttactccttcacaacgggaggcgagcgagaaattgcatgggacatcaaggagaagctagcatatatagcccttgactatgagcaagagttggaaactgccaagaacagctcttcagttgaaaagagctatgagctacctgatggacaagtaatcaccattggtgcagagagattcaggtgccctgaggtcctcttacagccgtcgatgattggtatggaagctgctggaatccatgagacaacatacaattcaatcatgaagtgtgacgtggatatcaagaacgacctctatggtaacattgcgctcagtggtggttcgactatgttcccgggtatcgctgatcgtatgagcaaggagatcactgtccttgcaccaagcagcatgaagat

SEQ ID NO: 55327 - DNA, 200 bp, Zea mays
  Clone ID: LIB3068-059-Q1-K1-H9
gacctcgacttaatctctatgactctaacaccattgctatgactaactctaatcacactcatgagatgatcaaatcagatgcgcccgaacacttacatcctgattcatttaaggctatcaacgactaacgcattcccatgtactacagccccattattcatgtccagctgttcatccacttctctgtataatagcccaac

SEQ ID NO: 55328 - DNA, 188 bp, Zea mays
  Clone ID: LIB3068-060-Q1-K1-A1
acccacgcgtccgccgacgcgtacgcttacgcccacaatttacgctaacgcacactcacccacactacacgtacggattaaacgaaaagggggccagaacacgagcctaacggagacaaaccagctctcctgggcgcccgtaacccctgctagcctcgccagggtcggaccagctctccgagtcgact

SEQ ID NO: 55329 - DNA, 427 bp, Zea mays
  unsure at all n locations
  Clone ID: LIB3068-060-Q1-K1-A11
gggctttagcgatggtcctgttcatggttggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgcncggggggggggtgaaggaacagaaacagacggacccaccctactatggacgaggacccatacagctaactcataagtacaactacaggctcgccgggcaa

SEQ ID NO: 55330 - DNA, 425 bp, Zea mays
  unsure at all n locations
  Clone ID: LIB3068-060-Q1-K1-A12
cccacgcgtccgcggacgcgtgggctttagcgatggtcctgttcatggctggcgccgggctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggacccgttttntttttgcctggggatactgccgggtgaaggaacagaaacagacggacccaccctactatggacgaggacccatacagctaactcataagt

SEQ ID NO: 55331 - DNA, 304 bp, Zea mays
  Clone ID: LIB3068-060-Q1-K1-A2
cccacgcgtccgcggacgcgtgggccgtgcttctctgctagtctgctctgcaactgcgagacgattcgtttccatcggcatcggtgctgctcgagctcgactgctgcagctgctaccagtagtgagctgtgtgtgtgtgtagtatatacaatattcgtataaactgctggtctcaatcgagtcgtcgcccaatcggttgaatcggggagcagaggcatcggccccacgcccaatcatccggccccaaattcctagaagcacccacccctccgggcgcgagatcccacgcgcgttccttccacag

SEQ ID NO: 55332 - DNA, 426 bp, Zea mays
  Clone ID: LIB3068-060-Q1-K1-A3
gcccggctcgagcgtcccatcccacagaatgctccacactctagttaggctaaagaagggatgtctgctgtcttcggagagattagttcaaaacctgtgactgcagggttgcgaaaggttaccgatgacatgaagtctaaaaaccgcgctgatagaagcggtgttgtcagcagcactgctcctgctcctgctgcagctcctgaaaagacttcccgtgcagggtccttctctttcaaatctggaccccctaaactggaacttcagatgggacgcaaatgggtggctgagaatcaggttggcaagaagacccttgctattgatgattgtgattccagacaatctgtctatgtgtatggatgcaaggattctgtccttcaagtaaacggcaaggttaacaatatcactggtgacaaatgcactaaagtt

SEQ ID NO: 55333 - DNA, 379 bp, Zea mays
  Clone ID: LIB3068-059-Q1-K1-G7
ctcttgtttcttggttatcaaacgattgtttttgtctagtctccagtgtaaataatggtacattgagcatgatctattcgagcagcttattaaggaaacatcatccgatacagaacaaacatcgcaaatcgaccacagtattagcgcaacatcctgcaatacagtacaatacatcacatcactagtcacgcctcattacgctactacactttcttcaagaggtggtactctgatatcgcgaaaccgaacgacgcaacgagcacgtaggcagcagcgtactattatgatacgtactagagctttcaggcgacgtgcagcgcgctaccgagcgctgcgcggaggctgtcgatctcgtcgccgggcaaaaccgccgtgacga

SEQ ID NO: 55334 - DNA, 349 bp, Zea mays
  Clone ID: LIB3068-059-Q1-K1-D8
ccagctgccattgccatctactgacctgtgtttctccgcattcccaaacagcccgagcgagcgagctagcagagcggcggcaggcacctccctcctcaaggaacatggcccgcacgcagcagttggcagtagtggcgaccgccgtggtggccttggtgctgctggcggcggctacctcggaggcggccatcagctgcgggcaggtggcgtcggccatcgcgccctgcatctcctacgcgcgcggccagggctcggtgccctccgccggctgctgcagcggcgtcaggagcctcaacaacgccgagcgcaccagcgccgatcgcctcgcctcctgcaactgcctcaagaa

SEQ ID NO: 55335 - DNA, 291 bp, Zea mays
  Clone ID: LIB3068-059-Q1-K1-E11
ccactcgtccgtaaaaaaaaaaaaaaaatcaaacaaaaaaatatttaaaaaacacccaaaaaacccaatccggaagactttaaaaaaaaaacaggaagtaacaaaaaccaaacacattaatatctaacaaactaaaatgaatacaatctaaaatcccttaaccaccatccaacttaacgcaactcctaaaccaaacaacctcaataattccaactacaatagcatatattcacactgtttcaaaaaaaaaactcctagaaaaacctctgacctaaccaaccttttcccctt

SEQ ID NO: 55336 - DNA, 436 bp, Zea mays
  Clone ID: LIB3068-059-Q1-K1-E12
attgtgggaacatttcatcaaaggagatctttcacaggtcaaacgagacctaagacttgagcgaaaagaaattattagatggaatctatttgcattaaaaaaaccgatcaaaaaaggacgagcgaagtaagtaatcgaaaaactttcttctttgttcgtcctatctataagaggagagcatatgaaaaatgtaacccattcttttgtttttttagctcactggccattcgctgggagtttcgggcttaataccgatattttagcaacaaatctaataaatctaactgtagtggttggtgtattgattttttttggaaagggagtgtgtgcgagttgtctatttcaagaatagattggatctatccggctgcactttagaatatttttagtattttttttgataaataagaaaaggtgcacgatctcgacgaattac

SEQ ID NO: 55337 - DNA, 330 bp, Zea mays
  Clone ID: LIB3068-059-Q1-K1-E4
cccacgcgtccgattcaacaaagccagagattagattaagggtgggaatggtcaagacacaggctcagcttccaaggaccccaggactgatagggtggagtcttatgctgcagaaccaagcacgaagaaatggtcttgttgtgtgacagccagccctacgcaatcctgaggaaggcaattgcatgctctggaaatactgaccctttaattctctatacatactatccataagacactgtagaggtacccatggctctctgagctccaggatgggtgtctgataaaactctggcgtgcatgtatgtatggtgtgagagttgtcggcataca

SEQ ID NO: 55338 - DNA, 442 bp, Zea mays
  Clone ID: LIB3068-059-Q1-K1-E7
gccgattctccgcgtgacttggggcgtcgtttccgagctttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgtcacctctgtacgattaatcgatgccttgagcttgtaacttgttcgcatccttgtaggtgcgatgcttgttgggtcataaactctgatgatatcgagatttggtgatgagaat

SEQ ID NO: 55339 - DNA, 230 bp, Zea mays
  Clone ID: LIB3068-059-Q1-K1-E9
gtctcggagcgcgcatgtggactcaagagaagctctccgttggcggccaccgggaagagaagttctgtacctcaccagcctgcgcgcacggaacaatggctcacgcgaaggccgtcgccgtcctcggcgccgtggtgatcgcgtcgctcctcctcgcggctgagagccgccacattgcccgaaaagacctgggcgtctgccttggtggtggcggctgcttctgttgttgc

SEQ ID NO: 55340 - DNA, 419 bp, Zea mays
  unsure at all n locations
  Clone ID: LIB3068-059-Q1-K1-F2
agcagatctcaaatgcaaagtccaaggagcttagcttccacgacatctttgctgatactctggattcgaggtctaacagggcaaggaacccatcgaacggcagcacagcctcacacgcacctgccaaaaatacaaacgccagcaccttctcgtttggagatgccaacactgacagcacgccaaagacggcaaggaagataaccggcaagaaggtcaacgacctcaccggcaacgacatcttcaagggagacgctccgccagcttctgcagagaagcatctgagcaccgcgaagctgaaggagatcactggaagcaacatttttgcagatgggaaagaaccaatccgcgagcgtgtgggcggaaaccgcaagcctnctggcggtgagagcagcatcgcgctgattaacataatccgggac

SEQ ID NO: 55341 - DNA, 273 bp, Zea mays
  Clone ID: LIB3068-059-Q1-K1-F4
aggacgcgtgggcaggctgcggccggcgggtacggtttgtccacctagtacacggacgccagggtgagggacgtcgcgtccacgggcgagaacgagtacgacgagtacaagaaggaggagatgcagcacatgcacaagcaggaccttggcgaggtcggcaccatcgcacgtgggcgccttcgcactatacgagaagcacgaagcgaagaaagactcggagcacgcgcaccgacacaagatcgaggaggaggtcctggaggaggttgtcgtcag

SEQ ID NO: 55342 - DNA, 419 bp, Zea mays
  Clone ID: LIB3068-059-Q1-K1-F6
cggacgcgtgggcggacgcgtgggcggacgcgtggggttcagctgagcctgagcatggcgtggccggcggccgtgctcgtcagcaatggcggtatctccccacacgctccaccttccgccgccgccttcctcgtctccactccgggcgcctacaccaccgtccccggaaccctcctctggtggacacgtcacctccgccgactcgccgaatccgccacgctactcgcccgttcccgcccgaacctgctcggcctccccctgccccgatcgcgcgccctcgacctagatttactatccatccattctctcgtgaaccccttcgagcgggtcgccatccgcgagatgcgcacaaggcttgccatgaccaaggacgaagatttggcgctcacggccctggtcaggggagccgatcccatttc

SEQ ID NO: 55343 - DNA, 447 bp, Zea mays
  Clone ID: LIB3068-059-Q1-K1-F7
gaaagaaaaaaaaaaaaaaaaaaaaaaaaatttaaaaaaaaaaaaaaaaacaaaaaaaaaaaaagaaaaaaaaaaaaaaaacaaaagaatacaaaataactaactacacaataaagacaactaaattaaaaatcaattaaccggactttgacaacagtacacactggtaaaaccctgccttaacccaactaaatgtcttttcagaacattcgcctatcccaagatggtataatacctaacagacccgcacctatggaccttcccaaaacttgctcagcctcaatggctaatgcaacactccctgtacatgctcttcaaacccggctggagcggtagttactcccagagatgcacataaagttgccaatgacctaggaccaggatcttccgctcacttgccttacttaatcgccacgatcccattgctttccctaccaagctctaaat

SEQ ID NO: 55344 - DNA, 452 bp, Zea mays
  Clone ID: LIB3068-059-Q1-K1-G1
gaggaggcccgcgagcccgaggccgtcgcgctgccgttacgcgctgtcggcgtgcgacctcgggtgccggaggaaggcgggcgcgtgggagacggccgtcacggaggccgccgcgagcctcagcaaggacagcttctccacgtccaagatctggatggcgtcggccgccgggagagaggaagacggccgccggcccggccagagacgagccgcgtcgttccggtggccggcgatcgcctcgggcgcctgcaagtggcaccgcagggacgaggaacctttcgacgtcgaggcgggaagccccggcggcgacaatgccgtctcgtctctgacagaagagaggccaccgtcggtggctatggcggcgatggtctgggtcgccggcggggggcacgggagccattcgtgatccgcattggtttgcacgttggttcaagttcaacacactacacaca

SEQ ID NO: 55345 - DNA, 286 bp, Zea mays
  Clone ID: LIB3068-059-Q1-K1-G2
cccacgcgtccgcagactcatgccgcatgtttaactacactctcaatctctctgctaccgaggagtacgctaattaagggatctatcgtggatacgaagtggactggaaccagctttatgattaacaaggacagcttctccacgtccaagatctggatggcgtcggccgccggtagagacgaagacggccgccggcccggccagagacgagccgcgtcgttccggtggccggcgatcgcctctggcgcctgcaagtggcaccgcacggacgaggaacctttcgacg

SEQ ID NO: 55346 - DNA, 431 bp, Zea mays
  Clone ID: LIB3068-059-Q1-K1-G5
ctcaagcgacacggcacacttacggtcactcttcctccaagactacatgtacaacgtgcgagtggtatgaagctatgaagactggacatgtgatcgaatggttagtactggtaacaaactatcacacttccatgtggttagtacttggcagaacacatatacacttccatgttagccacctgtagcaaccgacataacataatggccatgcgatcattagcataacatataactgcacatggacaaccatgatgagcacatgaaactgctagacatatgccctctggagatgttgatgagaccagctgacatcatgcatactgcatagttggcaagatgtaagtacatatagactactcctacagtccctaattatgatatgaatgtggctcgccctgctgtctataaccatcatcacacagtcaaatgtg

SEQ ID NO: 55347 - DNA, 443 bp, Zea mays
  Clone ID: LIB3068-059-Q1-K1-G6
cgcttttagcaaggctagtatctcatgtactgcaccagttgcaacttactaacttacgtcagctaccgtagtaggcgggcagtagcactgaataatgatcttatcacaactttttttttgcatggcaatgccttaccaggtatctatgttcaagaggacttatgatcatcttcctaaagatacttactttggcatgtataaggaagcgacacgaggaaatccaaattattttctcacctatggtaatggaaaatctgctgcacgaattcaagaccatctccgtactaatggcgcgcacaggtggcataattatgcaaagagcccaaatgagatcaagttggaagaagcttgcagtctgcattatacatacactaaattttcagatttgacatctagacgtgatcgctgtggatgcaagcctacgaaagaagatgttaagagat

SEQ ID NO: 55348 - DNA, 353 bp, Zea mays
  Clone ID: LIB3068-059-Q1-K1-D5
gttgtgatggctaaaacttatgactttgattataactcgagcttctacatgcaaagggcagagttatatttggaagggtgatagaccatgacataaggtaactgctaacaaatttgcaatatatcacaagcatcgctcttcaatggcagacactgttcaattaagaaggccagctgctacaacttccaatataaatgctgatattgtgagaacatccactctgcaatctgcatctctaccgaaacaagaatacttaacaattacattcaagatctatactttaagaaaacgtgactagagtgcattatgtgtgtccagctcaaatatcctcattgtcacaaaatctactatcc

SEQ ID NO: 55349 - DNA, 243 bp, Zea mays
  Clone ID: LIB3068-059-Q1-K1-B6
cccacgcgtccgcccacacgtccaaataaaataaaaaaaaaaaaaaaaaaaaaaaaaaggaaagaaaaaaaaaaaaaaaaaaaaaagaaaaaaaaaaaaaaaaaaaaaaaaaaaaaaaaaaaataaaaataaaaaaataaaataagaaccgaaaaaaatacaattgcaaaaatgcatataactcataagttagaaaacaaatatgaactaaccactgacgtgaaagaaaatacaatggaaata

SEQ ID NO: 55350 - DNA, 377 bp, Zea mays
  Clone ID: LIB3068-059-Q1-K1-B8
accacgcctccaaagcctccgacacctaagcttaccccaccgacgtacactcccacaccgaaggcgccggccaccaagccgcccacctacacttcgacgccgccggtgtctcacacccgcagcccgccttcaccatacttctagaaagcgatgcctaccataccacactgctgacagtctctggagcatctaggtggtctggatcaatggaagggttgtgtcctagccagccggcaatgatgagctgctgatggtactgatgatgataagaggccaatgctaccctactacgtaccctcctctttgtgtgctgtcattcgtccccgttagacgatcgatgagtgaataactcagagctctctgcaagggcctgtctt

SEQ ID NO: 55351 - DNA, 435 bp, Zea mays
  unsure at all n locations
  Clone ID: LIB3068-059-Q1-K1-C11
gaaatacgccggtcttagtcttaagcagcctatcactatcgatcaaagcgacaaccctggagggaaacttccattttcttgaacacgggtaaatgccattctatctcaactatggcgcatttgaccgaggttttcgtctcaagtccactcctgaagccctgccgattgaagcagaaaggctcttcttattctttttagggtatggtatcggactcgaaaccttcaaagtcgctgctacgtgctctgtggtgcgtctcagagccctattccatgtgggggttggaagacatttatttgatcccagagggaggaataattagaccttcctctgggttgaggatacgtagcagtggaagatgccggtacattatacgtctactcacttnctaagcaaaaatcacggccaaactttctttcttttcgaaaactggattc

SEQ ID NO: 55352 - DNA, 434 bp, Zea mays
  Clone ID: LIB3068-059-Q1-K1-C12
gcgtccggaaggactccggtcttagccttaagcagtttatcactatccatcaaagcgacaaccctggtggtttcttacattttcttgaacacggctaaatgccattctatctcaactatggcgcatttgaccgaggttttcgtctcaagtccactcctgaagccctgccgattgaagcagaaaggctcttcttattctttttagggtatggtatcggactcgaaaccttcaaagtcgctgctacgtgctctgtggtgcgtctcagagccctattccatgtgggggttggaagacatttatttgatcccagaaggaggaataattagaacctcctctgggttgaggatacgtagcaatggaaggatgccggtcattatacgtctaactaacttctaagcaaaatcacgggcaaaactttctttcttttcgaaaac

SEQ ID NO: 55353 - DNA, 299 bp, Zea mays
  Clone ID: LIB3068-059-Q1-K1-C3
tccgcagcaggtaccatgacaagattaatttgaaaatgaggacggccctgacgaactgcagagtcaaatggagcatgatcatgacattgggaccaccataagggataatgattatgcctcatgcagctacctggattactggtgaggctgagcaaggagaggattctggtgagtcgggcgacgatgatgaagatgatgatgatgaagacgatgacgaagatgatgaggatgaagaagacgatgatgatgatgaagaggatcatgaggaagaaagcaagccagcatggaagtcaggatct

SEQ ID NO: 55354 - DNA, 205 bp, Zea mays
  Clone ID: LIB3068-059-Q1-K1-C4
tcaacaggagcatgatcaggacatagggaccaccataagggataagatgatgcctcatgcagcttactgcgttactgatgaggctgtgcaaggtgaggataatgttgagctgggccacgattatgaagatgatgatgatgaatacgatgaccaagatgactatgatgaaaaagaggatcatgatgaggcagcgcataatgaggac

SEQ ID NO: 55355 - DNA, 246 bp, Zea mays
  Clone ID: LIB3068-059-Q1-K1-C7
cacgcgtcgccacgcgtcgcggaccgggtttacttagctcaaaaagaaaaaaaaaaagaaggggaattaaaagaaaaaagaaaaaaaaaaaaaaaaaaaaaaaaaaaaaaaaaaaaaaaaaaataaaaaaaaaaaaaaaaaaaagtaaaaacaaatataaaataaacacacaaaactaaaaaaaaaatcagcacgatcaaaaacaagcaactgaacaaaaaacgacaaaataaaacaaatgaatca

SEQ ID NO: 55356 - DNA, 187 bp, Zea mays
  Clone ID: LIB3068-059-Q1-K1-D1
ttcaaacccatcgtcgtttgcttttgctccttgccacgttcaattaatgcttgtgtatgcatgtatgtgccaatatgatgtgccgttgccctggtccattcatttcccttttttttgggggtgaaatagatgtaaagatctcgtcttgcctgccgtactcgcgctgtgttgggaaaaatttggtttt

SEQ ID NO: 55357 - DNA, 413 bp, Zea mays
  Clone ID: LIB3068-059-Q1-K1-D11
ctcgtccgcccgctcgtccgaaaggtttcagcacgcctccttttcccaaggtagcttctaagcttcggtcggtttctcaacgacctgggcggcttaaccaatgtcacgttcccttggaacgcgaacgccctaaccaccttccgtgcctacagcgagcatacactcacattgctatcttgaattcttactcaaaggcctacaaccataactcgtcacactcgatcatctacccaatctccaatcaacccttcgccttttccaatttttttaaacaactttacccatacgactaggtataaacactaacacagcgccgtcatcagactgacaaaaccaaaccctactaccacattccaaacccactcgaacttcccaacatcatagtgtacattacatcacacttcaaaaatcac

SEQ ID NO: 55358 - DNA, 455 bp, Zea mays
  Clone ID: LIB3068-059-Q1-K1-D12
actcgtccgcccacgctttcgcccactcgttcgactggggattgcatttatgagcttagttccaatgggaacaagttccattcttgcgtgttccacccgagctattccaatctcttggttattggaggctaccagtctctcgaggtttggaacatggtgaaaaaccagagcctaaccgtacaagctcatgaaggtctaattgcggcgctggcgcagtcaccagtcacagggatgatagcttctgctagccatgacaactctgtcaaggtgtggaaatagcagtaacaacgattatgatgcacctaggtagctttttttccaaggcaagtgaaatttctcctgctgaagcataaaataaggaagagtagtaaattagatggttgccggtcgcggttcagctgtccaagagcagtgagtttgttgatgggttgtattgtatttatgctgataggctg

SEQ ID NO: 55359 - DNA, 454 bp, Zea mays
  unsure at all n locations
  Clone ID: LIB3068-059-Q1-K1-D2
gcgagacagatagaagcaggacgaagagcattgacacgatatgcacgtcgtggtggaaaaatgtgggtgcgtatatttcccgacaaaccggttacaataagacccacagaaacacgtatgggctcgggaaagggatcccccgaatattgggtagccgttgttaaaccaggtcgaatactttatgaaatgagcggagtatccgaaactgtagctagagcagctatctctatagctgccagtaaaatgcccatacgaagtcaatttcttcgattagagatatagaaccccaaaaaggaatattgaagataaaaaacccctggtttttctttctggaaagacaatatttctttcatccttttgcattgaaataacaaatggaaatccaaataatatgattcaacctcagacccttttaaatgtagcagataacagtggagctcgaaaatngatgtgt

SEQ ID NO: 55360 - DNA, 374 bp, Zea mays
  Clone ID: LIB3068-059-Q1-K1-D3
gggttggcttctcctccccctccggttcggtttcgttttcgtgaggttctccggggttcggtgtcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcagcttcgtcaccttctccacggaggaggcgatgcggaacgccatcgagggcatgaacggcaaggagctggacggccgcaacatcaccgtcaacgaggcccagtcccgcggcggcagctgcgggtacggtggtggccgt

SEQ ID NO: 55361 - DNA, 323 bp, Zea mays
  Clone ID: LIB3068-059-Q1-K1-D4
aaaaaggctagtacatacaactacaaaacatttacgttttccagtagatctgcaccgatcagaggtacggggtcatccgatcgagaagccggcctctaatgtcacctaccgctaattcattggccgcctctccataaccacggaccaccactaactctacaactccctaagtaactaccgttacgtcctatactccaatatcatcctggatcagtagacacaaagccccctcagatcccgcttcctaaccttctccacggatgaagcgatactgaacgccatccatggcatgaacagcaaggcactagactgccgcaacatca

SEQ ID NO: 55362 - DNA, 428 bp, Zea mays
  Clone ID: LIB3068-059-Q1-K1-B5
ggtattgctgctctccgaccccgagctccttaggccgcaacatcaggcgcggccccggtcgcgtgtgaccgaaatggcgctgccgaatcaggggaccgttgattaccccagcttcaagctcggcatcgtcgggtatggtggaaccgggcaaactacatttgcgaaaaggcatctcactggaaagtttgagaagaaatatgaaccaaccattggtgtggaagttcatccgatggatttcaccactaactgtggtaagatcaagttctactgctgggataccgcacggcaagagacgtttggtggactcagggatggatactatatccatggccagtgtgcgatcatcatgtttgatgtaacctcaaggcttacttacaagaatgttcctacgtggcatagggacctgtgcagggtctgtgaagacattc

SEQ ID NO: 55363 - DNA, 351 bp, Zea mays
  Clone ID: LIB3068-016-Q1-K1-F8
gccacgcttgcggacacattagacgacatatttgaccatccactcgagcaccaggccggggcaatgtcacgcgcgatggcgcgcggcatggtctccgcgaacggcggcacgatcacgggctagaataacgtgtcgatctacttcaccatcgactgcaccgacccaatcatggacatcatcatggtcgtcaacttgctggagaagctcatgcaggaccgcatcaaggtcgctggcagcctggctgactacctcagcatctctgtcaccatgtctagcgagacgaccaacgttaccgtaacctttgacagaccgtacttcaagagctacatgaagaacttgtccaagaagtac

SEQ ID NO: 55364 - DNA, 363 bp, Zea mays
  Clone ID: LIB3068-016-Q1-K1-F9
gacccactcgtccactttgacatccaatactctctgactatcatttaatatttggtataccaattcttttttctgtagagtgtacacttagtaagacaacgtgaaccaaacacaccttctttctataccaattatccctatatcacatctaaatatcactcaaatcatcaataatgcaaatgcctattacattcaattaatccttaaggaaaacatatcacacacgatataaccgcttaccttaacgctccttgcctatccactgaacaacacacactcttgtttcaccctggtataccgagaactcctggatcacttgaccatgtccacttcaatacactaattcaataccacctattccac

SEQ ID NO: 55365 - DNA, 378 bp, Zea mays
  Clone ID: LIB3068-016-Q1-K1-G1
gttaacttcgggaagaaattgatggcagatcaaattccagaatggaaaggatattatatcggttacgagttgatgaagaagaaagttaaacagtatggccagcagcttcagcagggggaaaaagatcgtcgtcgggttctgaaggatttctcgaagatgcttgatgatcagatagagaagatcgtcctgtttctgttggaacaacaaggactattggcaagcaggattgagaagttaggaaagcaaagggcaatactacaagagcagccagatatatctggcattgctgagttacgagaagcttatagggaagttggtatcaatctcatcaaacttctcaagttcgttgaccttaatgcaactgcatttcggaaaatc

SEQ ID NO: 55366 - DNA, 448 bp, Zea mays
  Clone ID: LIB3068-016-Q1-K1-G10
tcgcccactcgtccgcggactcgtgggtctgcccaaggaccgacgggtttaggtaaatatctggtgcgttccccaacgggagaggttatttttggaggggaaactatgcgtttttgggaccttcgtgctccgtggttagaacctctaaggggccccaacggtttggacttgagtaggttgaaaaaagacatccaaccttggcaagaacgacgttcagcagaatatatgacccatgctcctttaggctctttaaattccgtgggtggcgtagctaccgagatcaatgctgttaattatgtctcccctagaagttggttagcgacctcccattttgttctaggattcttcttttttgtgggccatttgtggcatgcatgaagagcccgagctgctgcagcaggctttgaaaagggaattgatcgcgatttggaacctgttctttacatga

SEQ ID NO: 55367 - DNA, 403 bp, Zea mays
  Clone ID: LIB3068-016-Q1-K1-G11
aattcctctggtctatctcactcttcctctgactctttttcttactcttgggaaaaaaaaaaaaatataaaaaaaaaaaaaaataaaaaagaaattggaaaaaaaaaaaaaaatataaaaaaataaaataataaaaaaaatataaaaaataatataataaaaaaatataaaaatatatatttaaataacaataaaaaaatttaataacatgtatacaagactatgtatctaaaattagaattattttctgtagaacatatgacatttgattaacttaaacttaaaaatcgcattgatgaaactgtttcaatgattgaagcatacctttaagcctataaaataattgtgtactacaattagcattcaactgaaagaatatactcatatttagctgaaccttgat

SEQ ID NO: 55368 - DNA, 373 bp, Zea mays
  Clone ID: LIB3068-016-Q1-K1-G12
tctcactcttccgcggactcgtgggtctgcctaatgactgtcgtatttaggtatatatctagtgctttgcccatcttcagaggttatcgtttgagcggatactattcgtatttgggaccttcgtgctcatcgattataacctctaaggggccccaaccgtttggacttgagtatgttgaaaaaagacattcaaccttggcaagaactacgttcatcataatatatgacccatgctcctttaagctctttaaattccctgggtgacttagctacctagatcaatgctgataattatatatgccctataacttggttatcgacctcccattttgttctaagattcatctattttgtggtccatttgtggcattca

SEQ ID NO: 55369 - DNA, 332 bp, Zea mays
  Clone ID: LIB3068-016-Q1-K1-G2
aaaaaaaaaaaaaaaaaaaaaaaaaaaaaattaaaaacaaaaaaaaaaaaaaaaaaaaaagcagaaaggtcaaaaataaaaaaagcgtacatacactaacatacaacatatataacaatgccatcccctttcatgaatccaatttactgtccccttctttacaacgtcatccaccgttcatatcccttccctaacctaacttaacctcctctcggtccataccctttccgccggcaaacctcttgctttcccaaacttaccctatttcaattccctcctctttctcccacttaccggaaacttgaacacgccctatagcttcgcttttccca

SEQ ID NO: 55370 - DNA, 439 bp, Zea mays
  unsure at all n locations
  Clone ID: LIB3068-016-Q1-K1-G4
gttttgggtagaacgctagctcatagtattttgggcttatggcacacagaaagcaagtttgtggacaagttttggacattattgctgctgtgagatgtagtgctaggcaacagatggtctggttggtggatcatggattccatggcattgagaagcttgcaaggctagattgattgtgttctgcgggggtaaatcttgcgtggcgttttgaacgtggattggtaaacagaatagcatcttttgaacgtcggttgttccatgtccacagctgatggtggtggcctcgaatgtcgtactgtacgtccatgtcgatgattccgtcgcaggagcctactactactatatccctgttctatgtaagatatgtgtactccagtacanacagtatatggacagctcangatttttttatattggtctacacatacatctttagatg

SEQ ID NO: 55371 - DNA, 338 bp, Zea mays
  Clone ID: LIB3068-016-Q1-K1-G5
cccacgcgtccgggaggtggtacctttgatgtctccctcctcaccattgaggaaggaatctttgaggtcaaggccacagctggtgacacccatcttggtggtgaggactttgacaacaggatggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacct

SEQ ID NO: 55372 - DNA, 372 bp, Zea mays
  Clone ID: LIB3068-016-Q1-K1-G6
cccacgcgtccgagcggccaggcaaagccgagccgcaaccgcgaagatcttgcgtggcctgcttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccggggtggcggcggcggcggcggcggcggccaagaagaagcagcagcagcggtgccgtgtgactgcggacctgctatggccggtgcccggcagtaagggagctccccaggacaaggaggaggacttcgaggccgacttccgcgagttcgagcgcggccctcgcgaggatga

SEQ ID NO: 55373 - DNA, 434 bp, Zea mays
  Clone ID: LIB3068-016-Q1-K1-G9
ctcaatttaaagtgagtaaacagaattccatactcgatctcatagatccctatagaattctgtggaaagccgtattcgatgaaagtcgtatgtacggcttggagggagatctttcctatctttcgagatccaccctacaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaac

SEQ ID NO: 55374 - DNA, 431 bp, Zea mays
  Clone ID: LIB3068-016-Q1-K1-H10
tctaaaccctaatcaatcagtcggtcgccgtcgtccgcccgtccgctcagccggccgagcgctcgagcctcctccgtcccgctcccgcccgtccgccgagcgccgacggcccgagcagccagcaccgcccagcaggcgagccgctccgcctccgcgcctctatccgccgtccgctcgtcccgaggccgcgagccgctccgcggctacgaccctccgcccgccgtctgcccgtccagcgagcgcccgacggcccgagcagcggagcaggcgagcagctccgcgcctccggccttcgcccgcggtccgctcgggctcggaccgagccgctccgcccaccgtccgccgagcgcctgacggcccgagcaggcgagcagctccgcgcctccgcccgccgtccgctcggcccgagcagctcactcgctcagccgcag

SEQ ID NO: 55375 - DNA, 81 bp, Zea mays
  Clone ID: LIB3068-016-Q1-K1-H2
tcgctccactcgtctcgcccactcgtccggttctagatcgcgggcggccgctcgcgatctatactagttctagatcgcggt

SEQ ID NO: 55376 - DNA, 210 bp, Zea mays
  Clone ID: LIB3068-016-Q1-K1-H3
cccactcttactcccactcttccttccactctttctaatctatatctctttctgccattcactatccatactggttccttttaaatctaatgcgacctaccctttcaactctaactccctaacatattttacaacatatcactattataatctcatttacactacctttaattctaacttataatccatcattcataatttttaacacct

SEQ ID NO: 55377 - DNA, 434 bp, Zea mays
  unsure at all n locations
  Clone ID: LIB3068-016-Q1-K1-H6
acgccgcatgtgaaccgtactgagtatcagctgattgatatttctgaggatggattggggagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaangggttgctgggtgtcgtacctacctgacttatcattatctgtgggtacaatttggacccttgattttctatgctt

SEQ ID NO: 55378 - DNA, 225 bp, Zea mays
  Clone ID: LIB3068-016-Q1-K1-H7
tttcatttaaaccaaactaaaaatataaaaaaaaaaaaaaaaaaaaaataaataaaggaaagcttaaaacataaaataaggacaaaaaaaaaaaaacaataaacaaaacaaaaaaaaaaactaaaaaaggcccacctttctgaaggacccaacctctctaacccatccttccaacactatacatttttttatggggcaccaaaataaattcacctggcccgattt

SEQ ID NO: 55379 - DNA, 305 bp, Zea mays
  Clone ID: LIB3068-016-Q1-K1-H8
ttaaccgtctgatatcacttttgatatttctaggatggatggtatgctctttcttaatgggacggctaagatgatcttaactcccaactgatagactctttggcccaataagaagggttctaaagcggaagatcttgtgtgactgtccagtctcatggaggagacagatcttcccttgaagatgttgccccaagtaacttccttgactttggaactaaccctactgttctaacttaaatctaaaataactgatcaccaaaggattgctacctatacattcacctggcttgatcttgcttttccta

SEQ ID NO: 55380 - DNA, 342 bp, Zea mays
  Clone ID: LIB3068-016-Q1-K1-F7
acgccaagatctgctacctgactgacaaatgtgtactggcatcttctgcctttcaaggggatagtaatgctctgcagaagaacctagctgccagagaattgctgtaccaacaccagcataataaaaggatgagctgcccctccatggcacagctactctccaataccctgtactacaagcgattcttcccatattacgccttcaatgtgctcggtgggcttgacagctaggggaaaggatgcgttttcacctatgatgcagtaggttcctatgagagaaccggttacagtgctcatggaacggaatctactttgatcatccccgtcctggacattcaactaa

SEQ ID NO: 55381 - DNA, 322 bp, Zea mays
  Clone ID: LIB3068-016-Q1-K1-E1
tcgaccaggcgtccgcccactcgtccgggaggtttgctttcgcgatggtcctgttcatggctggggccgggctgatcgccagggctgacggcgccgtcgctcagcatggcatgtggagcatgatcacccggcccatgttccacagcatgctgagccaccgcggcgacagcgggtgccagggcgccttctacacctacgacgccttcatcgaggccgtcagcaagttccccggcttcggcaccaccggcgactagcagacgcgcatgcgggagctcgccgtcttcttcggccagacgttccacgataccaccggtggatgggc

SEQ ID NO: 55382 - DNA, 396 bp, Zea mays
  Clone ID: LIB3068-016-Q1-K1-E10
atacaaagtcaacaccaatgattaaatagaatttatggctacacaaaccgttgaagatagttctagggctaagccaaaacggactgtcgcacgtagtttattgaaacccttgaattcggaatatgggaaagttgctccgggttgggggactactccttttatgggggtcgcaatggctttattcgcgatattcctatctataattttagaaatttataattcttctgttttactggacggaattttatcgaattaggtttctactaactaaaactatgacttcatagtttttccatctcaaaaaaagcctttctactttaagctccacatttctagacattctggtagttcgaccgtggatttttctgatgtggtatctctggaatattagtgtgt

SEQ ID NO: 55383 - DNA, 432 bp, Zea mays
  Clone ID: LIB3068-016-Q1-K1-E12
ggagcacagagagacttcctcgcctccatcccatcccttcgccgccgtctctacggtcgcgaataatgagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttacttttggtagtattttttacttcctctttctac

SEQ ID NO: 55384 - DNA, 394 bp, Zea mays
  Clone ID: LIB3068-016-Q1-K1-E2
cccacgcgtccggtttgacatggcaaatgactaaacgaagaggtgatcaggaagtccacagagtaactgaggagagacctggctggtgtagcgaccctcacctgccaccatgtgcagcgtttgttgaaattatggcaactgtattctcaagggatgcatggcgctgtgtatggcatatgattcagaacgacttggtccatggatggggccttgattttgctcttaggaaatgtgtggagccagcccatgagaaaattggagtggttgactcccagtggattgttcatcaagtcatcccttcgcttggtaaccagggcaaggcagagaatggaaaagcaccatgggaaggggtagagcacgctgtcgtaaagaaggggggatgttccaaacaagg

SEQ ID NO: 55385 - DNA, 444 bp, Zea mays
  unsure at all n locations
  Clone ID: LIB3068-016-Q1-K1-E5
cgctggtgctccagctgaccgtgtgctcgcacctttttctcttccccaaccgtgcccgaggcctcgcgctcccgccccctccggggaccgctgcggtggttgaggcgacgcatgaggaggaggaggaccaggagtgggaggctgcgctgcagaagtggaagaccaagacctacgcgctctcggtgcccctacgggtcgtcgcgctccgcggctccttccctccatcttggattaaggatttcgtcgaagctcaggggaagagactcaaattcagtcctgaactccgtgctaatcttgatgggatcttctctgagatgtcacaatgtatggacaagggtcaagttcagccgaagtctgcaatggcagctgatgttgtttccctggggactctnggctcggctatgccatccgtaagggattgctagagcctatcatgaatgctga

SEQ ID NO: 55386 - DNA, 339 bp, Zea mays
  Clone ID: LIB3068-016-Q1-K1-E7
gtgaagagcaacatagaagctgtttggatgggacactctcctcctttgctaaggctcgcaattgtggatttggcattaccaaaaactcctaatgataactctctgtcattgtttgctgatccccttgttccagagagattttattgtgcgcatggtggggggcttgacatggtcacactgcacttcctaccattttcataccctgaaatgtcttcgacaccaccctctgtgcatcctgtcctcactacagggaacagcgaaacaagctcaccttttctttctggatttgttaccatagctgatgcatatggtcatgtacagttagctggcatcacatgc

SEQ ID NO: 55387 - DNA, 268 bp, Zea mays
  Clone ID: LIB3068-016-Q1-K1-E8
ccgcacatcgcgcggtgtccggtgcgcacccggcagtcctagaatatcctgaggagcgcggttcgtacactcgcggtcgcactcataaccgcatatggctttcaaggagaacagcctctggccaatggaacaatgtaagcaagggaagtgcgtaaaacggatccgtaactacaggaaaaggattgtctctgagggttgagctccgtgatcccggtctactaacccgtctgctgctggcggaatgatcgagctgctcacgcgcaaatag

SEQ ID NO: 55388 - DNA, 448 bp, Zea mays
  Clone ID: LIB3068-016-Q1-K1-E9
cccacgcgtccgcccacgcgttcgcaccagcctaaattgcatggaggacttgtgatcaaacacaatgcgcaatcaacgatatgctacaaatgctgtgacagcatttatttttcgagaaattgctgagagacaccagctacctatacaggattttgttgttcgcaatgacatggcttgtggttcaacaattggcccaatacttgctagtggtgttggtattcgcactgttgatattggagcaccccaattatcaatgcacagcatcagagaaatgtgtgccgctgacgatattagctactcatatgagcatttcaaggcatattttgaagaatttactgaattggatggcaaggtcaaagtggattactaaagcatatagcacaataggttagctttgttacaagctgtactttatacaaattcgataagcaagtggagaacaaatttg

SEQ ID NO: 55389 - DNA, 336 bp, Zea mays
  Clone ID: LIB3068-016-Q1-K1-F1
accacgcatgcggacagtgccaaacgcccattaaccaactgctgcacctaccgccgttaggccgggctagcacgcgcgcgtgctctctctctaccctccctgtgtgcactaaactactaggagtctaggtcggggctacgacaactggtcagagacgaccagcacccaccatgaaaagggttgctcctagcctactacagatagggatgtttacgatcaagctacaatgaaggattctcaggatattcagagcacaacagagttgcagtcatcagcacagggtactaatgaagtgcatagtcagcaaccaaacccgatgaccactgatgctcctgc

SEQ ID NO: 55390 - DNA, 352 bp, Zea mays
  Clone ID: LIB3068-016-Q1-K1-F11
cgaagtttggaggctttattggtactgactgtccattggggaagagaatggagaattcagggactcgggctgagatcggttgggaaccaaagtatccaagcttcaccgaattccttggtatcagcagttaacatccttgcatactgttcagttagtctgactcagctgagttgcaaccgtgattagattgtacatcgtttgaatttttatatggtctgaactggtgatggtgtacatctcagcctaattttttattctcacagtatttgagctgtgaaccagacagatgccaccccatcccactggacaatatatactgtcacgtgagtggatttctcgatcaaaataaaat

SEQ ID NO: 55391 - DNA, 354 bp, Zea mays
  Clone ID: LIB3068-016-Q1-K1-F12
acccactcttcctctaagtttttaggctttattggtactgactttccatttttgaagagaatgtagaattcaagatctctgtctattatcatatgggatcgaaagtatccaatcttcacctaattccttattatcagcatttaacatccttgcatactgttcagttagtctgactcatctgagtatcaaccgtgattaaatcttacatcgtttgaatacttatatagtctgaacttttgatggtgctcatctcaccctaatttattattctcacagtatatgatctcttatccaaacaaataccactctatactacttaacactatatactgtcacgttaatagatttctctat

SEQ ID NO: 55392 - DNA, 346 bp, Zea mays
  Clone ID: LIB3068-016-Q1-K1-F2
ctgatgttgcagtcctcctggacaacgaggctatctatgacatatgcaggaggtcccttgacatcgaaaggccaacctacaccaacttgaacaggctgatctcacagatcatatcatctctaaccacctccctgaggtttgatggtgctatcaatgtggatgtcaccgagttccagaccaaccttgttccatacccacgtatacatttcatgctttcctcatatgcccctgtaatctctgctgagaaggcttaccatgagcagctctctgttcctgaaatcaccaatgccgtctttgagccctcaagcatgatggccaagtgtgacccaaggcatgggaagtacat

SEQ ID NO: 55393 - DNA, 322 bp, Zea mays
  Clone ID: LIB3068-016-Q1-K1-F3
ctaaccaccagtccaccacctgattgactagagcaaaagcacaagccgcccacgcatctggattgcggcagcagcagaagcggcgcgcagagctcgtgacgagagcaaccttccttccgttcctcgatcgccatggacaaggtgctggccttctcgatcctgagcgcgtcgccggccgacctctccttcacgggcgccggcttcggcgggagctgggcgcggctgtcgtggcggcggggcgcggacgaccagcgtgcgccgcggcgggagcagcagaagcagcagcaggaggaggacagggagaagcgagacttgcgctccc

SEQ ID NO: 55394 - DNA, 386 bp, Zea mays
  Clone ID: LIB3068-016-Q1-K1-F4
aatagtctctgactatcattaaataaagggtagagcaattcttttttcgagagagtctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttt

SEQ ID NO: 55395 - DNA, 213 bp, Zea mays
  Clone ID: LIB3068-016-Q1-K1-F5
cccacgcgttcggctgcatagagtcagacggtgtatcagcttgtacgccatcaatcaagtgctgtaaacatgcctgggaaataattggggacctggatttgaataagatttgagttgttgggggcggacgtgctacattaggccttgttcggttattcctaatacccttcggtgcaataaaggaaatcatcttgcgcgtgaccgagcgtgcac

SEQ ID NO: 55396 - DNA, 383 bp, Zea mays
  Clone ID: LIB3068-016-Q1-K1-F6
ccaagatctgcgacctggctgacaaatgtgtactggcatcttctggctttcaaggggatagtaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccagtcctggacaatcaactaaaataaccaagtcctctattactccctgtcagggatgctgtcaca

SEQ ID NO: 55397 - DNA, 407 bp, Zea mays
  Clone ID: LIB3068-016-Q1-K1-D9
cccacgcgtccggcagtcccctgatattgctcagggtgtgcacggccacttcaccaagcgcgcccgaggagattggagctggtgaccaggggcacatgtttgggtatgcgactgacgagacccctgagctgatgcccctcagccatgtccttgccaccaagcttggtgctcgtctcacagaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaagagcacgtcatcaagccagtcatccccgaacagtaccttgacgagaagacaatc

SEQ ID NO: 55398 - DNA, 235 bp, Zea mays
  Clone ID: LIB3068-016-Q1-K1-B6
cccacgcgtccgcttgtcagttatacaagtctaatgcagtcttttcactatcttggtcttgatttatctacgacgtcgatactgattacagattgttttgtattgtattttacgacaattggattttatttgtttctacatttgtatattgtttgtgagatgagagaaacctcttcaaggcgttgaaccaaacgtacttttccaacatttcatatatatcttaataattacattt

SEQ ID NO: 55399 - DNA, 438 bp, Zea mays
  Clone ID: LIB3068-016-Q1-K1-B8
cccacgcgtccggcgcccagggaggccaagacggaggccgcggacgccacgacggtcacggtagcgtcgacgtcgtcctccctactgcatgccgcgagcgttgccggcccggcggtgaggcacggtgacctgcccaccctgcaggtgccaacgcacctcggagtcgccgactggacgcagatgcaggacccgtttcagctgcgcagcccgtggcaggaccacctcttcttctctcccttagcccacctgctatactgaagtctgaactctgaagtgaggaaggtgcacgcgcaacttggaagaagtggtgaactgtatcaccgaaatgcggttcagctctgcaacggcgagccgtgatgctagcttagatgtgaattcggttgaggatatactgcacgaacaagtggaagtagaagaagaagtgagtactcgtatcgg

SEQ ID NO: 55400 - DNA, 354 bp, Zea mays
  Clone ID: LIB3068-016-Q1-K1-B9
aaaaaaaaaaaaaaaaaaaaaaaaacaaaaaaaaacactaaaaaaaaaaaaaacaaccaacgggaaccaggaaaaaaaccctactaaaacagaccacaaaaaacaaaaaaaacaaataaaacaacaaaagggcccacccctatatggctcccaacctatcgaccacatccagactaggttaacgctgctacaacgcctacccataactcctgaaatgaccagactttatacactcgcgtccctgtaaaacccttgcagctacccatcatataggactggcggcactcccccttttgcccaccatgcccaattagcaatgggccctaaaacactccactgaccgaacttaagccc

SEQ ID NO: 55401 - DNA, 423 bp, Zea mays
  Clone ID: LIB3068-016-Q1-K1-C10
cggacgcgtgggcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcggccacgtggtggcgtcgcggtgcctgtacggcgggacacacgcgct

SEQ ID NO: 55402 - DNA, 323 bp, Zea mays
  Clone ID: LIB3068-016-Q1-K1-C11
tctcactctttcgctgacacctcagcaacatcttcagctctaccgacgagaatcccaatgggcgacaagtgcatttttacccgccatcagcacaatgccactacccatcactaatactacaaccaccaccctatgaacatgatcaaatctcagaatctgctacatacagcatttaatccgttcactatgcacccactattcgatctccaactctaccccaaccgctatcacatttacatctacagtctacacttcaaccctacatactctattctccatctgtacattgcgtctctgctaatccacgaaaactaccctactta

SEQ ID NO: 55403 - DNA, 279 bp, Zea mays
  Clone ID: LIB3068-016-Q1-K1-C12
ctcttgctgattcgtgagggtggggagcttttggtggcggtgacatggctggctcgatgagatacgaggagagaatgattcatgctgaggtatgctacttctgtgtacagatgagatatatcatatttccaacctactcgctagtatgtgtatcataatataggtgctgactatatagaattagactgctctagtgagcttccaagaagttcattcgttccaacagacaagtatctttgccttgcaacttgggataccaaagctccaacaccgcaccag

SEQ ID NO: 55404 - DNA, 205 bp, Zea mays
  Clone ID: LIB3068-016-Q1-K1-C2
ctgccatccgtccccgttagacgatcgaggagagaataacgcagagctctctgctcccgggctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 55405 - DNA, 167 bp, Zea mays
  Clone ID: LIB3068-016-Q1-K1-C7
cccacgcgtccacacacgcgtcctgtcgtggtcaccctgatgcaaccagacaagagcgacggtctaacacactttgcgtcgctgccaaaccgcccatcgtagcaactcgcctgcacggcattcggcgtcgaagccggctccgtcaagatcaaatactccctgcaaga

SEQ ID NO: 55406 - DNA, 405 bp, Zea mays
  unsure at all n locations
  Clone ID: LIB3068-016-Q1-K1-C8
cgcattctcgcgtcggcttgcttttaactgaatccagcccaccgcttctcgcacgtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccggctaggctcagggcgcgactagcatgggagtagtgcgatacttttgagagcaagggatagcgaggatcttggtctttggaatagtattgttaatgacattttttttccggtggngtttctggaataaatcgttgaacgac

SEQ ID NO: 55407 - DNA, 312 bp, Zea mays
  Clone ID: LIB3068-016-Q1-K1-C9
cggacgcgtgggcggacgcgtgggcggactcgtgggcagcgctgctggcctggttcagtgtgatgaggaagaggaggaagccagcgacggtgagggccctacggcctatgttcctgtcaaggttacccctctgcccgtcgctgaagggtgcctcgtcctcccgtgagtccgtggtcggttaaataaagggccgtatatgattgcgagccctgtgctctgccgctattttcttctcgtttgtgtcttgctgctctcgtggtgaactcgctactccagtgttctgcaatattaagcagaagctattgtattgtt

SEQ ID NO: 55408 - DNA, 338 bp, Zea mays
  Clone ID: LIB3068-016-Q1-K1-D1
cttctcctccccctccggttcgggttcgggttcgtgaggttctccggggttcggtttcgggggtgagcggatcgagatggcggcgtcggatgttgagtaccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaagcgatgcggaacgccatcgagggcatgaacggcaaggagctggacagtcgcaacatcaccgtcaacgaggcccagtcccgcg

SEQ ID NO: 55409 - DNA, 308 bp, Zea mays
  Clone ID: LIB3068-016-Q1-K1-D11
gacaaatgttgtgaacatggttgacatagcttaagctcttgccaggccagcttcctactcgaccaagtactttggatgtgagcttggtgcacagtccaaatttgatgagaagacagggatttccttggttaatggggctcatgatactgcaaagctggctggtctccttgaggtattcatcaagaagtatgtccaatgttatgggtgtgggaatcctgtgactgagattctcatctcaaagacccagatgatatcatcgaaatgtgcagcctgtgtgttcgtctcagatgttgatatgagggtcaagc

SEQ ID NO: 55410 - DNA, 340 bp, Zea mays
  Clone ID: LIB3068-016-Q1-K1-D12
agagtatgaagggcaccccaaatcatctaaacaggatgctgaggatctgtgagcggtgattgaaattgcattttagtttcttcgcccttgttgtttaaagctcttcaacttattggcatcatgaggaactgtcgtgagacatcaatggtcagagtccgaccataaccacatatatagttttaacaatgtctcaagttttgtgttattacctgttgtctgttgtctgccatatgtaatagtttcctttcagaaggcaaaagcacttccttcccaaaaaaaaaaaaccaaaatactcataaaaacaaaaaagaacaaaaaaaaataataaactactaccacc

SEQ ID NO: 55411 - DNA, 341 bp, Zea mays
  Clone ID: LIB3068-016-Q1-K1-D3
cgacccacgcgtacgttatgtcaccacatacagaaactaaaccaattcctgtatttaaacctgctgtcaatgattagaaacggactatactacaccccggagtacgaaaccaaggatactgatatcttcacagcattcccattaactactcatatccaaactcctcctgaagaatcatgagctgcagtagactgccaatcttctactagcacatgtacaactgtatgcactgatacacttaccagacttgatcgatacaaacgaccatgctatcacatcgagcccgtttctagggacccatatcaatatatctgttatgtagcttattcattatacctatt

SEQ ID NO: 55412 - DNA, 277 bp, Zea mays
  Clone ID: LIB3068-016-Q1-K1-D4
taaaaaaaaaaaaaaaaaaaaaaaaaaaaaattaaaaaaaaaaaaaaaaaaaaaaaaaaaaaagaaaaataaaaaaaaaaaaaaaaaaaaaaaaaaaaaaaaaaaaaaaaaaaaaaaaaaaaaaaaaaaaaaaaaaaaaaaaaaaaaaaaaaaaagactgccccttttttaaattcccatatttcccccccctcaattccaatttttaaaaattttttttttgtcccccaaattcaattacatgtccctctttttaaaaattctttaccttgaaaaa

SEQ ID NO: 55413 - DNA, 352 bp, Zea mays
  Clone ID: LIB3068-016-Q1-K1-D6
cccacgcgtccgctcgccactattattctgcacagcaacgcatcaagccttctagggccatctcgccgccgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgtcgccttcctcttcgccgccgtccgccactgagccgatggggcctcgtgcctgcaggctacctagcagtactttcgccgctgctgccgccgc

SEQ ID NO: 55414 - DNA, 252 bp, Zea mays
  Clone ID: LIB3068-016-Q1-K1-D7
gcgcccacgcgtccgctcgccactattattctttacagcaacgcatcaagccttctaggaccagctcgccttcgccacacgacaacccgtcgaagcgaatcaagcaatggccggagtcggatcgaaggccctcgccgttgccgccgttctggcggccgtctccctctcggtggccgccgcggtcgaggcgcctgcgcccagccccgtctccgccgccgtcgcggcgtcgtcttccttcgccgcggtcctcgt

SEQ ID NO: 55415 - DNA, 317 bp, Zea mays
  Clone ID: LIB3068-016-Q1-K1-D8
ctgctgcccgtcttcttccgtcgtcgccgtcgtcgtcttcgtccgtagagcatcggatcagagagcggggaggaagaaaaaccgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcggtccacagccactgcggcggcggctgtgccaagtgcgtgtgcgcgccctcgacccacgccgggtcgttcaagtgcc

SEQ ID NO: 55416 - DNA, 393 bp, Zea mays
  Clone ID: LIB3068-016-Q1-K1-B4
ctctgcgtggcggcgctgtctggccacccaggggcgccgcccagcgcggcgcacccgccggggaccggcgtcgagccctgcttcgccgcgcccttcgtccccgtcgcgcggatgaagcgcgcggcagcgcaggcctagctggcttgccgcgatcgacgacaggcagagttggttaccgctgctacgacgcctacgcgtgacgcctgaagtgaatagacttgcttcgctcgtgtcgatctcggcatgtagcagcgaatcatcatgtaggacagggggcgctctcgctgtggtgcccagccccagtgagcaatggcatatagaacactccagtgactgtacttaaatcttatggaacttgggtctgctactgataactaatgaaccaatgttttc

SEQ ID NO: 55417 - DNA, 376 bp, Zea mays
  Clone ID: LIB3068-055-Q1-K1-F4
gacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatca

SEQ ID NO: 55418 - DNA, 350 bp, Zea mays
  Clone ID: LIB3068-055-Q1-K1-F6
tccacgcgtccgaataagacgacttgtttcattgattcttgaagagatcgagcttgtttggcaccacaaggtcgaggatgtcttgcaactgcggatcaagctgcggatgcggctcaagctgcaagtgcggcaagaagtaccctgacctggaggagacgagcaccgtcgcgcaggccaccgacgtcctcggcgtggccctcgagaagaaggccgtgccctagttcgtccatgccgtggcagagttcggcgaggccgctcactgctgcagctgccgtggcagctgcaagtgcgacccctgcaactgctgatcacatggatcgacgaccatggatatgattattatctatcta

SEQ ID NO: 55419 - DNA, 204 bp, Zea mays
  Clone ID: LIB3068-055-Q1-K1-F7
ggcgattgaagcagaaaaaatcagtcgccgtagcagcgccgcctccgccgccgtggggaggtagcatctaggcccattccgccgcctccatctccggccagcaatggcttcggcggtggagcggcggagggaggagcacgcgcggagatcgcgttccccagcacggtgcatggagcggaggtgaacgccgtcacgcatgcggag

SEQ ID NO: 55420 - DNA, 363 bp, Zea mays
  Clone ID: LIB3068-055-Q1-K1-F9
cccacgcgtccgacttcaacttcctcggccccttcctaattgctgctatcatggtgctcatggggttttcactaatccagatctttttcccactgggcaagatctctgtgatgatatatggtggattggcatctcttatcttctgtggctatatcatctatgacacagacaatatcatcaagcgccacacatacgatcaatacatatgggcagctgtttcactctacctcgacgtcatcaacttgttcctgtctctgctgcagctgctgagggcagccgatagctgagctcattaatggagtgtttggtttgagaaatgatatagtccatcatcttctcactcctcacttttttgtttggttg

SEQ ID NO: 55421 - DNA, 426 bp, Zea mays
  Clone ID: LIB3068-055-Q1-K1-G12
cccacgcgtccgctcccgcggcaagtctctctgaattgtgggtctccggcgatggcggctctagctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccagacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatg

SEQ ID NO: 55422 - DNA, 433 bp, Zea mays
  Clone ID: LIB3068-055-Q1-K1-G4
ggccggagctccctcctctccctcttccatggccggcgtccccttcagctccaactcgggctccatcccatggcgcccggccgcctcttctcccccatggcgctcctcccctgctcctccgacgcggcggcttccggctcgctcgaccggccatggtggccgcgcaagcctcctggccgcgggcggctctagcccaggccaccttcgcgcccggggttatggcgcgcgtccctacgcctagctaggcgcctagcctttgtctccgtcgcgccgatccgcgctcgccaaggtcacccgccatcgcccagctcagcggcttcccctgctacaaagttcgtcgtctgtccgtacgtcgcctgctgcttatatcctagccaggtcaaccttgtcatggtgctggagctctcggggatccggcatgtcgtctacttgc

SEQ ID NO: 55423 - DNA, 150 bp, Zea mays
  Clone ID: LIB3068-055-Q1-K1-G6
cccacgcgtccgaaaaaaaaaaaaaaaaataaaaaaaaataaaaaaaaaaaaaaaaaatagaaaaaaaaaaaaaaaaaaaaaaaaaaaaataaaatatatataaaaaaaaaataaaaaaaaataaaataaaaataaaaaaaaataaacaa

SEQ ID NO: 55424 - DNA, 457 bp, Zea mays
  Clone ID: LIB3068-055-Q1-K1-G7
cggacgcgtgggggatgatcctttcttctctcttagctttggcttgtcttgggagtcttggtaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaagcatccccctgcccgaaaaagtgatgggccatctcagctatcggtttcttcaactgggtcccgcaatgatgaaaagcatggaggtttaaaag

SEQ ID NO: 55425 - DNA, 52 bp, Zea mays
  Clone ID: LIB3068-055-Q1-K1-H1
acccgtgactcgtcgcctgacgcaggggcgcgagggaatcataacaagggct

SEQ ID NO: 55426 - DNA, 223 bp, Zea mays
  Clone ID: LIB3068-055-Q1-K1-H12
taaaaaaaataaaaaaaaaaacaaaaaataaaattaaaaacaaaaaaaaaaacacataataacaaaaaaaataataaaaaatttaataaacctaaaaaaaaaatacatttaccaaaaaaataccactattacatttctaaaacccctctttatacccaacttactcatattacatcacatttcctctccttctacttacttacaacacatacaatctctcttc

SEQ ID NO: 55427 - DNA, 451 bp, Zea mays
  Clone ID: LIB3068-055-Q1-K1-H8
cccacgcgtccggtgagaaagatggcatctgggctgtgcttgcatggctttctattattgctttcaagaataaggacaaccttggaggagataagcttgtcactgttgaagatattgtccgtcagcattgggccacacatggtcgccattattacacacgctatgactatgagaatgtcgatgctggggctgctaaggagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccgggtctggtggtgccaccatccgtgtctacatcgagcaatacgagaa

SEQ ID NO: 55428 - DNA, 441 bp, Zea mays
  unsure at all n locations
  Clone ID: LIB3068-056-Q1-K1-A12
gaccagtgctccatcctggagaaggaggccgtgaacgtgtccctggagaacctcaagagctacgccttcgtccaggaagggctggccaaggggaccctcaagctggtcggcgcccactacgacttcgtgtccgggaagttcctcgtatgggaaacttagccacccgccgctcagctagcgcgcgccttcgtcacaactcctatatcttcataaatatatatatccacgtactacctatatatacctaccgatatgtgaatgcgaggagtactattacctgcatgttttcagcagtatgcagctacgtacatatatatgtaccggatcgcctgacgacgtgaatgtaataagcaataacattttctaccgctttntttttatttctttctaacgtcgagcttctatatgtagcaacaacattttctacgtacatatatatat

SEQ ID NO: 55429 - DNA, 269 bp, Zea mays
  Clone ID: LIB3068-056-Q1-K1-A5
aaaaataaaataacgggttttggttttctaaaaaaaacaaaaaaaaaacggcgagggtttactctaaaagggaaccaatcttacctcccctttcttacaactaaataaatcttttatacccttacctaaatccaattcactttctcttcatttaactcttatttaataataaaacactcttctaacccatattaatttcataaaaacaaaacttactatctccatctactctaataaaaaaaatcccataaccaatctgcctatctaac

SEQ ID NO: 55430 - DNA, 222 bp, Zea mays
  Clone ID: LIB3068-056-Q1-K1-B1
cgcgagagaccgatagcgaacaaatatgcttggtttaaaaaaaaaaaaaaaaaaaaaaaggaaatgtttaaatttaaagtgttgttctcccaatttaaaaaaaacaaaattaacaatctcttgccccctacataaaattcccttctttatttccccctaattccaaatttctttcccttttttttacaacccttaacctctaaatccctcgctttacccaac

SEQ ID NO: 55431 - DNA, 413 bp, Zea mays
  Clone ID: LIB3068-056-Q1-K1-B11
cacacatatcagcaaggtgaagtaataagggcgaaggtgaactctctcacttccattgagacagagctacccttcagttactacagccttccatactgtcgtcccagagatggggttaagaagagtgctgaaaacttaggcgagcttctgatgggtgatcaaatagataattctccgtaccgtttccgtgtaaatgtcaacgaatctctgtatctgtgtactacaaccccacttgacgaggctaatgtgaagctcctcaagcagcgtagccatgatctataccaggtgaacatgattcttgacaatcttcctgtgaggaggttcacagagcagaatggaataaccatccagtggacaagctatccagttggttatattccagaaggcacttctgatgtctacatcatcaatca

SEQ ID NO: 55432 - DNA, 160 bp, Zea mays
  unsure at all n locations
  Clone ID: LIB3068-056-Q1-K1-B2
gcccgccacgcgtacagagacacctngagcacagatggcctgcttcctgtggtgcgtgtaatttttatgggcagttttgccgtgcaggacagacgaccatttcacgtctgcatggccaacccgttctgtatatgaaaagaaacaggtgctaggttttctt

SEQ ID NO: 55433 - DNA, 459 bp, Zea mays
  unsure at all n locations
  Clone ID: LIB3068-055-Q1-K1-F2
ccaatcccccacgtactatactacggtctacgtacgttattaaccccacctccccactcgcgtcgctcctcgtcgctagcaaagcaacacccgaaggcctgcgggcgcgcggcgtgcggccaggccaccgcgccatgggcaacgctctggcgggcaggcggcgcgcggccaaggtgatgacagtggacggcgccacgttccgctacaagacccccgcggcggcgtgcgcggcgctgcgcggccacccgggccaccagctcctggagtcggaggaggtgcggcggctgggcgtgcgcgcgcgcccgctggaccgcgacgcgccgctcaagcccgggaagctctacttcctggtgcagatcccccgcggcggcngcggcgacgacgacccgcgcgcgccgcgcaagacgtggtcgggcgcgctgcgcgtgggcgcccgcgagcgcctggagggcctgatgc

SEQ ID NO: 55434 - DNA, 62 bp, Zea mays
  unsure at all n locations
  Clone ID: LIB3068-056-Q1-K1-B3
aaaaaaaaaaaaannnnnaaaaaaaggtttggataaaaaaaaaaaaaaaaaaaaaaaaggag

SEQ ID NO: 55435 - DNA, 420 bp, Zea mays
  unsure at all n locations
  Clone ID: LIB3068-056-Q1-K1-B5
cccacgcgtccggagccttcgccgatccgcgagcgcagatcgccganaccaggcggcggagagggagctcgaggcggcggangaaggcgttcgccacagtcgctgatttccctggggaagagatgggtctctcctttgggaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttatttttgttgtagacagcaacgacagggaacgtg

SEQ ID NO: 55436 - DNA, 363 bp, Zea mays
  Clone ID: LIB3068-055-Q1-K1-D12
cacgagagagacgaatcttccgaatctctcggtggcgatggcgctctccgaccgctcccgcgggtcgctcctcccgagcttcctctacggctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctgg

SEQ ID NO: 55437 - DNA, 465 bp, Zea mays
  Clone ID: LIB3068-055-Q1-K1-D5
cccacgcgtccgtaaagaactgattaagtacaaaggttttcagattgcacctgccgagctggaagggctacttctgtctcatccagaaattctggatgctgttgttatcccgttccccgatgctgaagctggtgaagttcctattgcttacgtcgtaaggtcctctgagagttctttgactgaagttgatgtccagaaatttattgaaaagcaggtcgcatactacaaaaaattgaggagggtgacctttgtggacagcgtaccaaaatctgcttcagggaagatcttgagaagagaactcatctctaaagtcagatcatccaagctatagcaagccggcttctgtgttcagaagctagaacgacttccaatttgaaaatttgtcagattgagcgtaaaggtttacatgttactgagcggagcttatcaagcaatacattcagcttgacacaatttgggggacat

SEQ ID NO: 55438 - DNA, 427 bp, Zea mays
  unsure at all n locations
  Clone ID: LIB3068-055-Q1-K1-D7
agaaattaaactatctcctacgcaagatcagaagaaactgtgtatggagcaagaagaggggggcctcgccctgggcctctccctcggctgcggccaccaccagcaggagctcaagccgcaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggtacttgtctactcagtggcgtcgtcggcggtggttactgccgacgacgacgaagggtgcaacagcagccggaagaagctgangctgtccaaggagcagtcggcgctgctggaggaccacttcaaggagcacagcaccctcaaccct

SEQ ID NO: 55439 - DNA, 402 bp, Zea mays
  Clone ID: LIB3068-055-Q1-K1-D8
aaaaaaaaaaaaaaaaaataaaaaaaaaataaaaaaaaaaaaaaaaaaaaaaaaaagaaatgaaaaaaaaaaataaaaaaaaaaaaaaaaataaaaaaataaaaaaaaaaaaaaaaaataaaaataaaaaaaaaaaaaaaaaaaaaaaatattatggccccctctttttagttccccaattttatttccctttcttttcatttttttcttttttttttatttcctctttatttaatttcctttccctttttttaaaaactttttctttgtaaaacccttttttttctcaatttaattcctcttttaatatatctctttttccccatttctttaattacttaaataccccccatctattcccttttccaaaatttttccatccttaattccttttttttcccc

SEQ ID NO: 55440 - DNA, 407 bp, Zea mays
  Clone ID: LIB3068-055-Q1-K1-D9
cggacgcgtgggcggacgcgtgggccgcagcgcacagcgtgcccggcgccctggcgtgcagtgcccacgcgcttggccccagccgggcccccgccccagccccatggtcgctcctcacggcctacgagctcgcccctggccacaggcagcagggcgcccgcgcatagcccaagcagcccttgctgaccgtcccctccagcgcgtggtgctcctgccagccggcgggcgtagcaagcccccgtccctccgagcgtgaagatcatgccgaactagccccggcagtccccatggcaacctatgttcctgtgttcgtgggcatatgcagagaggaggaataaatgccacgctcgatcccacctctttccaaatctccgtggctaaattttgtgtggcctagtgtgtgactt

SEQ ID NO: 55441 - DNA, 64 bp, Zea mays
  Clone ID: LIB3068-055-Q1-K1-E1
catacaaaaaactaaactatcataatcacaatagcattaaaaaacagataaacaaacaagaaga

SEQ ID NO: 55442 - DNA, 368 bp, Zea mays
  Clone ID: LIB3068-055-Q1-K1-E10
attggtggacctcacggcgatgctggcctcactggccgcaagatcatcattgacacctacgggggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgcta

SEQ ID NO: 55443 - DNA, 448 bp, Zea mays
  unsure at all n locations
  Clone ID: LIB3068-055-Q1-K1-E12
cgagggcgaaacccacaaaccctctccctcctgtactccggccgacacatccaggggcgatgaggctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatactgtacatgagggtcgcatctaccagctgaagttgttttgtgacaaagactatccggagaagccaccatctgtcagattccactcaagaatcaacatgacatgcgttaatcacgagacaggaatggttgatccaaaggaaagttggtttgctagcgaactggcagcgggactacacgatggagaacatnnctacccagctcaagaaag

SEQ ID NO: 55444 - DNA, 439 bp, Zea mays
  unsure at all n locations
  Clone ID: LIB3068-055-Q1-K1-E2
gcgccaacgagctcagcgacggctactccaagggcaccggcctcgccgccgagatcatcggcacggttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgncgcctaccaccagtacgtgctgagagccagcgccaccaagctcgggtcctaccggagcaacgcctaataagtccggcgccgggagctgtgggcgccaccgatcgatccaagtgtagata

SEQ ID NO: 55445 - DNA, 405 bp, Zea mays
  Clone ID: LIB3068-055-Q1-K1-E3
cccacgcgtccgcccgccaacaagcgctgcatcaactgcaataatttgggaccacaatatgtctgcacaaatttctggacctttgtttgtaccaattgcagtggatcacatcgggagtttacacatcgagtaaaatctgtttccatggccaaatttaccgcacaagaagttgctgcccttcaagaaggggggaatgagcgtgctagagaagtatttttcaaggaatgggatcctcaacgaaatggataccctgacagcagtaacgctgacaaattgagaaatttcattaagcatgtgtatgtggaacgtagatacacaggagaaaggagtactgataggccaccaagggcaaaggatgacaaggatgagtatagtgaaaatagaagatctgatggaaaatggggt

SEQ ID NO: 55446 - DNA, 97 bp, Zea mays
  Clone ID: LIB3068-055-Q1-K1-E4
cccacgcgtccggaacaaatttgatagcacctgatgttgccttagacgactaaatcaatgaggtgacaccagtaactatcatgtcttaatcaaaaca

SEQ ID NO: 55447 - DNA, 404 bp, Zea mays
  Clone ID: LIB3068-055-Q1-K1-E5
cggacgcgtggggccttctctgactccggaagcaatggattttgtcaagcgattgctgtgcaaggatccgcgtagaaggattactgcagctcaggctttaagtcatccatggatcagaaattataatgacattaagctgccgttggacattcttatattccgacttatcaaagcttatattcgctcctcatctttacggaaagctgctctgagggctctgtcaaagaccttaaccgtagacgagcttttctacctgaaatcacagttttctctattggaaccagacaggaatggatgcatcactcttgacaatatcagaatggccttaacgagagaagctactgatgcaatgaaagaatcgcgagttcaagatattcttgtttcgttgagcgcccttcaataca

SEQ ID NO: 55448 - DNA, 374 bp, Zea mays
  Clone ID: LIB3068-055-Q1-K1-E7
ggcgattgaagcagaaaaaatcagtcgccgtagcagcgccgcctccgccgccgtggggaggtagcatctaggcccattccgccgcctccatctccggccagcaatggcttcggcggtggagcggcggagggaggagcacgcgcggagatcgcgttccccagcacggggcagggagcggaggggaacgccgccacgcaggcggagttccccagagcggatgaagggttcgcctgctagggcacggtctcctgctgcgaagtcaagtgcgtcgcatagggacagggagaggtcgccttcgagggagaaggtgaatgagcgtgtcaggtcgccagagtctcctgctaaggtcagcctgttgcacaaggtgagagaga

SEQ ID NO: 55449 - DNA, 476 bp, Zea mays
  Clone ID: LIB3068-055-Q1-K1-E8
gatcctcagccgcctgcatgtccgcgtcacccgccgatcccccgcctccgccgccgtccgggatgcggcaacgcgcgccttggcctccgcgggcctcttccgtggcctccacggcggcgcggcgggggacggcgcctcctccgagcacggccgcgaacccacaggtcctcttacgctctacaggaagctagtgagccaagggaagctcacgcatgatagttaccaggaaaatgtagcttccgaattagacaaccttcttagtaggcttcaacggtacgagatggaaatggaggattatcatgacaagctgtacttctgggagaatagcagggagaaagagcggcgcaggcttcttgtcgaagaagctgaagataagcagcgtggtggtgtatggattgatgagagaaggggatttcttgacaaattggttgcgcggagaagaagaggaagcatagaacctggagttggtaagtggg

SEQ ID NO: 55450 - DNA, 436 bp, Zea mays
  Clone ID: LIB3068-055-Q1-K1-E9
gcggtcgtcaccagcagggtgtcccggccctctctagtttctaccccggcccccaacattggccgggtgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgtgggagagaagatggtaatggagtgcgtgtgtatgtatgtgtatgcccagggcgcgcgcgcgcggctctgggcgagtcacagtagagatgcaatatcatgtatccagtatctttcttacaacacaaacagtgaagaaataataagtaaagtgtgcattgtgggtgc

SEQ ID NO: 55451 - DNA, 286 bp, Zea mays
  Clone ID: LIB3068-055-Q1-K1-F10
cccacgcgtccgaaaaaaaaaaaaaaaaaaaaaaaaaaaaaaaaaaaaaaaagggcggacaggggggaggatctaaactatacctaggtcaccttcccacgcattcgatgttatatatcgtcacttaagttcactaaattgaatcgactgtccacaacttttacaactgggaaaactcgtaaaaccactgaacttacatcaactttaaacgacatgcagcattatcccagtttgcgcagatagcgaagatagccaaaagggatcgcaccttatcaacatttgcaac

SEQ ID NO: 55452 - DNA, 457 bp, Zea mays
  Clone ID: LIB3068-055-Q1-K1-D11
cccacgcgtccgcccacgcgtccgggaggagcgaaacctcctgtctgttgcatacaagaacgtgattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaagcttgccaggacattgctctggctgagcttgctccaactcaccctattaggcttggactggcacttaacttctcagtggtctactatgag

SEQ ID NO: 55453 - DNA, 469 bp, Zea mays
  Clone ID: LIB3068-055-Q1-K1-A12
cggacgcgtgggcttgattcacagatcgatgtgctcaaggccagcccaaaaccactccctatggaaccccatttcaactccagctcaaaggacgacgactcctccagccttgagaccatcgtgaagtgcaaggaagctgaggcgaaactgttccagaaactggccgatgatgccaggaaggaggtacacagctaccggcagatcgtccgcaccaagacccagaaactagacgaggagtacgccacgaaggtggcaaagctgtgcttccaggagacggacgagaagaggaggaagaaagctgaagagcttaaaacccttgagaacctccactacgactaccacaagatgaaactgcggatgcagaccgaaatccaaggcttgctcgaaccgattgaaaccacaaagaagatgtgggtataggctccctgtaacaatttcatgttgctgctgcttaatgcttccggtatag

SEQ ID NO: 55454 - DNA, 69 bp, Zea mays
  Clone ID: LIB3068-055-Q1-K1-A4
aaaaaaaaaaaaaaaaaaaaaaaaaaaagaaaaaaaaaaaaaaataaaaaaaaaaaaaaaagggaggat

SEQ ID NO: 55455 - DNA, 424 bp, Zea mays
  unsure at all n locations
  Clone ID: LIB3068-055-Q1-K1-A5
ctcaaaactgcacatcttgactgaacaagcctgaaacatgatttatttgtagttgggattgctgcatttcagacttttgtttcttatgtacaccacatttatgtttttgtcaaaaaatagtcctggtcttgtcctattgaaatataaatctctgatacaactggtcatgaaagtgtttatatcacctttatctgcacgatcaggttggcgcctatgcggtttatatgtggaggcatagaagattttttgggaattctagggagagtttagaacatattgtgcgtgtggttgtcctgaatatggtactgctccactntttttctgcttattttattttgccttcgtttcaaaaactttctttgttctatctgcaacattttctttttcatagggtatgggcctcctttcagggggattgataact

SEQ ID NO: 55456 - DNA, 379 bp, Zea mays
  Clone ID: LIB3068-055-Q1-K1-A6
cttgagattcagcatggaggtgacactgcatcagcctatgcaaggccacaataccggagggaaagcactgcacctacagtgcacattctcaacacaagcaaccagcaaccatcgccaagcttatttgctccaggaaaccctggtctgacacaatccaagaattccatggtcttttcaaacgcattatccagccccatccggcggagcctgcagccttaccacctagaacaggacggagacacatggtactttgtgaacggcgcaagccgcgacatgaaccccacggcttcgaacgattcatccatggacatgcactcggacagcccagttcatgactcctactgagcagcttccttcacggaaccagaagaacagcatt

SEQ ID NO: 55457 - DNA, 462 bp, Zea mays
  Clone ID: LIB3068-055-Q1-K1-A8
cccacgcgtccgattgctgacaagaacaacaagtgggcatcatatgctggacctggtggggggaatgacccagatatgctggaagtaggcaatggtggcatgagcttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcgtcttgttgttgctctgtggaaccgttgttcagatactgctaacgttacaatgaaactgccagcagtaggccttgatgggtatgctggctattctggtagggatctgtggaagcatgaaactctatcggaaaat

SEQ ID NO: 55458 - DNA, 476 bp, Zea mays
  Clone ID: LIB3068-055-Q1-K1-B10
cggacgcgtggggttgtgagaattcttaattcatgagttgtagggagggacttatgtcaccacgaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaagacgatgctatcacatcgaacccgttcctggggacccaaatcaatataatctgtatgtagcttatccattagacctatttgaagagggttctggtactaacatggttactttcatatggggtaacgtatttggtttcaaagccttacgcgctctacgtttggaggatctacgaattccc

SEQ ID NO: 55459 - DNA, 184 bp, Zea mays
  Clone ID: LIB3068-055-Q1-K1-B5
cccacgcgtccgcccacgcgtccgtaagcatataaataagcgaagaagaagaaattggtgggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaataaa

SEQ ID NO: 55460 - DNA, 448 bp, Zea mays
  Clone ID: LIB3068-055-Q1-K1-B6
ctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgtgttcgagcccaacgccagctgcgccaccatgaaggagggccgcgccgaggcgtccacggccatgttcgcggcgctggacgagctgttcgacaagtgccgcgtccggcccaaggacgtgggcgtgctggtggtcaactgcagcctcttcaacccgacgccctccctgtccgccatgatcgtcaaccactacaagatgcgcggcaacatcctgagctacaacctggggggcatgggctgcagcgcgggcgtcatcgccatcgatctggcccgggacatgc

SEQ ID NO: 55461 - DNA, 328 bp, Zea mays
  Clone ID: LIB3068-055-Q1-K1-B7
agcttttccaagaaacctagctagctagctagtaagaggcacaggccggcaccatgtctgaccaccattcccaccacaattctcattctcacaaccgtacccaccaccactctcactctcactccggaggaggtggaggcggcggcggcggtggcgccggcggtggaggcggaggcggagtggctaaatgccactgtgattgctcacaccatgatcattcaccaccaaggcaaccgttcttcccgtcaccgcagcttccaccaccacaaatctttcttcctgcaagaccaccgctccctccgtctgggccggtcccattttcgtcacc

SEQ ID NO: 55462 - DNA, 325 bp, Zea mays
  Clone ID: LIB3068-055-Q1-K1-C12
cccacgcgtccgtaaaagatgggtgcctcctactggtaaaggttccctatatatcaggccactgctaatatgaagcggtgcagttcttggtcttgcgcctgctcctgagtatagctttatcatttttgtatcccctgttgggaattatttcaaggaaggtttatctcctattaatttgatcgttgaggataaatttcaccgtgccagccctggtggaactggaggtgtgaaaaccattggaaactatgcctcggtactgaaagcacaaaagattgcataggggaaaggatattctgatgtcctttaattggatgctgttcatgac

SEQ ID NO: 55463 - DNA, 370 bp, Zea mays
  Clone ID: LIB3068-055-Q1-K1-C2
gccacgcgtccgcccacgcgtccgtccacgcgtccgaccacgcgtgcgcgcaccggccgggtgcggaacagctcctgctggtgcggcgatcggctcggagcgtggaccgttgtcgcccgcgccggcggccaaagcccgggggccctagtggcccccggcagccgtcgtcggcgcggacggcatccgcgcgcctctggcgcgcccctcggggcgctgtgccgcaacggtctgcgagctccccatccgacccgtcttgaaacacggaccaaggagtgtgacgtgcgtgctagtcgacgggttcagaaacctgagaagcgcaaggaagctgacgagcgggaggcccttacgggccgcaccggtggccgaccct

SEQ ID NO: 55464 - DNA, 379 bp, Zea mays
  Clone ID: LIB3068-055-Q1-K1-C3
cgccctcgccttcgactacctgcgcgccatgggttacagcaacgtggaggtcgtgtcggcgatggtcttcgaggcgttcccgctgctcagatacatcctctacacgccttcgtacctgagcctgcaccaccgcgagcggtgtcgcaacttctgcctgttcatgccggcgctggacctggcgggcgggacgctggacgagcgggcgtgggcgctgcagcgcgcggcgtacgacggggggccgggcggcggcgcgctggggacgccggagttcgtgttcctggcgcacgtggtggacatgatgtcgtcgatgcacgtgccggtcgcgctccggtcgctcagctccaccccgttcgccaaccacttcattctggttccggtc

SEQ ID NO: 55465 - DNA, 134 bp, Zea mays
  Clone ID: LIB3068-055-Q1-K1-C5
cccacgcgtccgcccacgcgtccgcggacgcgtgggttttttcttttagtttttgggtggggttttttttttttttggttttttttttttttttcccatgcctgcctctaccctttcgcccacccctccggcaa

SEQ ID NO: 55466 - DNA, 212 bp, Zea mays
  Clone ID: LIB3068-055-Q1-K1-C6
caacgtccaaaatccagaccgctggtaggagtatctcgtatacattgatcaacgggggcggggcgagcgcctgcgccacctccatccccctcgtctcggcgccttctgcatgcccttccaagaagaccaccgtcgccaggttcctgtgctctacggcgacttgcatggccatcagcggcggtggctgtggccgttgctgcgaaaatgatggc

SEQ ID NO: 55467 - DNA, 248 bp, Zea mays
  Clone ID: LIB3068-055-Q1-K1-C7
cggagccaaacacaaaggagggtaggaatagctgtggtgactcggaagagaaagagacaggggacgccttgttttgtggatgcttagtgtggtgacctggtggtggtggtggtgggtgttcttggcacaagttacatgctggggatagctataggaggtacctgttgaggtgtgtaagacagtagctagcaaccgtatgcctaggtttcctgtttggatgcgtgacatgccgactttctagctgcttc

SEQ ID NO: 55468 - DNA, 361 bp, Zea mays
  Clone ID: LIB3068-055-Q1-K1-C9
cggacgcgtgggcggacgcgtgggctctggagcatttaggtggtctggatcaatggaagggttgtgtgctagccagccggcaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 55469 - DNA, 431 bp, Zea mays
  Clone ID: LIB3068-055-Q1-K1-A10
gcctttttgggttgtatccgaagacatggaaagggatgtttttatgtcagcagacgaagccagagcttatggacttgtcgatattgtaggggatgaaatgattgacgagcactgcgatactgatccagtgtggtttccagaaatgtttaaggattggtagtgggtggatttcttgtaaatttatctcaaacctaaattcgggttttatgctatagaaaatagaaatacttcatgatgatgaatcatcaggttaagatcgatctaaaccaatccattttatatatacatacgacatgccaacggttaaacaacttattagaaatgccagaacagccattcgaaatgctagaaaatcggccgcgcttaagggatgtcctcagcgtcgaagaacatgtgctaaggtgtatactatcaaccccaaaaaacccaac

SEQ ID NO: 55470 - DNA, 62 bp, Zea mays
  Clone ID: LIB3068-055-Q1-K1-D10
aaaaaaaaaaaaaaaaaaaaaaaaaaaaaaaaatcaaacaaaataaaaaaaaacaaacttac

SEQ ID NO: 55471 - DNA, 438 bp, Zea mays
  Clone ID: LIB3068-023-Q1-K1-B12
gcaatctgcacaggataatgcacaagacggaactagtccatccactacgtgtttgaggaaaagagagttcatccactacggttctggaagaccctgttgagaacaccctgcacggtgccgcccatgcctgctcccacggcttcagcgaggtatgcggcctcttggaaggttttctgaagatcaagagcatcctttattctgcggttcacaaacgtccaagtatcacggaactctggagaattgtctgtcaacatatacacctctgaggttgagtagataccaccaagcactgtacgtttcacataccaatcaatatctgacccagaatctccagcagcatgccatatctcatccaccaggatagctcgctgcttcaagcttgttgagacgtttgctggttgagactgaatactcagtgcctagttctagatcgcgagc

SEQ ID NO: 55472 - DNA, 376 bp, Zea mays
  Clone ID: LIB3068-023-Q1-K1-B2
ggggccgtacccagctactcggtgactggaatatatgatgccttggagtttaagaatggaggatctgattatcttggcacgggtgtccttaaggctgtcagcaatgtaaataacattattgcaccatcaattgttgaaaaggaccccactgatcaggttgagattgacaacttcatggaccatcagcttgatggaacctccaatgattagggctggtgcaaacagaatcttgtagcatatgccatccttgccgtttcacttgctgtgtgcaaagcttgagctatggtgaagaatattcctctttaccagcacatctcatatcttgctgggaacaaaactctggtgcttcctgtacctgcctttaatgtcattaatg

SEQ ID NO: 55473 - DNA, 433 bp, Zea mays
  Clone ID: LIB3068-023-Q1-K1-B6
cccacgcgtccggacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttg

SEQ ID NO: 55474 - DNA, 430 bp, Zea mays
  Clone ID: LIB3068-023-Q1-K1-B7
ggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgc

SEQ ID NO: 55475 - DNA, 122 bp, Zea mays
  Clone ID: LIB3068-023-Q1-K1-B8
caaagcgtaagatagaaatgccggcttcgattcactaacaaggaggcagggaggaaagacctaaaagatcctctccacttgaagttgtaccaaatggtatatgatatcgcctttccctttcc

SEQ ID NO: 55476 - DNA, 422 bp, Zea mays
  unsure at all n locations
  Clone ID: LIB3068-023-Q1-K1-B9
atcgcgagcggcgccagctcgattgggctcggggaggagtggaggagatggccggggctggtgtggatgaaacggagctcgggcaggcgaggggtgaggggacggctcggatacagtggcggggtggtcgctgaggccggtgcgagcattaatggcgaggtgacggggcgtgaggcggtgaacgcgcaggtgatggcatgggcgggacgaaggtcctgacaggcgggcctgggctgccagtgggagagcggcgcgagagggagagaggtggagccgctgaacggtggggccggtttgtcaggtgcggcgcgggcgcgcgcagctgggccgcttgggtcgggggaggagagggggaaagagcatgcgcgacgcggcttgggctaaaatcggcccatccganggggggagggttttttcttttt

SEQ ID NO: 55477 - DNA, 419 bp, Zea mays
  Clone ID: LIB3068-023-Q1-K1-C11
atcagtttgaaagtctctggctctacatctgtctatcagttgaaactgatgatatgggaatctttagggattgttaaggagaaccaaatgcttcacaaaggctctgttgagattgaagatgattttgctactcttgctgataagagtatttttcctggggattttctctgggtcagagactctgaaatatatgagaaccgtgacattgcagatgagatttcagaacaaaaggatgatatgctacaggctgaggaaagctttcgaggaactctgttgacatcaactgtctcagctcagctttgtcaggatatagcttttaatgaatgagttcccacatcagatatgtagctgcatatctgctgacttaagctggtgaagcctgcttggaagtgatgctgactagcttattctttggtttt

SEQ ID NO: 55478 - DNA, 437 bp, Zea mays
  Clone ID: LIB3068-023-Q1-K1-C12
cccacgcgtccgcccacgcgtccggaccagcccacggtcagtagccatcggccactaccagcctcgggcgctggctgtggcctgtgggctgggcggggcccctttaaatgccggccatacgcgcggcctaaagcctccagagccacgctgcttcccggccgaagcctccgtccgcgcccacggtttccattccatcccccaggcttgcgccgactcgccacttgcaccgccggccggtttcgccgaacgcctcgcgcccacccgcgcgcggagacctgcatataagccggccgcgtgtcgtccggcgctcccgggacaggcgatccgttcgtcatccgctgcaaaccaccaggcaccagctccgcgcgcagaggccggaggactacgaccgacgagggcgacgaacaccaaggctccgaagtccgaggaggcaggaa

SEQ ID NO: 55479 - DNA, 401 bp, Zea mays
  Clone ID: LIB3068-023-Q1-K1-C2
ccgggtggacgctgtacgtgcaggtgatggagccggacacggaggagcagtacgactgcgacccgctggacgacaccaagacgtggccggaggacctgctgccgctccgccccgtggggaggctggtgctggaccggaacgtggacaacttcttcaacgagaacgagcagctggcgttcggcccggggctggtggtgccagggatctactactcggacgacaagatgctgcagtgccgggtgttcgcctacgccgacacgcagcgctacaggctggggcccaactacctgatgctgcccgtcaacgcgccgcgctgcgcgcaccacaacaaccactacgacggcgccatgaacttcatgcaccgcgacgaggaggtggactactacccgtccaggcacgcg

SEQ ID NO: 55480 - DNA, 354 bp, Zea mays
  Clone ID: LIB3068-023-Q1-K1-C3
cccacgcgtccgaaaaaaaaaaaaaaaaaaaaaaaaaaaaaaaaaaaaaaaaaaaaaaaggaaaaggaaaaaaaaaaaaaaaaaaaaaaaaaaaaaaaaaaaaaaaaaaaaaaaaaaaaaggaaaaaaaataaaaaaaggggcgggtttatttaaagggtccaagctaaaataaagcttttttataaggtaatgtatttttaattgggtgccctaatttaaaaaaaggggcgactggtaaaaaccttgggtttgggaaaaaaattggtttacccaaattaaacgttttgaaagaaaatccctttttgaaaaggtgggtaaaaatcaaaatgcccaaaacttttgcactttgaaa

SEQ ID NO: 55481 - DNA, 436 bp, Zea mays
  Clone ID: LIB3068-023-Q1-K1-C4
aaaaaagaaaagaaaaaaaaacaaagataaagaagaaggaaaaataaaaaacaaaagagtgaagaggaacaagagaaaaaaaaaagaaagaaaaaagaaaaaaaagagcagaaaaataaaaaaaaaggaaaaaaaaaaaaaacaaaaaacaaaagaaaaaaataaaaaaaaaaataaaaaaaaaaaaaaaaggaaaagaaagaagtaaatagaaaaaaaaaagggaaagaaaggaaaaataaaaggaaagaaaagaaaaagaggaacaagaggaaaaaagaatgaaaaaaaggaacagtaaaagacaaagaataaaagaaaaaaaaccaaagcaaaaatgaaaaaaaaaaaccaaacaatttaaaggaatgaaaaaacgaatgaccaaaaaaaggaaaattgagaaaaaaaaaaacgaaggaaaaacgaatgaaaa

SEQ ID NO: 55482 - DNA, 405 bp, Zea mays
  Clone ID: LIB3068-023-Q1-K1-C5
cccacgcgtccgcccacgcgtccgcccacgcgtccgaaaaaaaaaaaaaaaaaaaaagaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaggggcataaaattaaaatgaacgaaagaaaaaaaaaaaaaagtaacaaaggaatgaaacaaaaaagaaagacaaaaacacaaatgtaaacaacacttaatgccgaaaaaacagatggaaaaaccccaatgatgaccagggtgaaaaaacgccctaaatcaagagggatctaaacaagtgcgtatcctaaaaggggattttcaaaatacttgtctaaagaattgggaaaatg

SEQ ID NO: 55483 - DNA, 420 bp, Zea mays
  Clone ID: LIB3068-023-Q1-K1-C6
cccacgcgtccgatctccttcagcatcgatccgcccgcccctccctccaccagcagcagcaatccgtttttcaccgtgcctttccactcaccaccagccgccggcccccaggccacaggcccaagccaagccgcgcggcgtcactcccaaaccctagctcgcccgcagtcgccggtgatgtcgtccccttcgtcgtcccctgcgcggaggcgggagatgggggagggcggcgagctccccgtccccgtgcccgtgcccgcctccgtcgtcggcgacgacaaggtcctggcggcggcgcagcacatcgtcaagtcgctcgccacgtccaagaacgccgccgacgacatgatccgcatcctctccggattcgaccaccgcctctcctccatcacctccgacctcttcccgtccccgtccccc

SEQ ID NO: 55484 - DNA, 96 bp, Zea mays
  Clone ID: LIB3068-023-Q1-K1-C7
cccactcgtccaatctcctttatcatttttcctcccgcccttccctccaccagcatcggtaattctctttttcaccgtgcctttccactcaccacc

SEQ ID NO: 55485 - DNA, 457 bp, Zea mays
  Clone ID: LIB3068-023-Q1-K1-C9
aattccggcttggctgctgccctgtctgcaagtacctcgtcttcttcctggagagaaaaagcagaagacaatacaaagatgtccaaggtggcggacgagaaggcggcggcagtgggcggactcggaggagccggggcggctgacgcggcgcagcagcagcagctggcagcaggggaggccgctgcggcgcgggtgcggtccgtggagacgctgcttcgcgcggcaccgctggggctctgcgtggccgccatgaccgtcatgctccgtaaccagcatagcaacgagtacggcgccgtcgactacttcgacctgggaggcttcaagtaccttgtctacgccaacggtctctgcgctgactactcgctggtatccgcgttctacactgacgtgccgaggcctgccaccgtgttgcgctactggctcgtcttacttctcgaccaagtgttcacgtacctga

SEQ ID NO: 55486 - DNA, 407 bp, Zea mays
  Clone ID: LIB3068-023-Q1-K1-D1
aaaaaaaaaaaaaaaaaaaaaaaaaaataaaaaaaaaaaaaaaaaaaaaaaaaaaaaagggaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaggggtaaatcttttaagaatggaaaaatattgtaatgatacaaaaaaattaaaattttattaaattgggcttaaaataaataaatttagagccaatattaaaaaaaccgtactgggtaaaaaaacagggtgtcaaaaaaaaaaagggattggaaaaaaaactttttttgaaaattaagcgaaaaagaaaaaaaggttactcgaagcgtttttgaaaaaattggcaacactctaaaggcaaatgaataccctttt

SEQ ID NO: 55487 - DNA, 381 bp, Zea mays
  Clone ID: LIB3068-023-Q1-K1-B11
cccacgcgtccgcccacgcgtccggggttggcttctcctccccctccggttcgggttcgggttcgtgaggttctccggggttcggtttcgtgggtgagcggatcgagatggcggcgtcagatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggctaggagctggacggacgcaacatcaccgtcaacgaggcccagtcccgcggcggccgtggag

SEQ ID NO: 55488 - DNA, 452 bp, Zea mays
  Clone ID: LIB3068-022-Q1-K1-G2
gtgtaaataaaggcttgaataaggactattttttaagttcagtggccaaattgacatggcggtatggcctccatagctcataagcagcatttacccctcttaggaattaggataagacatgtaatgcctacattattgtcttggttcatattgcataaccattggagcaatgaaagcctcacccatttttggattgtctagattggtttgacgctgaagaagctatttgaagagggtgtagtgaagcgacgagatctgtttatcacctctaagttgtggtgtgctcaaatctctggtgatattccaatatttatgtctcatgcatctcattttggaaaaactcatacgaaaagcagatttcaagtggaatttggtcttcagtgtatatacacctacaatttggtatttctatgtgatttttttgtttgagtctgaacatcaataatttatgg

SEQ ID NO: 55489 - DNA, 451 bp, Zea mays
  Clone ID: LIB3068-022-Q1-K1-G3
ttgtaaataaaggcttgaataaggactattttttaagttcagtggccaaattgacatggctgtatggcctccatagctcataagcagcatttacccctcttaggaattaggataagacatgtaatgcctacattattgtcttggttcatattgcataaccattggagcaatgaaagcctcacccatttttggattgtctagattggtttgacgctgaagaagctatttgaagagggtgtagtgaagcgacgagatctgtttatcacctctaagttgtggtgtgctcaaatctctggtgatattccaatatttatgtctcatgcatctcattttggaaaaactcatacgaaaagcagatttcaagtggaatttggtcttcagtgtatatacacctacaatttggtatttctatgtgatttttttgtttgagtctgaacatcaataatttatg

SEQ ID NO: 55490 - DNA, 223 bp, Zea mays
  Clone ID: LIB3068-022-Q1-K1-G4
ccacgcgtccgacgtcatcttcctcatcgtaaactcctgtggttcgcctgggacggagttgctgaagtgaaatggttcccttctcttcaatgctgaaaaaaggggaaaaaaaactatgtgaaaatgatggtagacgtgtctgggtcagtaataagagtttctaaaatctgaatgagatttgaatcgctctccgttgatgaatttctcatggtctgtgtattcc

SEQ ID NO: 55491 - DNA, 117 bp, Zea mays
  Clone ID: LIB3068-022-Q1-K1-G6
tcttcctaaaaaacataaaaaaaaaaaaaaataaaaaataaaaaaaaaaaataaacctacaaaagaaaggtaaaaattaaaacttacttgcacatcctttctaaactcccattctta

SEQ ID NO: 55492 - DNA, 376 bp, Zea mays
  Clone ID: LIB3068-022-Q1-K1-G9
gggaaagaagggtggcaagaaaaagaccgtcgaccctttctctaagaaggattggtatgacgatcaaggcaccgtcggtgttcagtgtgcgcaacatcgggaagactctcgtatccaggacacagggtaccaggattgcttctgagggtctgaagcacagagtctttgaggtttgcctagctgatcttcagggtgacgaggatcaagcttacaggaaaatcaggctccgtgctgaagatgtgcagggcaggaatgtgctcacaaacttttggggtatgaattttaccactgataaattgagatccctagtgaagaagtggcagacattaatcgaagcccatgttgatgtcaagacaaccgacaactacatgttgcg

SEQ ID NO: 55493 - DNA, 389 bp, Zea mays
  unsure at all n locations
  Clone ID: LIB3068-022-Q1-K1-H1
cggacgcgtgggtctcgccgccgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgccttcgccgtcgccttcctcttcgccgccgtccgccactgagccgatggggcctcgtgcctgcaggctacctagcagtacttccgccgctgctgccgncgtcgnctagatctatttaatggagtgctatccagtagtactagtagtagtgagatttcttcggtgctgtcgtgtcgtcgtcgcattt

SEQ ID NO: 55494 - DNA, 212 bp, Zea mays
  unsure at all n locations
  Clone ID: LIB3068-022-Q1-K1-H10
cgtaatgttatggtaaaacttcgtttaaaacgatgtggtagaaagcaacgtgcgacttgagaggacgtgatcgattgtggattgcctatccatcattntccatagtaatgaaaatgctcttggctcgacatagtctgttctattcgtcccgaaccgaattttcgctgggttgtttgtaagtaaagtaaatattacacgatggagctcgagag

SEQ ID NO: 55495 - DNA, 291 bp, Zea mays
  Clone ID: LIB3068-022-Q1-K1-H12
gaggagaagccctctagtggtactgggacctaatttgcttctttaacccatgattggaccgcttggtctgtagaaaaggaggatggaacctttgaaattccagaatcctgttgaaaggtcaaccccgaaaaaacctaccactgttgcaaaggagccaggtaaaactccgaagatgaagaagcttagaaacctcagatccagatatggacacagttcacaacatattctcgttgcccacacccaattcatccgaggctctgttacacactctatgtggaacaccacaggtgt

SEQ ID NO: 55496 - DNA, 199 bp, Zea mays
  Clone ID: LIB3068-022-Q1-K1-H2
acggaattcggttctacacatgatcactggtctccttgagctcaccttacaacacccgaggtacggtgcatcagatgtccctggacagtaaatctggctaaacgacaatgactgtcggccggatcggaaccacaagacataactcttgacccagaacgaggcgccgtgtcccgacttcctaacatcgacttatgccgac

SEQ ID NO: 55497 - DNA, 88 bp, Zea mays
  Clone ID: LIB3068-022-Q1-K1-H3
cccacgcgttcgactaaacaatatcactggtctacttgagctcaccttacaacacatgaggggcggtgcaacagatgcggctggacaa

SEQ ID NO: 55498 - DNA, 400 bp, Zea mays
  Clone ID: LIB3068-022-Q1-K1-H5
ctgatcgctcactcttgcagctcgatcattctttagctgctctagctctagcctctagccgtagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggttgaagaggtgaaggaggaagcg

SEQ ID NO: 55499 - DNA, 284 bp, Zea mays
  Clone ID: LIB3068-022-Q1-K1-H6
cccacgcgtccgagcaaaacagagctccagaaactgaccgattggtttcacaccggagtgggcgggatggcggggacgagcggccacagcgaacgagcagacgagcctctgaaggaggcgctgttggctgcccgcaacggtagcggcagcgacggcgactgcgagaaggacctggaggagatccggagcgtggggtcgttcctgcggcacgcggtggaggagaaccggaagctctggtaccttgcgggccccgccatcatcacgtccatcacgcagtactcgct

SEQ ID NO: 55500 - DNA, 273 bp, Zea mays
  Clone ID: LIB3068-022-Q1-K1-H8
tccacaacgtacgcttagaggaaggctgcaggtgctcctccgtaagccgagacgagggtatggcaccatccctgtgagtaccaacactactaatgcagctcgccatgctctatcagtaccgaccatggttgctaactagatctccgacttagagaaaaacactaataataccgcacatgctatcttttcaccactagattttcaaacgatcgccatcaccaatagcatgaatctcatgcacctgtccaactccgtcaaactactattcttcta

SEQ ID NO: 55501 - DNA, 294 bp, Zea mays
  Clone ID: LIB3068-023-Q1-K1-A11
cccacgcgtccgcccaggatctacagcttgatatatctgggagatgcatgcctgattacatattgccaactaccttagctaaggttcctaactgtatgccattgttgagaaaaatatctctgaagggaaattatcggctttctgataatggtttggtcacaatcatctcggctgcaccttctttatgttccataaatctgtgtgagtgttctcttctcacttaaaaaaaaaaaaaaaaaaaaaaaaaaaaaaaaacaaaaaaaaaaaaaaaaaaaaacaaaaaaaaaaaaaaca

SEQ ID NO: 55502 - DNA, 428 bp, Zea mays
  Clone ID: LIB3068-023-Q1-K1-A12
gattttagcttctatgatcgttctgctccaatttatacgcaacctagatatttgcctgcttcaaaggttcttgatgctgatgtgacagacagtgttattggagaagggtgtgttattaaacattgcacaatcaatcattccgtagttggactccgttcctgcatttctgaaggtgcagttatagaggactctttgctaatgggtgcagactattacgagactgagaatgataagaatgtcctttctgagactggtggcattcccattggtattgggaaaaattcacatatcagaaaagcaatcattgacaaaaatgctcgcattggagaaaatgtgaagataatcaattttgataatgtccaagaagcagtaagggagacagaaggatattttatcaaaagtggaattgtcacggtgattaaagatgc

SEQ ID NO: 55503 - DNA, 406 bp, Zea mays
  Clone ID: LIB3068-023-Q1-K1-A3
cccacgcgtccgcttaatccagtgcatctttgagccgccgccgccgtgaggagctccggccatccgtcgtcatccgtcaaatcagttgatacgaagacattagaggatataatcggcccttcaacttcaatgaagtctcatacacatccagtgaagcctcgctttcaagtcagcaatcggcctaaatgcaatttgctaaataaaagttctattgattctgagcaaactatccaatcttctatagcctccaagataacaactttgattgacccgcggcaccggtatgaccacaaccttcactgctactacgactgctggctccactccgaaagcaagcagcctttctcctactggccgcacttgaagaaatcttatatcagtttgaggaaaaactccaagctgaaag

SEQ ID NO: 55504 - DNA, 64 bp, Zea mays
  Clone ID: LIB3068-022-Q1-K1-G11
ggctgtctttgcttttgtaattgaaaaaaaaaaaccccgacttcggtagcaatacattttgttg

SEQ ID NO: 55505 - DNA, 359 bp, Zea mays
  Clone ID: LIB3068-023-Q1-K1-A5
acgcgttacgcgtcccctgacgcgtatgcagtaaattctctattctcaacactgctgaacaaatccggctatgggttatgtatatttgcaatttgtcttatgaagacattctaccatatgatctcgcctatgactttactgatttttgctccacttctagtgctgccttagtttctcacatgcatgttgactagatgccatttactaatatctaccgctactgattctgttcttactatgcaatcttctataagctaccttattacacttatgctagacccacgatacctgtatgaccacatcctttactgctactactacttttaccttgattttcgaaatcgcgcattctttcttct

SEQ ID NO: 55506 - DNA, 429 bp, Zea mays
  unsure at all n locations
  Clone ID: LIB3068-023-Q1-K1-A9
cccacgcgtccgggtggnggagaaaggtgatacactgaaggtgcgagctggattctaccgcaacttcctccttcccaagggcaaggctacacttctgaccccagaagtcctcaaggaaatgcagctggagcaggagagaatagaagctgagaaaaagcgggtaaaagaagacgctcaacaacttgctcgagtttttgaaaccattggcgctttcaaactccctcgcaaaggtggaaaaggaaaacagatctttgggagtgtcacggcacaggatgttgttgacataataaagtcacaacttaatagggatgtcgacaagaagctggtgacggttccagaaatccgtgaaatcggagagtatgttgcagagatcaagcttcacccagacgtgatagcgcgagtaaggcttgatgtctatgcgaaatgagc

SEQ ID NO: 55507 - DNA, 440 bp, Zea mays
  Clone ID: LIB3068-023-Q1-K1-B10
cccacgcgtccgcccacgcgtccgtgccgctgcacgagctgcccacccacgccacccgcggctactacctgggcatgttcctcgggggcgcctaccaggaggccctcggcgggctgcacaacctcttcggcgggccgagcgtggtgcgcgtgtcccagtgcgacgggccccactgcttcgccgtgacgcgcgccgccgcgggcccgtcctgcgccgacgtgctccgcgcgatgcagcacgagcccgaggtgatgtacgaggtgctgaagcagaggaccgacggcgccacggccgccgccctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatt

SEQ ID NO: 55508 - DNA, 410 bp, Zea mays
  Clone ID: LIB3068-022-Q1-K1-D12
tgagaatctgctacatagggcatttagtgtgttccttttcaactcaaaatatgagctgctacttcagcaaaggtccgcgacaaaggttacctttcctttagtttggaccaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctca

SEQ ID NO: 55509 - DNA, 346 bp, Zea mays
  unsure at all n locations
  Clone ID: LIB3068-022-Q1-K1-D5
ctgaaaccttggtgaagccgagacgagcaatcatccaagcagctagtgcttagcatctatggcgacctccgttcgtggtttcagtagcgccctcagggatgtgccgggcagctacggccttccgctggtgggcgccgtccgcgaccgcctcgacttctactacttccagggccaggacaagtacttcgagtcccgcgtcgagcgctacggctccaccgtggtgcgcatgaacgtcccgccgggccccttcatggcgcgcgacccgcgggtggtggcggtcctggacgccaagagctntcncgtcctcttcgacttggacaaggtggagaagagggacctgttcacg

SEQ ID NO: 55510 - DNA, 89 bp, Zea mays
  Clone ID: LIB3068-022-Q1-K1-D6
tcgaaaaaaaaaaaaaaaaaaaaaaaaaaaacaataaaacaaacaaataaaaaataaacagatatggcaacctaaaaaaaaaagaaaaa

SEQ ID NO: 55511 - DNA, 325 bp, Zea mays
  Clone ID: LIB3068-022-Q1-K1-D8
aaaaaacaaaaaaaaaaaaaaaaaaaaaaaataaaaaaaaaaaaaaaaaaaaaaaaagcaaagaaaaattttattaaacttcaaaaacatcataactaaaacaaaaacagaacaaaaacaacacgaaaaataaaaaacaacactacaggacctcctaaacaaaatccactaccaaggcccatgacaagaaaatcaaaaccaattgcaaagcgctaccgaatacaaaaatcaaaagcaagaacataaaaaaaaagcgccaccggaaacaccaaccaaaccaaaatccaaacccctaccccaaaaacccccttacccgaaccgccaa

SEQ ID NO: 55512 - DNA, 338 bp, Zea mays
  Clone ID: LIB3068-022-Q1-K1-D9
tcgcccacgcgtccgcccacgcgtccgcggacgcgtggggaccaaactgcgtgctcaggcctgcgggagaggagagggtagaggagttgggcgtgcagcaggatgagcggggaggaggccgacggctccaagccccagggaggcggcgtacactacggcaccttccaggggccgcccagctacccgcccccgcgcccgccgccgagcctctccgcccaccaccgcggcgactaccaggccgttcccgctcgagattccgaagcaggtgtgcggggacgtagccatgatcgacttccctgttgtggcattggttttggatggtccctgtttatagtcgg

SEQ ID NO: 55513 - DNA, 365 bp, Zea mays
  Clone ID: LIB3068-022-Q1-K1-E10
aaaaaaaaaaaaaaaaaaacaaaaaaaaaatttaattaaaaaaaaaaaaaaaaaaaaaaagagaagagaataaaaaaaaaaaaaaaaaaaggacacccaattttacaggaaaccgggctttctttcccttgcattcaacttcatacctcttctattgggtcactttttttcttttttttttccctctttttacaacttcttttctggcaaatccctggcgttccctatcttaatccctttgcttcccatccttgtttccctatttggccatttatcttaaaggcccgaaccaatctccctttttacccttttctcatgcttattggtaaattttaccccccctttttccgcccattaagctccct

SEQ ID NO: 55514 - DNA, 302 bp, Zea mays
  Clone ID: LIB3068-022-Q1-K1-E2
cggacgcgtgggccgccgcctgaaaccccagccgatcgacggtggcggagatgtcgttgtgctcggtgaatatcggcgaggaggtgtggctcacatgcctctcccacgccctcactaccgagaccgaggaggtcatggggctcctcctcggcgacgtcgagctttccagcaaggtcgccacagccctggtatggggggcgtcgccgcagatgaggtgcgagcggaagaaggaccgcgtcgaggtcaaccccgagcttctcgccgccgcatccgcgcaagccgagaaaatgacggccaccatc

SEQ ID NO: 55515 - DNA, 450 bp, Zea mays
  Clone ID: LIB3068-022-Q1-K1-E3
cccacgcgtccggcggaggggcgtcgtgtcctccccccgctcccggctccagcgccacatgcggctgccgaggatcagctgcagcgccaccgatgaggccagcggcgccgtggtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgagggggagttcaaggtgccggcgtcgttcgggcccgtgggcgctgtgctgctggagaacgagcaccacaaggagatcttcatcagggagatcaagctcgtcacgggcagcgaca

SEQ ID NO: 55516 - DNA, 341 bp, Zea mays
  Clone ID: LIB3068-022-Q1-K1-E5
tctcctctcttctctaaaaaaaaaaaaaaaaaaaaaaaaataaaattaaaaaaaaaaaaaaaaaaaaaaaaagaaaaggaaaaaaaaaaaaaaaaaaaaaaaaaaaaaaaaaaaaaataaaaaatcccaacgcttcctccaacccttccttttttaattccggtgcgcccgttttaacggctccatgtttacttacacttccttgcaacttcttattttttttttagggtcacttaattttatttccttgcccctttttttccaacttgctaactgggataccctttcctttccctagcttattcgctttgcagaatttccctttttctccagttgccctt

SEQ ID NO: 55517 - DNA, 300 bp, Zea mays
  Clone ID: LIB3068-022-Q1-K1-E7
gccgagcccaaccgcacaagcgcgcgaggcaggagagagagagaggcggggagcaaaacagtggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaag

SEQ ID NO: 55518 - DNA, 449 bp, Zea mays
  unsure at all n locations
  Clone ID: LIB3068-022-Q1-K1-F1
cgcattagcgcggccagagagagatgcgggtttgagttgggatacctcggaggcggcgacggcagggtcgcagtggtcagtagccgggtcggccggtggccgcagattctcaccagcagcgccatacctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgtctncaacaacgtcaccaactggcaa

SEQ ID NO: 55519 - DNA, 126 bp, Zea mays
  Clone ID: LIB3068-022-Q1-K1-F11
tcttacacttgtccggacacgtgctcttactttcctcaccagattcctcttctcgttaagcgctggttatatcacctcctttgcactttcaacctacttcccctcctattcaaactccccacctta

SEQ ID NO: 55520 - DNA, 434 bp, Zea mays
  Clone ID: LIB3068-022-Q1-K1-F12
cgcattagcgcggccagagagagatgcgggtgggagttgggatacctcggaggcggcgacgactggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttgccaggtgaactccgttgccttcaacaacg

SEQ ID NO: 55521 - DNA, 291 bp, Zea mays
  Clone ID: LIB3068-022-Q1-K1-F6
acatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacagcgtcgtttggaagtgtggatgcttcgagctacgacgcgcttgtggttcctggcggacgggctccagagtacctggctctgaacgataaggtcatcagcttggtgaaagccttcgcgg

SEQ ID NO: 55522 - DNA, 446 bp, Zea mays
  Clone ID: LIB3068-022-Q1-K1-D11
ggagaaccgagagcagagagacatggcgccccaccaccagcagcgggcgctgctcctgttgccactcgtcttcctcctcctcctccttgccccgcccctcgccggcgcgtggggaaaggagggccacatcatggtctgcaagatcgccgagaagtacctgtcggagaaggcggcggcggcggtgaaggcgttgctgccggagtcggcgggcggggagctgtcggcggtgtgcccgtgggcggaccaggtgcgctggcactaccactgggccagcccgctccactacgccaacaccccccaagtctgcaacttcaagttttctcgggactgccacaattctcgtggccagcaagggatgtgcgtcgtcggggctatcaacaactacacggaccagctctacagctacgggcagaagacttcgtataacctgaccgagagcctgatgt

SEQ ID NO: 55523 - DNA, 214 bp, Zea mays
  Clone ID: LIB3068-022-Q1-K1-F7
acatggccgattatgaggttacggtccgattacttgctttgcatgctcttgtctggcgtgcagatgctgtttacctcgacaaggtaactcgggaaacattaccaacaggcattcacgatttccaaggttaccagacctacagggagcaacctggcccagattttactctgacaacgtgcgtttgctattgcggacgctgtaagctacctcccgc

SEQ ID NO: 55524 - DNA, 184 bp, Zea mays
  Clone ID: LIB3068-022-Q1-K1-F8
atatggactattataaggacacgttttcattacaaactttccatactttattccggcatagacatgctattctccttagcaacctatactccttattacaaaccaacatccatcatacaatacctacatcaccagatttacacatatcaacttaccatcaaatcaaatataaccatatccattt

SEQ ID NO: 55525 - DNA, 293 bp, Zea mays
  Clone ID: LIB3068-022-Q1-K1-G1
acccactcgtacgcccaggctttcgtccactcattcaaactccttatcgtcgactgcgtcacctaccctaagacgtgctgtgctaacagccactgcggagggatcctctctatatgcaactactcttccatacacagtgtgctgtactgcaagacccacttctagcagctcttcaacgagacctttagcttcttcaagaacttcacgccatgtggcaagtcttcagacaatggtgaactgacaatggcccccagcaagctatcatctgcgtttcctagtactcatgataagtg

SEQ ID NO: 55526 - DNA, 431 bp, Zea mays
  unsure at all n locations
  Clone ID: LIB3068-022-Q1-K1-G10
cttggcgcatggatgggtactggcgaagtatgccctcgcaggatgccgtcattgggcgatcagttggtgcgaagtcctgccttcgccttggatctgcggggtcggaacccggccgcgtttgtgcgtgaagtggaggccgaggcctcaaggattgtagggcgatacgtgccgaagaagaaaaccttgcggagttgggatattcgcggttctaatgttcgtttgaaccgtgttttcgagttgaaccgtctgccatatggcggttacccgggagacgacgatgctggtgttgtcgaccgccggggaaaagggcggctgctgcggtcgacgagggcccttcgcggggagttgtgccggccgcgaccactaaaaagaggaaactaggtactgcagttgangggttgggggtctccgaccgttttgctgtcgatttg

SEQ ID NO: 55527 - DNA, 210 bp, Zea mays
  Clone ID: LIB3068-012-Q1-K1-E2
cggacgcgtgggcggacgcgtgggaaaaaaaaaaaaaaaaaaaaaaaaaaaaaaaaaaagaaagaattataaaaaaaaaaaagaaaaaaaaaaaaaaaaaaaaaaaaaaaaaaattaaaaaaaaaaaaaaaaaaaaaaaaaaaaaaaaaaaaaaaaaaaaaaaaaaaataaaaaaaatacatataaaaacaactaaaataaaaacaaaaa

SEQ ID NO: 55528 - DNA, 344 bp, Zea mays
  Clone ID: LIB3068-012-Q1-K1-E4
aaggctcgtcctcctacgcttccggcgtgtcgtaccaggacggagactatctttctgaggagggtttataaccatccactgattacatccaaagctcaagatgctaggagggctatgatctatgttcatgccacattgatgatagtgcactatgcttacatcatcattatgtccaccaacattaaccacaggtccatggacggagcctgtgactctcagatcaccatgtgctcgtaccagccgtaccacctgtcaactaggcaacctgcccgaggcctgatccaaggcttccagatgtcatattggttcgaacaccagcagatgctgcactacttattccaccg

SEQ ID NO: 55529 - DNA, 441 bp, Zea mays
  Clone ID: LIB3068-012-Q1-K1-E5
cccacgcgtccgggcgctggagctgctggggctgagggacaacggcgcggaggacgcggggccgccgtcatcctcctcctcatcttcgtcgtcgtcctcccctgaccatcaggagatcgacgtgagtctcatcatcactgactactgcatgcccggcatgacaggatacgatctgctcaagcgagtgacggggtcctcatcgctcaaggacattccggtggtgatcatgtcgtctgagaacgtgcctgcccggatcagcaggtgcttgcacgatggcgcggaggagttcttgctgcagcccgtgaagccggccgacatgaagaagctcacgtcacacctgctgaagcggaagcagcccaagcagaagaacaagcctcaggcgcatgcggtggagtctcctgagcagcagctggacccgcatccgcagccggtgcacgagcc

SEQ ID NO: 55530 - DNA, 453 bp, Zea mays
  Clone ID: LIB3068-012-Q1-K1-E6
aacatcttctcgaagaggggcatgaaggggaagtccgtcagtggcatgaattacgacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatgaagcgtatatcagtgattgtttcatcaatcattatcttccacactcctgtccgcgctgtcaatgcactgggagctgccattgccatccttggcacattcctgtactctcaggcaaaggtgtgaggcgggccatgatgacgaacgtctgcagaatcagtagcaagcactaaa

SEQ ID NO: 55531 - DNA, 346 bp, Zea mays
  Clone ID: LIB3068-012-Q1-K1-E8
ctctcgctttcacactactctgcgttcatttaccctcttatctaccataatgctgaggcggctttcttagaaacctcaccttactcttacctactttcttttataacacttctaactgattcaaacattcttttactatgcaacacatcactatgaacttattaatactactctcctcttcatacggaacttgactgcttcacttatttctcctttctaatctgtacatctacgtcgtacataatacctcatattttttttccacgatgactatatactaaattaactatctcttagatatccttcaatcattacatcacctgacactaacaatctacctatctac

SEQ ID NO: 55532 - DNA, 419 bp, Zea mays
  Clone ID: LIB3068-012-Q1-K1-E9
ctcgaggggagacacatctggtgcggaggttccctgttgttaccataaggctgaggctgctgtccgagaaaccgcagctcagttttgccaattttgatggggaacagtcctaattgattcaagcattctggtagttggcattgcagcatttggaacgtattaggaatatgctacagatcacaaggaacatgtctgcattacttggttcttggtttcaatatgtttgtctggggggtgcataatgtatcataatttgttttcacggtgtcaaaagactagcttagctgtccgctggatgtgctgcaatccgtgcatcacctgacactagcaatctgtttattctaccgaatggctcctggatatatagtcgttttctttagcttgacgtttgctttgtgggtactggtgggaaattcatc

SEQ ID NO: 55533 - DNA, 443 bp, Zea mays
  Clone ID: LIB3068-012-Q1-K1-F1
ggcacgaacgcgtacaacgagacgatcgagatgacggcgccggtgctgacgcgggtgtggccgagtgacgggcccttctgcgcctccgccttcgccgcgagcttgtacgtgccgggcaagaaccaggcggacccgccgccggccgatggcctgcgcgtggaccgctgggccggggccaggtacgcggtcgtgcgccgcttcggcggcttcgtggcggacgccgacgtcggtgagcaggcggcgcgtctcgaggccagcctccagggcacccggtgggccgccgacgtcaacgacgcgcgcagggccgacccggactagacctacaccgtcgcgcagtacaactcggccttcgagttcaccggcaaggtcaacgagatctggatgctcttcgacgccgacgacgcggacgacgacgccagtatgtgatgcgattgcaagcgtgc

SEQ ID NO: 55534 - DNA, 364 bp, Zea mays
  Clone ID: LIB3068-012-Q1-K1-F11
ctcacgcgtccggagttttgtaccacactagattaatggtctaggggcgctcatacgcaggacacttgccttatcttttaacagatgtgccgacacagccagacttggcacctgacaatgtctagcgcccggatcgggacaatgaggctggaccgttcaacgaaaatgagggtcgttacgacgcatcgagcgctgtctatactagcattgtcggcaggcgtcgcgacactggagtgacggtcggcatctgccactaagatgactatgttgacgatgaagctaaatccagactaggtatactgacactgaggtacccaattgagcactgaattcgtcaagaactgggatgacattgagaatatct

SEQ ID NO: 55535 - DNA, 384 bp, Zea mays
  Clone ID: LIB3068-012-Q1-K1-F12
cggacgcgtgggcggacgcgtgggaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctac

SEQ ID NO: 55536 - DNA, 343 bp, Zea mays
  Clone ID: LIB3068-012-Q1-K1-F2
aaccctctccctcctgtactcaggacgacacatacaggggcgatgacgctgggtaactggggggccggatcgaacgtcggcgtttcttgaaacttcaggctattagaagagcttgagcgtggagagaagggcattggtgatgggacagggaactatggaatggatgatgctgatgacatctacatgccggcatggactggtaccatcattgggccctgacaatactgtacatgagggtcgcatctaacagctgaaagttgtttcgtgacaaagactattccgagaaaccacccatctgtcagattccactcaaggaatcaacatgacatgcgttaatcacgag

SEQ ID NO: 55537 - DNA, 237 bp, Zea mays
  Clone ID: LIB3068-012-Q1-K1-F4
cccacgcgtgcgcccacgcgtccgctgaggcgaaccaagctggagaatatcaacctgaggagcgcccacaatctgagactgattacatccgtgctcaagaggctatgagggtcatgatctatgttcatgcccgaatgatgatagtggacgatgaatacatgatgattgggttcggcaagatcaaccataggttcatggacggagccacagactctgagatcgccatgggcgcgtacc

SEQ ID NO: 55538 - DNA, 452 bp, Zea mays
  Clone ID: LIB3068-012-Q1-K1-F6
atctttttcagatgataagtaaataaggcccgttctgacggttcgttatccagtttcggaaaaaggtgcttactagtgtctcgtcgttatccggggggagggttgtctccactctaaagaatgtgcattgattttattgctctaaagctcgcctaacttatttgacttgacaagaacagtggaagagaaagattctcaacgtctaacagctgctttagcttgaatcgggttgcgctgagttgagtgagtggaaatgagttgaaatatggaagcgagaacagctccgccgcttgagaagagacccagaattgctcataaaactctgtttcaacattttctgggtttagagcacattagaaatatggagtaggtaatccgcttggtttccctgatttctctatcttagatccgcataccatacccggttcagattggaaagccaaggtagtggc

SEQ ID NO: 55539 - DNA, 436 bp, Zea mays
  Clone ID: LIB3068-012-Q1-K1-G1
ctcgcgcgaccgcagaagcgagctactttatcactgtagtgatattattactgaactccgaatgagcaatgtcgacaattgcgacatccctcggcctgctaatccgtccgccaagatcatcagctggtacgccgtcctttgggtctctcaaaccagtagtggtgactctcccttgcgctcctgctgagaagaagcggcctcgatccatctgttactctgtggatgccaaggctaacgaccatgccttcaacatctctcccgttgcccttgtgcatgccaacatgccgccaacgtctacgccgcgatgggagatcaaggaagatggcaaggaagtcaggctgacattcttcaacttgtcggagggtgctacaacgggcgacttccatgttgccgtggaggacgatgtgctcatcatcaagagcacgaaacccaagcc

SEQ ID NO: 55540 - DNA, 413 bp, Zea mays
  Clone ID: LIB3068-012-Q1-K1-G10
cgggctactcggatgaccgtagcaattttagagctaatacgtgcaacaaacccggacgtgcgtgaggggcgcgttgatgagataaaaggctgacgcgggctctgcccgccgatccgatgattcatgataacttgacggatcgcacggccttcgtgccggcgacgcatcattcagatttctgccctatcttggagtcaatggagtctggcaggagaccatgaagaagcatgccactgggtttgtccaaggtgccctgaagcgtgatgagttttgtggtttcatcatgtagccgttcaacgtaaaaacagtatggaggtatatctaccaccacctgatgatttgatgaaccacagactgtcgtggttagctgtaaatgacagcgaatgtttatgtttctagtgacaatgtgaata

SEQ ID NO: 55541 - DNA, 397 bp, Zea mays
  Clone ID: LIB3068-012-Q1-K1-G11
ctcgcgtcaccggagctctccagaaccgaaccccaactgcccaagggcgagcgatccgaacccctcggcggcttcgtcaacgacgccgagaacactttgaggaatggctgaagaggatgtccagccccttgtgtgtgacaatggcactggaatggtcaaggcgggtttcgctggtgacgacgcaccgagagctgtctttcctagcattgtaggcaggccacgccacactggtgtgatggtgggcatgggccaaaaggatgcatatgtgggcgatgaagctcagtccaaaagaggtattctgacactgaagtacccaattgagcacggcattgtcggcaactgggatgacatggagaagatctggcaccacaccttctacaatgagcttcgtgtggca

SEQ ID NO: 55542 - DNA, 402 bp, Zea mays
  Clone ID: LIB3068-012-Q1-K1-E12
gtcgtcgctgcggacacccgcctctctgtaggatacagtatcctcacgcgtgatcacgccaagatctgcgacctggctgacaaatgtgtactggcatcttctggctttcaaggtgatattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccagtcctggacaatcaactaaaatca

SEQ ID NO: 55543 - DNA, 402 bp, Zea mays
  Clone ID: LIB3068-012-Q1-K1-C12
cccacgcgtccggcccgccgcacccggaggacttttgctacatcacagacaacacctagaccaaagaggagctcctcaagatggagagcgatatactcaagcttctcaagttcgagttgggcaatcctaccattaagaccttcctgaggcggttcacaagatctgcccatgaagacaagaagcgctccatcttgttaatggaattcttggggagctacctggctgagttgagtctactggattatggctgtctccgattcttgccatcagtagttgctgcttcagttatgttcgttgctaggctgaccattgatccaaatgccaatccttggaacatgaagctgcagaagacgacaggctacaaagtttctgaactcaaggattgcatcgtagccatacgtg

SEQ ID NO: 55544 - DNA, 181 bp, Zea mays
  Clone ID: LIB3068-012-Q1-K1-C2
cccacagcgtccggcaaattacatcgagttaacatcgcgcgcgaacactgccagtctagggctgggttctttctatctcgacgacggccgcatgcacaccaactctggcttcagcgacagcttcttcagcaacaaccggccaacaatgggatggctacgacagtcctgtccacctagctac

SEQ ID NO: 55545 - DNA, 426 bp, Zea mays
  Clone ID: LIB3068-012-Q1-K1-C3
cacacacacacacagacaagtggttaccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccggcggcgccggcggctacgtattccacgagcaccacgagaagaagaaggaccac

SEQ ID NO: 55546 - DNA, 412 bp, Zea mays
  Clone ID: LIB3068-012-Q1-K1-C5
cccacgcgtccgtttacacgtaagacctattgctcatgccatttgggatcctcagttggggcaacccgctgtggaagcctttactcgaggaggtgctgccggtccagtgaatatcgcttattctggggtttatcagtggtggtatacaattggattgcgcaccaatgaagatctttatactggagctctttttctattatttctttctacgctatccttaatagggggttggttacatctacaacccatatggaagccaagcctttcgtggttcaaaaacgcctaatctcgtctgaatcatcatttgtcaggacttttcggagtaagttctctggctcggacaggacatttatttcatgttgctattcccggatccagggtggagttcgtccgatggaatcatttcttagat

SEQ ID NO: 55547 - DNA, 447 bp, Zea mays
  Clone ID: LIB3068-012-Q1-K1-C7
gattgaggtagttgatggtcctaatgatgagggtgaaatgttcacccgccctggggaagtgagcgatcgcttcccacagcgcttatgcaaacgagcaagcagcccggtttgctaatggtggtgcataccctccggaccttagtctcatcacaaaggcaaggcacaatggtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgc

SEQ ID NO: 55548 - DNA, 311 bp, Zea mays
  Clone ID: LIB3068-012-Q1-K1-C9
gattccgtcgacattcgttatcatgtcatagctgtgaatacatttttgacagcgcgcgccatgcatccgggagcatactaagagggggcgggaccagaaggccgaaggagataaccttgcagcaatggaagaggatgatgacgaatatcaaataccgaaatcaaggcggctgagatgaggaatcaagaaagatgcttcaaagaacgtaagcgacgcccacatacagcagtaccacgcattcgccctaacattacagcagtcatctagtgattctacttgagctcagggcaacagattaaacatacactgat

SEQ ID NO: 55549 - DNA, 419 bp, Zea mays
  Clone ID: LIB3068-012-Q1-K1-D10
cccacgcgtccggcaaagcgccgccgtcgccccatccggcatggctccgaagaaggatgaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggattcccttgtttgccctctctgtaggagctcgtcttctttagaac

SEQ ID NO: 55550 - DNA, 452 bp, Zea mays
  Clone ID: LIB3068-012-Q1-K1-D3
cccacgcgtccgcctggttcacgaggctccagcagaggcggcaggttcgcaccaggcaggggcaacaatttcagaagtgaaggtaccagagggcgtggtaactacggtggaggaaggggctacgggaggggtgaatttagttacaggtctgattacggggtcagaagtggtggcagaggtggctcatcacgtggagctgatgttggctaccagagggttgaccatgctggatatgctggtggtcgtggtagccgcacagcagctgctggcgcaccttcaaaatgaggggcaccatagctgttgcgcgtcttttgggagtgttgttcggtggctctaagattattttgaagttggcatagaggctcatcaattggttcagtgcgggattacaagagaagcctggatacaaattatgagggttcctgtccttgatcattatttttgcaggcagc

SEQ ID NO: 55551 - DNA, 452 bp, Zea mays
  Clone ID: LIB3068-012-Q1-K1-D4
cccacgcgtccgcccacgcgtccgcccacgcgtccgctcaaggagacctgcagctacatgaagagcctgcacctggaggtggacgacctgagcgaccggctgtccgaccttatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatctcaacctctctctctctctctctctcgctcgctctacatgtgtgtgtacctttctcttcctttcacctgcctgtctcctccctagatctgagatcatgtggctagctc

SEQ ID NO: 55552 - DNA, 385 bp, Zea mays
  Clone ID: LIB3068-012-Q1-K1-D6
aaaacaaaaaccaagagagcaacaaggaaacaaacaagcggaaggcccaaaaaagggcgagccgaaaaccaaacccagagcgtgtgcgaacggaccgagccggacttctcttctcgggacccgtttgacggtgaactatgcctgagcgatgcgaatccagacgaaactctggaggaggcacgaagcgatactgacgagcaaatcgctcgaccgacttggatataagggcgaaagaccaatcgaaccatctaggagctaggcccctccgaagcgcccctcacgatagctggagcccacacgagtcctatcggataaagccaatgattacaggcatcgagggcccaacgccctggacctattcacaaactccaaataggtaggacgg

SEQ ID NO: 55553 - DNA, 450 bp, Zea mays
  Clone ID: LIB3068-012-Q1-K1-D8
ggagcagcagacctgggccttcaccttcggtatcctaggtaacataatctcgctgatggggttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaaggccgccagggcgctcacggccaagatgctgctggggctcaacgtcggcgtctttggactcgccgcgctcgccaccatggtggtctccagcgccggcctccgcgtgcgcgtgctcggatggatctgcgtcagcgtcgcgctcagcgtattcgccgcgccgctcagcatcatgcg

SEQ ID NO: 55554 - DNA, 404 bp, Zea mays
  Clone ID: LIB3068-012-Q1-K1-D9
gacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgggtggtgtg

SEQ ID NO: 55555 - DNA, 208 bp, Zea mays
  Clone ID: LIB3068-012-Q1-K1-E1
cagacgcgtgggaaaaaaaaaacaaaatttaattaaataaaaaaaaaaaaaaactaaaaagcaagtataaacaaataaaaatataaatatctaacaaacacatacatacaactactaatactctaatatcattaccaataaatccatcttcattccccttactatataacatcctctctcctactatccaccatactctccaacttaa

SEQ ID NO: 55556 - DNA, 395 bp, Zea mays
  Clone ID: LIB3068-012-Q1-K1-E11
gtgacataataaatcatttctggccgcccttgtttttgccattttgccagtataagccattggtgtctggtcaattccctgtgatttgcaggtcgctggtatgagttttgcagccttagccaacctttaagggtaggacaattttaggctcgcaaaattctatccttgtgaggaagcatcttggataatctgtcacgtcggccatgttcttcgtggcctgttgttgccgtcttggttgcgcaagaaagtttctctcgaggacagttgctccgtcttgttgaatttttttttgggggggcttgtaagagcatttgttatagaaactcacctcaggtggtggggttgcattctccgagttgtcaaagtttattactggttcggagtagattgtatat

SEQ ID NO: 55557 - DNA, 395 bp, Zea mays
  Clone ID: LIB3068-012-Q1-K1-C11
acccacgcgtccgacggcagtaggggccaggtgcacgtcttatctaagcggctgactcatcctctcgggcgcgatcctatgatcggtgataactcgacggatctgacgcccttagttccagcgacgcattattcacatatcggccctatcaagtttcaagggaaagctctgaacctcccatctcggcgtctggctacctagaattacactccgattaccaagcggatgcctgccaaacttctaatacattcaatgtaggcacttagttcgcatattaacctatattcactcgtacaggtagtgacgataattaactaagaggacgtcgctcgagattactcagcctacatagcgctgcacgcaacttcagtagcatattcatagtgttacctaaa

SEQ ID NO: 55558 - DNA, 371 bp, Zea mays
  Clone ID: LIB3068-012-Q1-K1-A12
aacagctcgtccgagaccatgaagagcagcccacacctggtgctgatcctgtgcctcgaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttc

SEQ ID NO: 55559 - DNA, 170 bp, Zea mays
  Clone ID: LIB3068-012-Q1-K1-A3
caggaaaaaaaaaatatacataacacactttataaaagatctagctactaacaaagtaagacgcgttatgatagatggtgacggggtccggatgctccattatgtgcttgcagatctagcatgtgtgcccggcattgcaacttacgttcctctttttcactggtccatat

SEQ ID NO: 55560 - DNA, 286 bp, Zea mays
  Clone ID: LIB3068-012-Q1-K1-A4
gccggcaaagatgagctgctgatggtaatgatgatgataagaggccactgctaccctacgacggaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 55561 - DNA, 440 bp, Zea mays
  Clone ID: LIB3068-012-Q1-K1-A7
caagcaactgcaaagcagcaagctctactcttcttctgtactgaacgtgtgactggatgacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacagccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaacaagtccggagacgacggctacgacagcgggtacaacagatcgggcaccaccaacgacgacgaata

SEQ ID NO: 55562 - DNA, 450 bp, Zea mays
  Clone ID: LIB3068-012-Q1-K1-A8
cccacgcgtccgcccacgcgtccggcaagtctcgctacgtagcagtgcaataaaagaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggtgctgtcggcggacccggagacgttcgccaagaaccgggagctggaggtgatccactcccgctgggccatgctgggcgcgctcggctgcgtcttcccggagcttctcgcccgcaacggcgtcaagttcggcg

SEQ ID NO: 55563 - DNA, 425 bp, Zea mays
  unsure at all n locations
  Clone ID: LIB3068-012-Q1-K1-A9
cccacgcgtccggacccacgcgtccgcggacgcgtgggttttgattttagccgccgccgctggtcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagcttctgcggcagctgctcctgcggatgaggctgangatgatgatgaccttgatctttttggtgatgaaac

SEQ ID NO: 55564 - DNA, 409 bp, Zea mays
  unsure at all n locations
  Clone ID: LIB3068-012-Q1-K1-B1
gaggcagtaagcagcatgggcattggcaggagatggcagttggcgtgcaaatggaccgagaggagaggcgaacatgggcaaaaggaacgtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaacgaactgctggagcaacgtgctgcttgtcctgcgatgatgcattcatctgaagcaggtactaaaggtccaaaatgggcccaactatttgagccttgggtgaagcatgcaacttgttgtggcatangaatacagatcctgcaacagtttgctggcatcaacggcgttctctactaca

SEQ ID NO: 55565 - DNA, 419 bp, Zea mays
  Clone ID: LIB3068-012-Q1-K1-B10
agggcagcaagggccatgggatcgactgaactatgcatgatgctcatcattgcggcgagtgggatcagctcggtgctacctcgacggatcggacgctgcggcttccagcgacgcgttagtcacatatcgggcatatcatgttgcaagagaaggctctgaacatcacagctcggcgacaggctacctgccacgtacacgccgactaccatgcgtatgcatgcctcactgcgaatactctcattgaaggagcttagttcgcatattcacatgcatgcactcatacacgtaatgacgataattaactgtactacgtcggtcgacattgcttcgaactaaatgcgccgcgcgcagcttcagagaagaggcatcgggttacgtcggcgtataacacattcattaaggaagagatacccaggatc

SEQ ID NO: 55566 - DNA, 194 bp, Zea mays
  Clone ID: LIB3068-012-Q1-K1-B11
tacacgatcgacgcatgcctacgcgtgcaggccgtattatctatcaggcatactcggactttgagcgaggatactgacagtcatgatacctcgacggatctgacagaactctggcctgacacacatcattcacattgctgcactatcaactttcgacagctggattggtacctaacatggcggtaacgatcgac

SEQ ID NO: 55567 - DNA, 416 bp, Zea mays
  Clone ID: LIB3068-012-Q1-K1-B12
ggcgagcgaggccttggacgcccacgacaacttcggcatcgagatagctatgcgggaggtcagggacttgttcgaggggatccagtccatgacctactgctgcggtaacttcggtgatgacaagggtgccagggccattgtcaaagccttcccacacataaaatgcactgtgctggcccctcccaagatcattgccaccaaaccggccgatggagcgaagataaactatgtcgaaggtgacatgttcagtttcattccacctgctcaaactgtcgtgctaaagcttgtgctgcaccacctgaccgatgaggagtgcgtcaagctcctggctcaatgccggaaggcgattcctccacggaaggacggcgggaaagttataatcggtgatattatgattgaccactctgggcttatgc

SEQ ID NO: 55568 - DNA, 427 bp, Zea mays
  Clone ID: LIB3068-012-Q1-K1-B2
aaaaaaaaaaaaaaaataaacaaaaaaaataaaatggcagccgacgtactaaatagaccgaggaagaacacataaattgggcagaatgaaagagtctctagagttactttacttgcattgacgatggcctacattgtacatacgggttctctattgtaattaccctgcggggatatttataatgctggtaagggaatacactttgcagatctggtgtgataaccatgtctttactatcacgtactgctggatcaacttgctgctaatactgcgataatgcatccatctgtaaaaagtactaaaagtccaagagggaacggcctatacgatcctcgggtgaattatgctctgcaggttggtatatgactacaaatgctacagcttcactttgtaattaacaacgttctctactatactcctcaaactc

SEQ ID NO: 55569 - DNA, 132 bp, Zea mays
  Clone ID: LIB3068-012-Q1-K1-B3
cccactcgtccgcccacgcgtactcccactcgttcgaaaaaaacataaaaattaaacaagtagatataactaaaatgatcaaaaataaaaatactttacaacaaattaaacttcaattaaaaatcttacaat

SEQ ID NO: 55570 - DNA, 454 bp, Zea mays
  Clone ID: LIB3068-012-Q1-K1-B4
cccacgcgtccgcccacgcgtccgaagatagtcgagaagctcttcgagatggaccctgagtacgcagtgcttgcgtttgctgacatgatgaggaagaagatcacgatgccagcccatctcatgtacgacggtaaggacgacaacctgttcgagcacttcagcgcggtggcgcagaggctgggcgtctacaccgccaaagactacgccgacatcctcgagttcctggtccagaggtggaaagtcgcggagctcacagggctgtctggagaagggagaagggcgcaggactttgtctgtaccttggcgccgaggatcaggcggctggatgatagagctcaagcgagggcgaagcaagcaccggttattcctttcagttgggtttatgaccgcaaggtgcagctttaatcaagaacgctaggcaatgtgggcatttactacgtatatcattttcagt

SEQ ID NO: 55571 - DNA, 262 bp, Zea mays
  Clone ID: LIB3068-012-Q1-K1-B5
gaggaactcatcatgaatccactaattggtggtggtttcggtattggtggttgaatgggcctaaggcttggtttcaatgggcccggaattggtcaagggactggtgcaagacaagctggaaaaaggattggcagaccacccgaagcagaaagtaaaataagaagtactttattgcttagactaacttttatagaaactctaacaatttatggactcggtgtggcactagcgcttttatatgcgaacccttttgtgtaatcct

SEQ ID NO: 55572 - DNA, 264 bp, Zea mays
  Clone ID: LIB3068-012-Q1-K1-B9
acccactcatcctcccactcgtcctaaaaaaaaaaaaaaatttattaaaaaaaaaaaaaaaaaaaaaaaaaagaaagaattaaaacaaaagaaagaaaaaccaaaaaaaaaaaaaaataaatattttatacaaaaaaaaaatgcccccccttttaaaattcccaactttcctaccccttcttttcaacttcatactttttctatactcccccctaaatcaatttcactccccccctttttccccccatctaaactttaaaaccc

SEQ ID NO: 55573 - DNA, 374 bp, Zea mays
  Clone ID: LIB3068-012-Q1-K1-A11
ggcattgctcagttttcagccccaatttctccaccatagtctgactgacaaaagtaggggaggtaccataatctaccaggatgagcatcacctgattctgaatcagagctcttactctcatgcaacactcatggtctgttccactgatggcatttaacgacagattgtgggactcctctcggttctggtcctcctggtccagatcatacaacacctcatccgacaacatctgccccatatcttccacagttaaactatgtaactgaggacctgttctcttggaacatttggcctgatgtccaggttcatacttctctccacacccaaaacataacccattcatcctcctaaaatccctcaactgcctcttcttc

SEQ ID NO: 55574 - DNA, 446 bp, Zea mays
  Clone ID: LIB3068-012-Q1-K1-C1
cgaaagaagtcgcctaattctttcgatcgaattaggcgccttcttcgtcccacgctccggctgtatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgc

SEQ ID NO: 55575 - DNA, 328 bp, Zea mays
  Clone ID: LIB3068-012-Q1-K1-C10
acgatggccctagctctccctcgcattcgctttactcttgctcggtcagagacatccggtggcaccgttagaccgtcctgacgatcctcagctatctagctatggcccagactgttgagctcaacgatgctacgatctgtaacgtctttatgcgagctatcaaacctgtccatgacgagatgagacgcttcatcttctacatacgtatacatcatgaaccagatggctaccgtgaatgtcattgatactccttacgtcctactgttgacttgattcaagactggttaaaatacttccttctctaaggttgacgtcgatacaagtgaat

SEQ ID NO: 55576 - DNA, 464 bp, Zea mays
  unsure at all n locations
  Clone ID: LIB3068-010-Q1-K1-E9
cccacgcgtccgcccacgcgtccggccgcagtcccaccgaccccgccgccggtcgccctgggtctgggcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaatcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctnccctgcctgctgcgtgctatgtctga

SEQ ID NO: 55577 - DNA, 401 bp, Zea mays
  Clone ID: LIB3068-010-Q1-K1-F12
acgcctggcaaagtcaaccagaaatatggacttgccacttcaactaaacataactaaaacaaggaaagagataacaaaactgtacaaaaaacccataaaaaactaaaaattaaaaatgtaacaaaaggatcatgactataatgctcaaaaaaaaagaagaaccaaaaatctttcacaaatggctctgccctacttagcaaacacttttatcgcattgtcctcgtgcattatcaggcaaacatcatgaggaaactgccttaccaccttctcatgtacaatctaaaatttcagaactgcctaaactcaatatgacccattacacctcctctacagatacatcctcttttcatactgagctatcttcttatgctgctcctgcaccataacatatccactcaaat

SEQ ID NO: 55578 - DNA, 215 bp, Zea mays
  Clone ID: LIB3068-010-Q1-K1-F2
accacgcgtccgaaaaaaaaaaaaaaaaaataaaaaaaaaaaaaaaaaaaaaaaataaaaagaaaatttgataatataagaaaaactgaaaaaaaaacaaataaattaaatataatttaaaaaatacataaatataatttaacttaaagaaaaattaaacaaaatactattttgaaaacaaatataaatcaattactttatttcaatttacaata

SEQ ID NO: 55579 - DNA, 359 bp, Zea mays
  Clone ID: LIB3068-010-Q1-K1-F3
cccacgcgtccgcaaccatttgagaacaccagattttgtcgaattttcctttccttttgaggaatatgtgagcacgtccatgtcaataccaaacatctggccttttctctctctcttttttacatatgtttatgtggtcttagcaagtagttgtgctcgactttgcgttatgaggtatgccgtatgtgattggatcacggtgacctaacaggccattcccacacttgtgtttttacatgacttttgagtgggtgatgcacggataatattgacatgttgcgtgcacgctcaggtggtgctctttcacttgatggcgtcgtcggttcggtcaagataagtttttaaggttttcctgttcc

SEQ ID NO: 55580 - DNA, 434 bp, Zea mays
  Clone ID: LIB3068-010-Q1-K1-F6
cctacgcgtacgtgcacgcctaccaaaacaaggtgacggtcacaggactacggggacaccgccaaagtcatagcagccgggtcgactacaagacaggcaagcgggtggagccctggccctacgtgccctacgagatggtgcagcacccctacgcgccgggcgcctacgacaagaaggcccccgccggctacgtccgcaacgtcgtctccgaccccaccgtcgcgccgctcgccagggcctactccaccgaggtccgctacaccgccgccttcagcgacgagaaccccaacgcctgctccgtcatgtagacgtagacccacccacacaccgaccgacccatgctattagttactagtagtatagtaggtgcttgcttgagagagttgctcttggaggaggttttgctcttcctgattctctttttcttttttttc

SEQ ID NO: 55581 - DNA, 153 bp, Zea mays
  Clone ID: LIB3068-010-Q1-K1-F7
acgactctgcccaatacttctcctatctcgtgcagacgtccatactcaaagggtacaccgtaaacacttaaatcgtgggatgacaaccagacacccaaaattctctgtgtctccaacatatgaacgacactgcatcacccatgtctgacaaca

SEQ ID NO: 55582 - DNA, 464 bp, Zea mays
  Clone ID: LIB3068-010-Q1-K1-G10
gcatctaacactaatgcaactcagttttactcttacaaggaccaaatgcatgtaacaccggagactagggcctcagtgatgacagaaaaagatagcagtcaagcttctgctgcatcaagtcagccctttgcgggaactgttttaagagcacaaagtgtatctcaggaagcttcacctagcgtctttacttcaaagcctctcatagattcttcacttgtgaaaaatacatatgttggtttaagttcaggcggtgcccatattggacatccaaattttggtaaccagcaaccaagtgacgaatgccttaaaagaaaatctgaatctctatctggttcagaagcaaggggtcattcagctgcattggtgcaacctgctctaggaaatcataatgggagtggaggtgcacacaagggccttcggatggctaacgttgtacatcgattcaagagcttagttgaatcttt

SEQ ID NO: 55583 - DNA, 449 bp, Zea mays
  Clone ID: LIB3068-010-Q1-K1-G11
gcatgtaacactaatgcatctcacatttactcgtactgagaccaaatgcatgtaacaccagagacgggggcctcagtgatgacagagaaagatagcactcaagcttctgctgcatcaagacatccctttgcggcaactgttttaagagcacaaagtgtatctcatgaagctacacctagcgtctttacttcagagtctctcatagattcttcacttgtgacaaatacatatgttgcgctaagttcaagacagagcccatattggacatccaaattttggtaaccatcaaccaagtgacgaatgccttagacgaaaatctgaatctgtatctggttcataagcactgcgtcattcagatgcattggtgcaacctgctctacgaaatcataatgggagtggaagtgcacacaatggccttcggatggctaacgttgtacagctattcaaga

SEQ ID NO: 55584 - DNA, 466 bp, Zea mays
  Clone ID: LIB3068-010-Q1-K1-G12
ctcatcaccaccttgtatgcagtttccctagcaacagtgatagtcctcctcctttggttggacaagcccgcagtcgtggggaaagccactgccgttcccggcgacgagaagccacggcgacgactgccgcctgggccatggacccttccggtcatcggcagcatccaccacgtggtgcgcggcctaggacaccgcaccatgatggagctgtcccgtcggcacggccccctcatgttcctccgccttggcgaggtcccgacgctggtggtgtccagcgccgaggcagcggagctggtgatgaagacccacgacctcgccttctgctcccgcccgaccaccagcgtcaccatcgacatcgtcggctgcaagggcaaggggctcggcttcgccccctacggcgaccggtggcgtcagatgaagaagatcaccgtcgtggagcttctcagcgccacgcaggtcaagcgca

SEQ ID NO: 55585 - DNA, 436 bp, Zea mays
  unsure at all n locations
  Clone ID: LIB3068-010-Q1-K1-G2
cgagccccaaacccacgccgccgacgtacactcccaccccgacgccccccaagccgacgcgacccacatacactcccgcccgtacgccccacaaacccacaccaaaacccactcccactcctccgacgtacaccccgacccccaagcctccgacacctaagccgaccccgccgacgtacactccaagccccaaacctccgacgcccaagccgaccccaccgacgtacaccccttcccccaagcctccgacacctaagccgaccccgcctacgtacactccaagccctaagccaccggctaccaagcctcccacgcccaagccgaccccgtcaacgtacaccccttcgccaaagcctncgacacccaagccgaccccgccgacgtacaccccttctnccaagcctncgacgcccaagccgaccccgtcgacgtacac

SEQ ID NO: 55586 - DNA, 338 bp, Zea mays
  Clone ID: LIB3068-010-Q1-K1-G6
caagcaccacaagcacgagcaccacctgcggcgatgctgcgggagcatggcggcgtgcgggctgacgctggtcctcatcgtggccttcgtctcgctggtggagtacctggcgctgcgcccctcgaagccgtgcttctacctgcaggacctgcagctgcgcaggcccatctcgctgggcgacccgtcgctgacggcgtcggcgcaggtgacgctggcctcccgcaaccccaacgaccgcgtgagcatcttctacaagcgcctggacgtgttcgtcacctaccgcgacgaggccgtgacggtgcccgtgtctctgtcgccgcagtaccagtgccatcgct

SEQ ID NO: 55587 - DNA, 104 bp, Zea mays
  Clone ID: LIB3068-010-Q1-K1-G7
ctttcaatacatacaagatttttactttcgttgatctcatcttaacacaccggccttattgtttaacataagtctcagtcctgacctaactcatcatctcacaa

SEQ ID NO: 55588 - DNA, 462 bp, Zea mays
  Clone ID: LIB3068-010-Q1-K1-G9
gcttgatgaatctgtgtctgctgcaattactgagaatgatattgttgctgctgctgtgtggtctgggaacagaaattttgaaggacgtgtgcatcctttaaccagagcaaattaccttgcttcccctcctttagttgtggcttatgcattggctggcacagttaatattgattttgagaaagaacctattggcatctcgaaagatggaaaagaggtttacttccgggatgtttggccatccacagaagagatagccgaggttgtcaagtcaagtgtgctccctgacatgttcaagagcacatatgagtcaatcaccaaaggaaatcctatgtggaatgagctgccagtctcaacaagcactctctacccctgggatccatcatctacatacatccatgagccaccttacttcaaggatatgaaaatgagtcctcctggcccgcggcctgtgaaagatgcata

SEQ ID NO: 55589 - DNA, 437 bp, Zea mays
  unsure at all n locations
  Clone ID: LIB3068-010-Q1-K1-E8
gcgggacgcaagtgctggaacgtcagacccccctgtatcagagtctaccccggtgctttgatcatccgccacacgctggccggaatcaactgtgttggcttccttgcggtctacagcagcagcgtctccccccaggacgatcagccggcatcctttgttgcggtcaatatcccgcaattactctgtttcaggttccagtatccttcgcacccccgactctaggtttgatgcaaactcatctatctgcacaagtggaagcaacttggaccttgcaaatgtaccatccccatggtctggcacttggcaccgtgcgtctgctcactctttgtgcaggggctacttgtccccaccgatcggcatcaggaatacctcagcacatgtctcgcgttctgccaatggatctcccagtcgttacgtangctcatcacgcatgtccc

SEQ ID NO: 55590 - DNA, 433 bp, Zea mays
  Clone ID: LIB3068-010-Q1-K1-H1
cccacgcgtccgcccacgcgtccgggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaacta

SEQ ID NO: 55591 - DNA, 357 bp, Zea mays
  Clone ID: LIB3068-010-Q1-K1-H10
cccacgcgtccgctgtatcctatgactttcaagtatctaggtccatgtaagctttttgtgggtgtctgtgttcaactgagacgtttttatccggagttgaacatcacaataaagcaaagtcactgataccatgtaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaataaaattaaatatttaaatataaaaaaaaaaaaaaaaaaagggggggcccttttaaaagaaccaagttttcctccccggggattccaatttaaacatttttattaggggcccccaaatt

SEQ ID NO: 55592 - DNA, 276 bp, Zea mays
  Clone ID: LIB3068-010-Q1-K1-H11
gcatcgacactgatacgatgtaccaaaacggcaacatcaaaaagaattacgaaatgaaccctgaagatgaagactaaaaaaagtggagctaacatcgatctggactcacaaatgaaaggaaaatgagttgatcggaagacatgcaccagacaaaccataattgctgcctgaaaatgcgttagtagaaaccgataagctaaagcctggcgaaggaactagagataacaaatactgctacttgatactagatacattggcttcaaaatatgactcacg

SEQ ID NO: 55593 - DNA, 453 bp, Zea mays
  Clone ID: LIB3068-010-Q1-K1-C9
gtccctcgtgctgtttttgttgaccttgaaccaactgtcatcgatgaggtgaggactgggacctagcgccagctcttccaccctgagcagcttatcagtggcaaggaggatgcagccaacaacttcgcccgtggtcactacaccattggcaaggagattgttgacctgtgccttgatcgcatcaggaagcttgccgacaactgcactggtctccagggcttcctcgtcttcaacgctgttggtggaggaacaggctctggccttggttccctcctcctggagcgtctgtctgttgactacggcaagaagtctaagcttggtttcactgtgtacccatccccccaagtttcgacctcagtggttgagccatacaacagtgtcctgtccacccactcccttctcgagcacactgatgtggctatcctgctggacaacgaagccatctatgacatc

SEQ ID NO: 55594 - DNA, 435 bp, Zea mays
  Clone ID: LIB3068-010-Q1-K1-D10
gacgctactggcacgcacgcacgcaccagcaccagcaccacaccacatgcatggtggagggtatcaggggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgacgcccgcctccgcgtcctgggacaccgccagccaccgctccttgtcgtcgtccgacgaccagcagtacatgacgatgagccgcgagttcacggccatggtcgccgacggggcgaccatgcagaccggcggctacgacggcgccgtcgaccagctcaccagcatcggcgaggacgagctggaggagac

SEQ ID NO: 55595 - DNA, 416 bp, Zea mays
  Clone ID: LIB3068-010-Q1-K1-D11
cggacgcgtggggcagccaagtaaaccgtgggaatgttttttttgttgttgtcttgtgtgcgatggcaacacccaggtcgtgaaggcaatcgagaacgcgatccccgtgcggcggcgcgggtgcggcgggagctgtggtgcgggctgacgtacctggtgatccagacggccgggttcatgcggctcaccttctgggagctgtcgtgggacgtgatggagcccatctgtttctacgtcacgtccatgtacttcatggccggctacgccttcttgctccgcaccaagaaggagccgtcgttcgaaggcttcttcgagagccggttcgcggccaagcagaagcgcgtgatgcgcgcccggcgcttcgacctccgcaggtacgaggagctccggagagcctgcggcgtggcggcggcgcc

SEQ ID NO: 55596 - DNA, 229 bp, Zea mays
  Clone ID: LIB3068-010-Q1-K1-D12
gacgctcctggcgcacacacgcgcaccatctccatgtccacaccacatgcatcttgtatgggaagggggcaacctagctgtggatcgacgatataacgcccaccctccgccatgttgcatgagcagcatgcgccgtcacccgcactgacatccctaccgatacacaccaaccccttcatccacctcaccttctatgacctggccaccaacttgatcgaccccatctctt

SEQ ID NO: 55597 - DNA, 286 bp, Zea mays
  Clone ID: LIB3068-010-Q1-K1-D2
cccacgcgtccggagctgctgatggtaatgatgatgataagaggccactgctaccctacgacgtaccgtcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 55598 - DNA, 308 bp, Zea mays
  Clone ID: LIB3068-010-Q1-K1-D3
cttctgatggcaattatgatcattagatgccactgatactatacggcttacgtgaatctttatatgctgacttgcgtccaccttagacgatcgatgatagaataacgcatacctctatgctgccggctctgcttctgccgtcctggacagttaatttactcatgtgtaatctctatatgtcaatcatcagcatgactattgagctgatatgtcatggtattacaactatatagtcattaaaaccataatcaatgaccccaactatgcagagtaaattcactttgacattcatagcactgtgcataaat

SEQ ID NO: 55599 - DNA, 242 bp, Zea mays
  Clone ID: LIB3068-010-Q1-K1-D5
gacccactcgtccgcaggcacgttggctgacacgttttctccttattcaaccgacgcaaacaggagaagatttgctaacattaatcggtcttcaggtctaccaatgcatgactttttcctgctactaacattttgatcgtcctaagcaatattacttgtattgttctaccttttcacaaaccaatcatactatgttctacctcatgatttcttcaccttaatgtactatcaagtcatatcct

SEQ ID NO: 55600 - DNA, 297 bp, Zea mays
  Clone ID: LIB3068-010-Q1-K1-D6
cggacgcgtgggcggacgcgtttgaaaaataaaaaaaaaaaaaaaaaaaaaaggaaaaaagaaaaattaaaaaaaaaaaaaaaaaaaaaaaaaaaaaaaaaaaaaaaaagaaaaaaattttataagttccaagtttacttactctttcttgcaacgtcatattttttttatagtgttacctaaatttattttattgcccgattttttaaaacgtcctgatttgaaaaaccttggagtttccaaacttaatggctttatagtacatattcgtttggtaacatggcatattatctaaaa

SEQ ID NO: 55601 - DNA, 436 bp, Zea mays
  Clone ID: LIB3068-010-Q1-K1-D7
cccacgcgtccgaatttaaggaggttgtgctaactcccacacatttggccatagttatgggatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgttgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccc

SEQ ID NO: 55602 - DNA, 231 bp, Zea mays
  Clone ID: LIB3068-010-Q1-K1-D8
cccactcgaccgcccgcgcgtccgaatacacatatgaagaatatactcccacacataacaccagggaaatatgaaaattttaaaaaagcggagcgcttacaaaagatccaaaacgcaggaacacttaccgatcatcacgcaaaacacattattccaacaacagaaatcacaagttacacacaaccactcaatacacatataccatagacactacaaactagaaaacactct

SEQ ID NO: 55603 - DNA, 396 bp, Zea mays
  Clone ID: LIB3068-010-Q1-K1-E1
cggtcgatccaattgtcacttgctctcccttttacaagctaatcaaggccgctgcatccctgtactatctcgaagcattgtgcgtcgctgaagagaatcaccaccaccaccacctgttccaccacaagaaggactaggagcacgccgccgccggcgggtacggcgagtccgccgagtacaccgaggccaccgtgacggatgtcgtctccacgggcgagaacgagtacgacgagtacaagaatgaggagaagcagcacaagcacaagcagcacctctgcgaggccggcgccatcgacgccggcgccttcgcactcgtacgtagtccgtacgatccgatcctccttgagtagtatatatatacataaatgaacgacgagaacgaattatatatatata

SEQ ID NO: 55604 - DNA, 448 bp, Zea mays
  Clone ID: LIB3068-010-Q1-K1-E12
acgcgggacctagagattaacctatttgtcagatccatttataaacggacactatccacacatggtgcgggatctcatcaaggagagcctgcccatcttcactcctgagcagtctatactggtgaagggctcgacagactacatcgctatcaacgagtacacatccagctacatgaaggggcagaagctggtccaactagcgcccagtagctactctgccgattggcaggttcaatatgtgtttgcacgcaatgtcaaaccgattgcaccacaggcaaattctaagtggctctacatcgccccgacggggatgtacgggtgcgtgaactacctcaaggagaagtatgcgaatccaacgatctacataacggataacggaatggaccatcctggaaacttgacccgagaccagtacctgcgcgacgccaccaaggtgcggctctacagg

SEQ ID NO: 55605 - DNA, 279 bp, Zea mays
  Clone ID: LIB3068-010-Q1-K1-E4
accacacgttcggttaaaaagctcgtaattggaccttgttccggaccagacgctccgccgcacctcggtaacctatcgcatccagccttctatcaactatgctctcctgcacttaactgaccgcatcgtgccttcgtcgccgttacttcgaacaaattacagtgctcaaagcaatccatcgctctacatacattaccatgccataacaccataggattccgactctattgtggcggccttctcaatcatcttcacgattattagcaacagtcaccttca

SEQ ID NO: 55606 - DNA, 434 bp, Zea mays
  Clone ID: LIB3068-010-Q1-K1-E5
gtcgatccaattgtcacttgctctccctccaacaagctaattaaggccggtgcatccctgttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactcgtacgtagtccgtccgatccgatcctccttgagtagtatatatatacataaatgaacgacgagaacgaataatatatatatattaatcgaacgaactgaatgacggtcacctcgtgtgacgt

SEQ ID NO: 55607 - DNA, 270 bp, Zea mays
  Clone ID: LIB3068-010-Q1-K1-E6
cccacgcgtccgaaaaaaaaaaaaaaaaataaaaaaaaaaaaaaaaaaaaaaaaaaaaaagaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaagccaaatatacaaaaaaaacaaaatttttctataattaaatacaactagtacaatattcatgagaagcaacaaaataaaa

SEQ ID NO: 55608 - DNA, 435 bp, Zea mays
  unsure at all n locations
  Clone ID: LIB3068-010-Q1-K1-E7
cacgatgttctccaccgcaaaccctgatgtggtatacaaggggaagctccatgcccaggggcgcgtcgccgtcaagcgcttgaaccgctctgcctggcccgacccgcgccagttcctggaagaagctagatcagttggcctgctccgaagcaaaaggttggcaaatttgcttggctgttgctgcgaaggtgatgaaaggttgcttgttgcagaatacatgcccaatgatacgctcgcgaaacatcttttccactgggagtcacaatcaatgaaatggaccatgagattaagggttgttctctgtcttgctgaggctttagaatattgcaccaacaggggccgtgctctctaccatgatctcaatgcctatagagctctgtttgatgatgattgtaaccctagactntcctgttttggcctcatgaagaacagtcg

SEQ ID NO: 55609 - DNA, 436 bp, Zea mays
  Clone ID: LIB3068-010-Q1-K1-C8
gcggtagcggcgagtccttcattgtcggagtcggaagaggagcaatccgaggcccactcgttgcctagatgcgcctggccctttgccttcttgtaatgcttcttcttttccctcttgttttccttttcctggtcactatcattatcaggccagttagcgataaaatgaccaatcttaccgcacttgaagcatgagcgcttccccttcgtcttggtcttgcttggctgccccttgtgaccctttagcaccgtcttgaagcgtttgatgatgagagccatctcttcttcattaagtccgaccgcctcaatttgtgccaccttgctaggtagcgcctccttgcttcttgttgctttgagagcaaaaggttgtggttcgttgatcggtccattcaaggcgtcgtccacgtaccttgcctccttgatcatcattcgcccgc

SEQ ID NO: 55610 - DNA, 436 bp, Zea mays
  unsure at all n locations
  Clone ID: LIB3068-010-Q1-K1-B2
gctcgagcccgctcagcgcggagctgaggaaggtccggacgacggccactgtcaacttcgacaactcgctgagccccgcgcacacgctggttcagatcgtctgcgctgaccagaaggggctcatttacgatatcttgaggacgatgaaggactgcaacatccagatattttacggccggttcagatcagacaagaaagggtcagccagcaaaggttcatcaggttgccgtgaggtggatcttttcgtgaagcaagtagacgggaagaaggtgactgatcctgcgaaacaggacgcgctgcggtcacgcctgaggtccgagacgctccatccgctcagggtcatggtcgtcggccgtggacccgacacggagctcctcgtcgccaacccggtcgaggcctncgggaagggacggccgcgcgtgttctacgacgccac

SEQ ID NO: 55611 - DNA, 441 bp, Zea mays
  Clone ID: LIB3068-010-Q1-K1-B4
gcgaccaccaagcagagcaagccagtgaggtctctcagagcgtagccagccagctacaatggcggtggacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaggccatcatgtcgtgccaccagtgcggcggcaacgtcggcgacgtcgtcaacatcccgatcccgcagtgggtgcgggacgtcggcaaaagcaaccccgacatcttctacaccaacccgagtgggctgac

SEQ ID NO: 55612 - DNA, 291 bp, Zea mays
  Clone ID: LIB3068-010-Q1-K1-B5
tcacgatacttcacatgatatttgatcgttttaaatagctcacacaacactgattatctgtccaccttcaacccacacgcgaaaaatattcgacacgctctacttctgtacatacctatcatgctattactctatccacacatcaccctgctgtaccactttcaccaactcctaacgtacctaataccacatataacgataacatcaatgatatcatatacgaaaactcgtgtttacatgatgctcaccttacattctaagattataaagagctactttatacctctcaca

SEQ ID NO: 55613 - DNA, 423 bp, Zea mays
  unsure at all n locations
  Clone ID: LIB3068-010-Q1-K1-B6
cccacgcgtccgcaacttcgaggatggcccgcccaagtcggcgctggtgaacggcacgggggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcggcgcggacgtgcgcgcaggcggagcggctgaacgtgtcggtgagccccgagtggggcgtgctcccgatgcagaccatctacggcagcaacggctgggactcgtacgcctgggcctttcaagcgaagatggacgcggtgacgctgctcatncacaacccgggcgttga

SEQ ID NO: 55614 - DNA, 243 bp, Zea mays
  Clone ID: LIB3068-010-Q1-K1-B7
cccacgcgtgctcactaactatgtagttcctactaactcaaacctacttagggacaccggggtttcatacactcacgccatccattaattagatacattcatctatctacaattcatataatcacctcactctcactactacttgctcttcatggttccttacatcacacactctcagccccttttccaagactcgtctttcctgcagcgacttgccgtaccgcatctcgactactactgcat

SEQ ID NO: 55615 - DNA, 442 bp, Zea mays
  unsure at all n locations
  Clone ID: LIB3068-010-Q1-K1-B8
cgacgcgcagtcgcccattccgcatctcgccctcccgtcccgtcccgtcccggccgtccgttctccgattggccgccgcccgcctcgccctcctcgtcaacaaaagcccaccggaagcgagcgagcgagccaccctccccgccgccgccaccgcccccgtcccgcccccaccccgactcctcctgaccgccggcgtggggtgcccgggctccacctccggcgacgacaccctccccgccgcgcgcgccctcaccgcctgctccgtttgcggnggtagccggggctccggcctcggcggctttcaaagccccctccctcacaacaggatccanaatcccgtcctagacttcttctacctccccttccagaacttcctcttttggcatcccggacggtcgatctcgacccccttcgacttcgattcatctcttcttatcgattg

SEQ ID NO: 55616 - DNA, 452 bp, Zea mays
  unsure at all n locations
  Clone ID: LIB3068-010-Q1-K1-B9
attttagccgccgccgctgctcatctcacatccctcgagaagacgcctgctcctcgccgggcgatgcgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgncgctgccaaggcctcttctaaaaagaaagaaagt

SEQ ID NO: 55617 - DNA, 430 bp, Zea mays
  Clone ID: LIB3068-010-Q1-K1-C1
gacccacccggacccactgatcctaactgccactctcaccgacttctcagcttgtgcgctcgcaatggcactcgtgtaacactgctccatcttcaccaccgacgtggcggcgctccccaggaatgggcatcagcagacgtcgtcgtcgttgttctcctactcctactcttcctccttcctcgtcggcaagacgctgctgaggcacgccgaggcagcccggacgtcgttcgccgtgcgcgcctctgcggattccgacaggccgatctggttcccctgcaacacccctacgacgaggctcgactgcagcctctctcacaacttccgctttgatccctgtggcctccgatctgacccggagagcctgcggtggaacgtgcatgcggatctggtgcactgccggtgggcgatgctctgcgcagcgggtatcttc

SEQ ID NO: 55618 - DNA, 468 bp, Zea mays
  Clone ID: LIB3068-010-Q1-K1-C11
cacaaccaggatagttatctttggaagatctttaggaggtgctgttggagcagttcttgcgaaaaacaatcctgacaaggtggccgctctaatactggaaaatacatttacatccatactggatatggctggtattatgcttcccttcttaagatggttcataggtgggagctcttctagaggtccaaaacttctgaactgtgttcttcgctctccatggaatacacttgatatcattggagaggtcaaacaacccattctcttcctttctggattacaagacgaactagttcctcctccacacatgaagatgctatatgacaaagcttctgatcataatagcaattgcagatttgttgattttcctagtggtatgcatatgaatacctggatgtctggaggggaccgctactggaggacaatccaactgttcttggatcaatatgctcctggagtacaaaatcgtga

SEQ ID NO: 55619 - DNA, 267 bp, Zea mays
  Clone ID: LIB3068-010-Q1-K1-C12
cttattctacctttcattctaacttacatacgttcaatcataatcctacacacaatatctattatccactgacttttcataccaatcgctattcaccaattattataatcaacatgttcctcattccactactcttaattactttctcatcacactcattatttttttctaactaacctatctcactacattctaaacccagttcacattccctatttgtcttataacaatccaacactatttcaattcttcttcacactcataata

SEQ ID NO: 55620 - DNA, 430 bp, Zea mays
  Clone ID: LIB3068-010-Q1-K1-C3
caatggtgcaaacagatgggggacaccacatcatgcccatccgtgagatcttggcctcagcgtcgattgagaagatgacgttgcaaatatttcagacttgtcaagataagaagagacgaaggaagaacaatcaaatgagaaaccttttcagtcagtatagaatgacatcttttttctttcagttcagaccaccaaggatccaccttcctccaatggtgtggtgcaaaaacaacaacatggtctacacagcagtgcctctaacgcaaggaaggacaaaggcagacgccacagagtatcattgaggaaatcatgtctctgttattaaatggtttgcctgcacatctgctttgagctgatcaccacgccttgtggacacaggtaatttataactgtgtctttccaaaaaaggatggttgcatgaattctatgc

SEQ ID NO: 55621 - DNA, 336 bp, Zea mays
  Clone ID: LIB3068-010-Q1-K1-C4
ctcgcgcgaggaatatgaacaacttacatgtgagaaggcacatttggagggagaactaggggagtgcggcagaataatcgaagaaacaatggctcggttaagtgatctggagaaaaaactggaagacctgacatctaagatggctgacagcgagaaatcaactagctagaatgagacacatgtgaagtgtatggctgaatcatacaagtgacttgaatcacggaaaatcgaattagaaaatgagatagaagcgctacagtccagaatagatgctctaacagctgaactctgtgatgaaagacagagtcatcaggaggacttagttaaatacagaga

SEQ ID NO: 55622 - DNA, 435 bp, Zea mays
  Clone ID: LIB3068-010-Q1-K1-C5
agctcccacgctcaccgacgccacagcttgtgcgcgcgcaatggcactcgtgtccgcctgctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgt

SEQ ID NO: 55623 - DNA, 184 bp, Zea mays
  Clone ID: LIB3068-010-Q1-K1-C6
gacccacgcgaccgagcggccacgctcaccgactcctcacctttttcacgcgcaatgacactcggggccatctgctcatcttacaccaccggcggcgcctcactcaacagtaatgggcaccaacaagctgacaactccataggtctcctcctcctactcttactccttactcttctgcaataca

SEQ ID NO: 55624 - DNA, 295 bp, Zea mays
  Clone ID: LIB3068-010-Q1-K1-C7
ctgagagtgtgtgtgagagagaggatgggtggcagcggcagggctgctctggggctggggctggtggtggtggccgtgagcctggccgtggagatccaggccgacgccgggtacggttacggcggcgggtacaccccgacgccgacgccggccagcccgaccccgaagcccgagaagccccacaccaaggggccgaagccggacaagccgcccacggagcacacgccgtccaaggagcacgggcccaatccgcagaagccgtcccaggagcacacgccgacgccgaccacgtaca

SEQ ID NO: 55625 - DNA, 467 bp, Zea mays
  Clone ID: LIB3068-010-Q1-K1-B12
cccacgcgtccggccagggatcgccatgtcggactcggaggagcaccacttcgaatcgagggccggcgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatggggg

SEQ ID NO: 55626 - DNA, 446 bp, Zea mays
  Clone ID: LIB3068-058-Q1-K1-A9
gtccaaaatccagaccgctggtaggagtatctcgtagacattgaacaacgggtgcatggggagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcattcggcagc

SEQ ID NO: 55627 - DNA, 411 bp, Zea mays
  Clone ID: LIB3068-058-Q1-K1-B1
gcggagcagcagaggaccagggcagctagtagctggtaatcgcaattagtgcgcgctaatcaggtgctgatctgtcctcccgaccgttgctacaccatatccctccccacaccgccggctccactccactccgatcgactcgcctgagattctcgcagggactagtttgtggcggaatctcaaacccaggaacctgtgaatcctcgacacttgcgaaacatgagaaggttctttttcttcgggtcccctgctgcaaacgctggtgagggtgccgggcaaccggtcaatgatagcaggactggacatagaaagacagatgagggaaaggacatctccaccgcgagattgtcgagatccagaagccgtcgtcagaagcggaataaggaggaaccggctaaccccaaacaactc

SEQ ID NO: 55628 - DNA, 445 bp, Zea mays
  Clone ID: LIB3068-058-Q1-K1-B11
tccttgctagctccttgccttgccttgcctttgccttccctccgcgcgaggagaagagcgggcggacggacggagcacaggaaagccggacggacggacggagccggacgcgcgagatggagatggcgggggcggccgaagcggacacgccgtcgcaggagccggtgcgcacgggccggagcaacaccatcctgctccccatcggcggcatcctcctggcctacctgctctaccgcttcctccgcccgcgcctccgcggcctgcgcctcgacctgcccgcctggctgcgctgccgccgcgcgccgaccggcgggggcgccgtgctgccctacttcgcgcccatcgccgaccgcctcggcgccgtcgcgctgccgtacctcggcgccttcgccggcccgcaggcggcgctcctcaggttccccggcggggaggcgctgtcggtggc

SEQ ID NO: 55629 - DNA, 381 bp, Zea mays
  Clone ID: LIB3068-058-Q1-K1-B12
cggacgcgtgggcggacgcgtgggtcaaaaaaaaaaaaaaaaaaaaaaaaaagaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaataaaaaaagggtggccctttttaaaaattcaatgtttattatcctacaaatctcatgtcattattttttttttagtttacctaaattaaaattctttggcctctttttaaaatattcctttttgtaaaaacctttatgtgcccaaatttatcgcctttctaaaaaatccccttttttcaatggtgattattactaaaaatgcccctccgaattaactttccaaa

SEQ ID NO: 55630 - DNA, 232 bp, Zea mays
  Clone ID: LIB3068-058-Q1-K1-B4
cggacgcgtgggtccgtgaaaaagattgtagaaaactactaagctcttcgacaataattgcctgcctgcaccagactctacgtatggaactcgaaatggtcaggttttactgtacgaccaaatttttactagaactaccggatttcctgtacattattgctgctgttattattcggaccacactagcctactaaaaaggaacacttccaataatgtaatcttgcgcaccttt

SEQ ID NO: 55631 - DNA, 151 bp, Zea mays
  Clone ID: LIB3068-058-Q1-K1-B5
aaaaaaaaaaaaaaaaaaaaataaaaaataaaaaaaaaaaaaaaaaaaaaaaaagaaaaagaaaaaataaaaaaaaaaaaaaaaaaaaaaaaaaaaaaaaaaaataaaaaaaaaaaaaaaaaaaaaaaaaattaaaaactataaatttttt

SEQ ID NO: 55632 - DNA, 434 bp, Zea mays
  Clone ID: LIB3068-058-Q1-K1-B7
cgagacagtgaccaatgatgagatcgctgctgacctgaaggagcatgtcatcgggcctggcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatcccctgacaggagatccttaagattgtcaaggagaactttgatt

SEQ ID NO: 55633 - DNA, 433 bp, Zea mays
  Clone ID: LIB3068-058-Q1-K1-B8
ccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaagcggcgggatctcttggtctgcagtcctgcttcacctc

SEQ ID NO: 55634 - DNA, 431 bp, Zea mays
  Clone ID: LIB3068-058-Q1-K1-C12
gtgagtgcttaaactgcttgcaggtttggctagtagacagcatcgacgacgaggaacagaagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgagaaagcatggtcagctgctattaggcacggattcgttcctttgacgaaagcctgaaagcctgtacgcaactctagacgccattcgacgatggctggaaaactacgtttcagcaatcggtagcacatattc

SEQ ID NO: 55635 - DNA, 358 bp, Zea mays
  Clone ID: LIB3068-058-Q1-K1-C3
gcggcagcaaacaagcaagcaagcaatggagatagaatcggtcaagtgcgagtgctgtggccggaaggaggactgcaccccgcactacattgccagcgtgagatcaggcttccatggccaatggttgtgtgggctgtgctgtgaggcggtcagagatgaagcatgcaggaggaaggctcaccatggagtagaggaggctgtgagggctcacatggcgttctgcaacatgttcaagttgaaccccgccgtccgcgtggccgacggcatgcgccagatgctccggaggcggtccggtgatatgtcaaagccagaatcgggcaagaagtacgaatcatcagtgacactgtattgaagagtt

SEQ ID NO: 55636 - DNA, 265 bp, Zea mays
  Clone ID: LIB3068-058-Q1-K1-C7
ctcctccactccactcccaagttccgactacccctaaccgcgtctctccactggggcgcgggcttcgcttcggctccgctcggctcgagcagaataaaatgcaactggcagtgcaggccgtcaggtcacacgtcaatgttcttaaatatgctgttctacaacacattagcgctcccaagccagaaatgcttcctgctgccttgactcgtttcatgtcactgtcatctgttcgcctagaggatcgtgttattgaaactgtcactga

SEQ ID NO: 55637 - DNA, 432 bp, Zea mays
  unsure at all n locations
  Clone ID: LIB3068-058-Q1-K1-C8
cccacgcgtccgatcgagtacgacccccaggcgaacaataagttcgacgtcgccatcaggctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgnttatatgctgtcacgcacagtgcgggacggccagtgttgcattat

SEQ ID NO: 55638 - DNA, 276 bp, Zea mays
  Clone ID: LIB3068-058-Q1-K1-C9
ccgcccttttgttccacacgatattgcttttctcgttgagctcatcttaggagacctgggttatcttttaacagatgtgccgccccagccaaactccccacctgacaatgtcttccgcctggatcggcccggctaggcctggccttggagccaaaaggaggggcggttcccctcttccgacccacggaatatttaaaataacgtttaaagtattgtgtatttacttgctcccggaggctcctacttattctacacctttcatgtctatatcacaaa

SEQ ID NO: 55639 - DNA, 323 bp, Zea mays
  Clone ID: LIB3068-058-Q1-K1-D1
ctcagttcaaggctaaatgcatgctagagacctattgcgaacaagtactgtaagggaaagatgaaaaggactttgaaaagagagtcaaagagcgctagaaattgccgggagggaatcggatggtggcatggttacgcgcaccgtccgtatgcgtaacggatcctgctggtccggcgatcgggtcagggcgtgtacagctgtcgcccgtgcccgtggacaaagcccgtgggtgctaagcacacacggcagacgaacttgcgcggactgtatccgcgcgcctgttgcgagcccctcggagcactgcgctgcaacaggctgctagc

SEQ ID NO: 55640 - DNA, 425 bp, Zea mays
  unsure at all n locations
  Clone ID: LIB3068-058-Q1-K1-D10
gcccaagctaatgcagcatggatttagtgatgccattgcaaaagtaggtttggcaaagtgtgtcagtgacctattcttggttggactgttctaccatctgtataaccagattgctacaaacaccttggagcgagtggctcctctgacacatgctgtcggcaatgtgttgaaacgtgttttcgtcatcggtttctcaatcattgtttttggcaacaaaattagcacacaaactggaattggcacgtccattgccatagctggtgttgctatgtactcttacattaaggctaagattgaagaggagaaaaggaaaaagagcgcatgactgctgtgaataatattatcaggaccttcctcggacacaacatcgtcgacaatcacgacctacttctatacnncttgtttgtttcatcttgagtcagtcg

SEQ ID NO: 55641 - DNA, 386 bp, Zea mays
  Clone ID: LIB3068-058-Q1-K1-A8
tcatacgctcactcgtggtctgacacatacccgaacttcacattccaaaccctactctggaacatggtgaacttttaacagagcttgatcttatgctaactcctccatcaatatcaccattttccacaccaaacacacattaaaccatgcattcactccactactccagattaatctttcacacatgctctaaaacatacttacttgcactccgcccatcctacattattcttttctcttaatactcctctatccatctattatctacttccttcaacccttttcataacaacctttttacatcacaaaaactcaatcctattaatccaatcattatacacaataccttcactacaactactaatctattattacactaataatat

SEQ ID NO: 55642 - DNA, 443 bp, Zea mays
  Clone ID: LIB3068-058-Q1-K1-D11
tggaggagggctttagcgatggtcctgttcatggctggcgccgcgctgctcggcggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacct

SEQ ID NO: 55643 - DNA, 243 bp, Zea mays
  Clone ID: LIB3068-058-Q1-K1-D12
cccacgcgtccgcctaaagctagcaaagtccatatggttgctgcacaggttggcgtactgcttcgacccaaaggcaaaggtgtttcaagtgaaaaaggggagtgaattttcggatatccacatggagagcgtcgtgaagaacatcatcctagaagaaggtgcggagaggccaaaagtcggcctgatggtgatgcctggtttcctgatcgggaccagcgtcatacagtcccgtgtgtacctttc

SEQ ID NO: 55644 - DNA, 390 bp, Zea mays
  unsure at all n locations
  Clone ID: LIB3068-057-Q1-K1-G6
ccgacacctaagccgaccccgcctacgtacactccaagccctaagccaccgggtaccaagcctcccacgcccaagccgaccccgccaacgtacaccccttcgccaaagccttcgacacccaagccgaccccgccgacgtacaccccttctcccaagcctccgacgcccaagccgaccccgccgacgtacactccaagccccaagcctnccacacacccgacgcccaagccgaccccaccgacgtacaccccttccccaaagcctncgacgcccaagccgaccccaccgacgtacaccccttacccaaagcctncgacacccaagccgaccccaccgacgtacactcccacaccgaagccgccggccaccaagccgtccacctacactccg

SEQ ID NO: 55645 - DNA, 345 bp, Zea mays
  Clone ID: LIB3068-057-Q1-K1-G7
cacacgcgtcgttgcgaagggagctgggaagcgagctgccacgccgcctggcgcggccggtctgacccaatggctcagccaatggcaccgcgaactgcctaacgaacgtcctaacgtgcgtcgagcagagccgccagctgatacctcggatgctgacttagatgctgacagacatgatccgacacacagtagcttacacccactgtctttgcaactaagtgcgatgaccaactctatgactaaacgggtgatttaacactaggtcgaattactatcggaatgactatatcagtacggtcatactaacctgtatcacgacctgcttaacgcaggtcacgatccata

SEQ ID NO: 55646 - DNA, 164 bp, Zea mays
  Clone ID: LIB3068-057-Q1-K1-H10
cccacgcgtccgcccacgcgtccgctccgctgggccaccagctttgaccgccgcctcccgtcccctgcgctactgctcctcctcaccccactcccccgcaggagcggcggcggcggcggcgaggtcgtaccccacatcggcgagcggcggcggcaccgccggag

SEQ ID NO: 55647 - DNA, 440 bp, Zea mays
  unsure at all n locations
  Clone ID: LIB3068-057-Q1-K1-H11
gcccacgcgtcgcccacgcgtccgcccacgcgtccgcagtgccactcgatcagtagtggtggcagctggcggctggcctgggacgacgatgagcgccaagaccagagctggggccgcccatgtacgccggcagctcgtcgcggccgtggcggtgacggtggcatgcttctactcctcggaggcgacgcagctgcaggtggggtactacaacggcagctgcccggccgccgagagcctcatcgagaccatcgtccacgccgccgtccgcaaggacgccggcaacgggccgggcctgatccggctcttcttccacgactgcttcgtcaggggatgcgacgcgtcggtgctgctggacgacccgacgggcagcccggggaacaggacggtggagaagacgtncccgcccaacttccctagcctgcgcgggttcagcgtgatca

SEQ ID NO: 55648 - DNA, 410 bp, Zea mays
  Clone ID: LIB3068-057-Q1-K1-H12
cccacgcgtccgcccacgcgtccgcaccagtgcctccaccgaatcttcaacaggcaaaggcaatcaataatcaccagccacatcaatccattccctttcctctcccgctccacttccatgggcaaggttcggtccttcttctcccgctcccgcagcggcaagcgcggcagcgcccggagggcaggctcgtcctcgccgcactcctccgcggcgagcgcgccgccgtccccgtccccactcccactcccgaggaggtcgccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcat

SEQ ID NO: 55649 - DNA, 443 bp, Zea mays
  unsure at all n locations
  Clone ID: LIB3068-057-Q1-K1-H4
gtgagtgagagagagacagagagatcatcgatcgatcgacgaccatggcgaggcaacggcaagttgcttccatgcttgcagctgctctgctcgttgcaacgacgtttgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcgggcctactaccccgncgtcggcatcaagtacgtcgcggtgggcaacgaggtgcanggcgacgacacgcgc

SEQ ID NO: 55650 - DNA, 426 bp, Zea mays
  Clone ID: LIB3068-057-Q1-K1-H7
tcataattcatataatgagcttgtagcacaaaagctggtggacatgaagaacagccaggttactataacggtcaatggcgatgaaattcatatggatcagttagggaatgttgatgaccgtaaaaaatctggggttcaggcattgcaaataagatcttgctcccagtgtgccattttggagtctggtgtgttaaggcagcctatgcggtcaaggggactgcttgctcggccttatattcattcaatgcttgctatagcagcagtctgcgtatgcgtctgtgtattcatgcgagctttgctgcggatcaattctggaaaatccttcaagtgggagaagctggattacggtacaatataattgtggggacacacctgagccttgtggtattattaagttaacaagcaagttgtatggagctattttgg

SEQ ID NO: 55651 - DNA, 416 bp, Zea mays
  Clone ID: LIB3068-057-Q1-K1-H8
gtggagaccaaggtcacggcctggcagacggccgaggtcgccaagatcaacaaccgctgcaagagggaggatgtggtcatcaacggctgggagaccgagcaggtggagaaggcctccgcgtggctcaagaagatcgagaggaagctggacgagcagcgcgccaaggcgctggagaagacgcagaacgacatcgccaaggcgcggcgcaaggcggaggagaagcgggcgtcggcggaggccaagcggggcctcaagctggccaaggtgctggagctagccaacttcatgaaggccgtcggcagggtgcccaccaagcgctccttcttctagccagccgactacccctgccaccttcgtctctccctgcctgcgtgtgatcgatgtacgctcgctgctgcatccgagaacctaactgt

SEQ ID NO: 55652 - DNA, 295 bp, Zea mays
  Clone ID: LIB3068-057-Q1-K1-H9
acgcccacgcgtccgcccacgcgttcgaaaatataaaaaaaaaaaaaaaaaaaaaaaaaaaaaagaaaaagtaaaaaaaaaaaaaaaataaaaaaaaaaaaaaaaaaaaaaaaaaaaaaaaaaataaaaaaatacttaatttaataaaaaaaaaatttaatttaatagttattttatttaaacacctaaatataataaaatcctaaaatttctaaaattaactgcctttaaaaacattaccattacccaatttaatcttttattaaaacattcttaattaataaacttttttaat

SEQ ID NO: 55653 - DNA, 340 bp, Zea mays
  Clone ID: LIB3068-058-Q1-K1-A1
ctcgcgggctgccaggacctggagtggagtgagtgagccggtggcggccttggattctgggctctgctctccctcgccggcgtgctttacgatcgtggtgtgtgtaaggaactaacgacgacggtgcctggattaggagtttagctatagacgaaagcacgtacggccgcgtgcctggtctagctacgcggactggttgatcttgagcagttaagcgtgtacgaaacgacagctgtgtacgtgtgtactgtctgatggagtgtgagaagtactgtgtgtatctggtatggatccgatcgggctgatgtatgaacaggatgtttacggactatatatagat

SEQ ID NO: 55654 - DNA, 290 bp, Zea mays
  Clone ID: LIB3068-058-Q1-K1-A10
cccacgcgtccggtgcctctcatagccgagtaagttggatcttgaggcaaaggaaataagtaaagatgcggtggcagcatcatactctatgcaagctaagagtgacagctgtgtttcagtcacatatatgatctagtctgtgtgtcaatgtgtcgaaaaacatgtctgtgattttgttatatgaatgtaacgcgcaatgaaacatacaggactagctgcttgcttgacgatgcgtttgcgtgtatccgtataaattaaaggctataagccacatcgtatatgcgtactgc

SEQ ID NO: 55655 - DNA, 444 bp, Zea mays
  unsure at all n locations
  Clone ID: LIB3068-058-Q1-K1-A11
ggtttatctaggactggtgtacaaagaaaacttcacttggatcgtcagccagggcagaggagtacaaaaccgaccgagaacagcaataagctagctacaaatcgggtcccagcccggaacagcccagggaatcctgtacttaggcattcacgcagcttgcctgaaactggtcgacgagcagtacagaaggtctcatcaatcacagagaaactgtcgcaaatgtcggtgacctccagaacacgaagcgccgtgaagcctgccgtcccgacgatgaaggccggacatggcaagtcagacttcctggggaagtctgacgatatccctccggcaaagaggctgacgagaaaattggtcagctaaacaagggtacgtagagtgaaaatccgatcatctgcaggagggtggagggatatggtgtatagtgtgcangaaccagtgtgccga

SEQ ID NO: 55656 - DNA, 283 bp, Zea mays
  Clone ID: LIB3068-058-Q1-K1-A12
aaaaaaaaaaaaaaaaaaaaaaaaaaaaataaaaaaaaaaaaaaaaaaaaaaagaaaaaaagaaaaaaaaaaaaagaaaaaaaaaaaaaaaaaaaaaaaaaaaaaaaaaaaaaaaaaaggaaacatcatatataaatctatactttagttactctacattgaaacctaatatttattctttggctgtacttaaatcactttatgtgtcctaaattcttaaacatatgtattggaaaacctttgctttatcccaagttaatcctattgtacataatacctattt

SEQ ID NO: 55657 - DNA, 414 bp, Zea mays
  Clone ID: LIB3068-057-Q1-K1-G3
tgtaattgtaatcatcagatgtcttcttccttctcagtatatatgcgaaaatgatggagaagttaagcaaagtatctttatggcgtctggcagttcgcagtgagctgtactgtaggtgcttttgcttaagcgacaaccagtttgcagattggtcacctcttcctcctgtccctgatgacattgaggctgatgtttatgttcctgaagccgatatcctgtcagtcttagatgtgcctcctgggaaaatgggacgagttattggcagaaaggggtcaacgataatggctgtgaaagaatgttgcaaggttgaaatacatattggtggtgctaaggggcctccagacagggtgttcatcattggaccagagaaggaagtcaggaaagctgaggccatctttcgaggcccgatgctgg

SEQ ID NO: 55658 - DNA, 417 bp, Zea mays
  Clone ID: LIB3068-058-Q1-K1-A3
tcaagatgtcccatctgatttgcatagtattgatgcaaacatttctagtcaagatgtgagtctagagaactctggccaagcttgcgctcacgcaacggacggcatgacaagggagcttactcattttgttcatagtaatgctaatattttcgagagtaatgaggtccctgcttctgagattactggggtggaatataatcaaggtgcctctggttttcctcaaccaacggaggatgaaaatgcggtggggtataatcaagatgtctctggttttcctcgaccaacggaggatgaaaatgcggtagattataatcaagatgcctctggtttttctcgaccaacgggagatgttcaaagtgcctctgggtttcctcgaccaacggaagatgaaaatgtgggagattataatcaagatgc

SEQ ID NO: 55659 - DNA, 211 bp, Zea mays
  Clone ID: LIB3068-058-Q1-K1-A4
gcgtccacacgtccgactgtacaaaaaaaaaattaagataaaaattaaaaaaaaaaaataaaaggataattttaaaattaagaggattgtaaataaacaaaattaaaaaataaaatatttttaaaaatcattttattaatattaatgcttaaattttttaaaattatttttatttattattttaatttaaatttaatttaaatatttttaa

SEQ ID NO: 55660 - DNA, 416 bp, Zea mays
  Clone ID: LIB3068-058-Q1-K1-A5
cggacgcgtgggcggcgttcgacctgatgctcaagggggagagcctgcgctggatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattgtgcatgacaataatgagatactgtagatattaataatgttccagaccttcaaggcc

SEQ ID NO: 55661 - DNA, 402 bp, Zea mays
  Clone ID: LIB3068-057-Q1-K1-E3
cccacgcgtccgcccacgcgtccgctgagtcggagattgaaagggaatcggagtatttgaggaaggtaaagcttacactccactctaacggtatcatttacccttcgtcgctactccgctctctctccaattggcataatccttcactctcatttacttgtaccaattgaacaaaagtaaaaacgggctcaaagtctccgatttcggcaattaatgccaaaggagaagatattaagcccaaagcacaaaggaccgcaccaccatttcaaaaaatttcaaaataaagatttaatcgatgattttcacattggtatccacacaatggacatctcttcaattggtatctttaaaggtagattttcaaaattggaatccaattctctagaaggtcatctttaaaat

SEQ ID NO: 55662 - DNA, 391 bp, Zea mays
  Clone ID: LIB3068-057-Q1-K1-E4
cccacgcgtccgcccacgcgtccgcccacgcgtccggaataagataacacgaaatgggcgtggagcggtggcgagagtagcgtgtaccctccgtggcaagaggctggacggtggtgtatctgtgctctcggtttgcgtgaacttgatctggtcttaagaaccccggtggcgggttgacatatgcaagggttaagtgctacatatgtcgtgtgattggagatcctcagttgagtataatcgattcggatcgccgtaccttcgcggttatgaagaattggtcacttccctgcaacctaaagtcaggatgtgaacactatggataaaaatgatgttgtattgatgaaatgttgaaattagactagatgcaaatagaggctattaatacttaata

SEQ ID NO: 55663 - DNA, 282 bp, Zea mays
  Clone ID: LIB3068-057-Q1-K1-E6
cgcgcgtcgacgaggtcccggagcccatgtaccgcccggagcccaccgaggtgcacaggtgaagccgagccacacatcgatctacaaagatgcatggacgacgactcttatcttagctaattaataagcactacatccatgcatgtccacaatagggccctagccctactatactatacgtcgtcagcagaaagtctggttttgatttcaataataagatgcacctatatgtgtgtgttacatgtacgccgttgtcttaattactgtgtggtgattggactc

SEQ ID NO: 55664 - DNA, 292 bp, Zea mays
  Clone ID: LIB3068-057-Q1-K1-E8
caattcccaattccaggcacgacgccacgcgtcccataaaaaaaactaaaactaataaaaagttaaaaacaacaaaacaaaaaaaaacagaaacagcataataaaaaaaactcatattaaaaaaaaaacataaacttaccatcaagagatctacaatgagtctcatcatcactgactactgcatgcccctacattacacgataccatcttctcaaacgcatgtaagggtcctcatatctcaaagacattccgatggtgatcatttcatcttataacctgcctttcccgatca

SEQ ID NO: 55665 - DNA, 449 bp, Zea mays
  Clone ID: LIB3068-057-Q1-K1-E9
agcgcacgcagcttctagaatctagaaggcaggagttggtcttcttggacaatgaaatagggttcaatgaggccatcattgaggagagggatcagggaatacaagagattcaacaccaaatcactgaagtaaatgaaatcttcaaagatcttgctgtgctagtccatgatcaaggagcaatgatagatgacattgattcccatatagagaatgctgttgtagcgacttcgcaggctaaaggtcagctttcaaaagctgccaagactcagaagtcgaactcttcgctgatatgcttgttattggttatcttcggcgtggtcctgctcatagtgataatagtacttgcagcataaaagcttggaaggcagctgaggttccgatgatcgagcttattgcgatgaattccttattattattttttttgctgtgcaaccaggaatgggatcctg

SEQ ID NO: 55666 - DNA, 389 bp, Zea mays
  Clone ID: LIB3068-057-Q1-K1-F1
cccacgcgtccgacgaaattgtggaaaatgaccttttcaagcaggattggcgatcaagaaagaaggagcagatattccagtatattgttctgaaatggtcattagttcttcttattggcctgtgtactggacttgttggcttcttcaataaccttgcagttgaaaacattgctgggttcaagttgttgcttacaagtgatctgatgctcaagcataggtacttcacagcatttctggcatatggaggttgcaatctagtcttggcagctgctgctgcagcgatctgcgcttacatagcacctgctgctgctgggtctggtatcccttgagttaaagcataccttaatggagttgatgcttatgctatattagctccaagcacactgttt

SEQ ID NO: 55667 - DNA, 431 bp, Zea mays
  Clone ID: LIB3068-057-Q1-K1-F11
cccacgcgtccgggcaaggcgaagcctgctccgaagaaggtggcgaagacatcgacctcgtctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggaactggtggacgg

SEQ ID NO: 55668 - DNA, 445 bp, Zea mays
  Clone ID: LIB3068-057-Q1-K1-F12
cccacgcgtccgtgcatcctgataatacattgtggcaatagctgtgtgctgcaccatgtgatgctgatatattgtatctgttatcctagatggtggccagtatcggagcacacagctgttgcatcctgataatacattgtggcaataccacgtggtgcacgccaatttctcctttccctgcatagctttattgacaattgatatgcttagccgtggggttctttatttatttgttgtagccttgcctcaaatgtcgattgggcagcttggctgacagattagtttttttttccctccctacgggcagatgcttgtttaaagacagcaattcttgtactccgtagctaagaatgaatgccatataaatgttgcagtagataagcatcaaggagtgtaagatgaagatggcagttcttttggtttatgagatgagatggtgctctaa

SEQ ID NO: 55669 - DNA, 374 bp, Zea mays
  Clone ID: LIB3068-057-Q1-K1-F2
cccacgcgtccgggcgctggagctgctggggctgagggacaacggcgcggaggacgcgtggccggcgtcatcctcctcctcatcttcgtcgtcgtcctcccctgaccatcaggagatcgacgtgagtctcatcatcactgactactgcatgcccggcatgacaggatacgatctgctcaagcgagtgaaggggtcctcatcgctcaaggacattccggtggtgatcatgtcgtctgagaacgtgcctgcccggatcagcaggtgcttgcaggatggcgcggaagagttcttcctgaagcccgtgaagccggccgacatgaagaagctcaagtcacacctgctgaagcggaagcagcccatgcagaagaacaagc

SEQ ID NO: 55670 - DNA, 390 bp, Zea mays
  unsure at all n locations
  Clone ID: LIB3068-057-Q1-K1-F4
cggacgcgtgggcgagtgactggggccaagttagccatccgggacaacgaggctgatcgcaaccgtaaaaacatcgagctcgagggaacatttgaccagatcaagcacgctagcgcaatggtcacagagttgattgtccgcatcagtggtaagccgcctccacaagccaagaacaacccaggtagggggcctggttctcatgccgggggtcctggaagcaacttcaaaaccaaattgtgcgagaacttcaacaaaggctcctgcacctttggagacaggtgccacttcgcccatggcgaaggtgagctgcgcaaacctgctgctgcttgacaggcatgctnattgtggcctgtggtgattaatctgcctgtatggctgaataacaccatg

SEQ ID NO: 55671 - DNA, 371 bp, Zea mays
  Clone ID: LIB3068-057-Q1-K1-F5
cccacgcgtccggtcttctccatccggtgttcgattgtgcgctgtcgcaacctctgtcgggactgccctttctcagtccgcttctacatctgcagtgagacgcgtattgaatctcatcgaatccatgggcagctactcgaataccaacacaagcggcggggccagcgacaaggaggacaagaacgaggacaaggtctaaggcaaggactcgtcgaagccatacttcaaggagaacgaatgggtcctcgcctaccactgccacgtcctctacgaggccaacgttcacaggatcgaagaccatgaatacgaatggcactactttggccattatctcagctggaataagaactgggatgaatgccttgcaaatg

SEQ ID NO: 55672 - DNA, 373 bp, Zea mays
  Clone ID: LIB3068-057-Q1-K1-F7
cccactcgtccgaacacacatacaaaatttaaaaaaaaaaaaaaaaaaaaaaaaaaaaaagaaaaaataaaaaaaaatataaataaaacatataaaataaaaaaacatataatatataataaaaaaaaaaaaaaaaaaactttttaaaaaaacaaaatttacttccctttttataaaacccaattttttttcttagggtaccttaaattaaatttttttatccggtattttacaattaatttaatttgaaaaacttttacattaccaaatttaataaacttttagaaattcccattttaaccactttgcaaaaaatccaattttcccaaactgattaatttttaaaaaatttcccaaccttaaattttaaaaa

SEQ ID NO: 55673 - DNA, 451 bp, Zea mays
  Clone ID: LIB3068-057-Q1-K1-F9
aaaagtactattggctttggtactagggttggaattggtgttgcagttgttatatttgggctagtgttcgcttttggggatttcctgccttatggaagtgttagccctagcaaagaaagtgcagtagttaaacaaaagctttctcaagaggaagaagaaaaatttaagaatgcactgcaaggctttcaagcaacgctgagtaagtcgcctaatgatcctactgctcttgagggtgcagcagtatcgttgtccgaactaggtgagtatgagaaggcatcaacattccttgagaagctaattaaggtaatccctgataaagcagaagcataccgtttgcttggtgaagtaaagtttgaactcaaggattatgaagggagttcatcatcatacagaaatgctttatcttcatcagataatattgattttgaagttctacgtggactgacaaatt

SEQ ID NO: 55674 - DNA, 426 bp, Zea mays
  Clone ID: LIB3068-057-Q1-K1-G10
cccacgcgtccgggaaacagtgggcgatgaaagcagagaatttgggaggtacatgcgacggagagaagagcaagagaagcaggaagaggagatgttcactcgggctcctgtaaccaaacgtgataagcagatcgagaagcgcataaggagacaacttcatgggctaggaggcttaactgacggtttcgaccttgggatgaacatgctgttgggaggagacaaggaagatgatggtggttcaagcaagtcacatggcaagagcggaaaccgaaagaagcacctgaagagcaacaagaagaggaagaggcattagccttggacccacactgctgtagcacttcaacataccgatacagcctagaagacggttcaagcaagccacacggaaagttgaagctggagaaaataccaagaaaccaagtagag

SEQ ID NO: 55675 - DNA, 442 bp, Zea mays
  Clone ID: LIB3068-057-Q1-K1-G11
cggacgcgtgggcggacgcgtgggcggacgcgtgggcggacgcgtggggtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgtccaaggagcacaagccgtccaaggagcacgggcccaagccggagaagcctgccaaggagcacaagccgacgcctgccacgtacaccccgagccccaaacccacgccgtcgacgtacactcccacccggacgccccccaagccgacgccacccacatacactcccggccctacgccccacaaacccacacctaaac

SEQ ID NO: 55676 - DNA, 408 bp, Zea mays
  Clone ID: LIB3068-057-Q1-K1-E12
gaatcccggtcgacgcacgcgtgcgccaaaatccagaccgctggtagaggtctcgtatcattgaacaacggctgcatggcggcgcctgcgccacctccatgcccctcgtctcggcgccctctgcatgcccgtccaagaagaccaccgtcgccaggttccggcgccgcacggcgacgtgcagggccagcagcggcggtggcggtggccgcggcggcgaaaatgatggcctcctttggctgccccggcgggacgtgatgctcaacggcctgtccagtgtcgccgccgggctcgcctggtacccgagcgtcgcgtccggcgcggatgctgtgtgcaccattgccgtacaggtgtacgagaagaccgtgcagtgcacacaccctggcgggcagcttccgtgccctctggtgt

SEQ ID NO: 55677 - DNA, 284 bp, Zea mays
  Clone ID: LIB3068-001-Q1-K1-E12
tcgcttcactccttgatataagtctgggaaaaaaaaaaaaacactaattagaaaaattgcatgcatcctaatgttcacagaaccattactcacaatgcttaaaatatgaaagcaccctacgtgcctatcaacagatgacgatgataaaatggtgtgtgtgcgtgtccgactctgcaaccgacagttgtgtccgactctgcaatctcatggactgtggcctgccaggctgttctatccatggaattctttgggcaagaatactggagtagatagccactccctta

SEQ ID NO: 55678 - DNA, 407 bp, Zea mays
  Clone ID: LIB3068-001-Q1-K1-E2
attatttcatatgatctccttctatcctttgtatatcattgaatattaggaaccaaggaatctgagtggtataaaggtcttctgtgctactaatacatgaaatagattgaaaactatgaagagactgccggatttgacaattagggaattttttgacagaattctcagtgagtgaagaagacagacctgactggaagtaattagagggtgaagtggctgtgacgtattggaaccaataatctttggttgctaaggtgagaaatttgacagtgaaatgaataagatacgtatgtttttgaatgtatgtcttttcttttaagcactagagactttcaatatttctgagaaagatggtgaccagagagcctcatcttgattcacctttgtgccttagatacttgtgtaat

SEQ ID NO: 55679 - DNA, 394 bp, Zea mays
  Clone ID: LIB3068-001-Q1-K1-E3
gcaagcaccttttcttatgataagcccctttcaggacgtccctagtgcatcggccactacagaatctgcctgcagtgcaggagacctgagttcgatccctgggttgggaagatcccctggaaaagggaaaggctacccactccggtgttcttgcctggagaatcccagggatgggggagcgtggtgggctgccgtctatggggtcgcacagagtcggacatgactgaaatgacttagtaacagcagccgcagcacccactccagaattctgtcctggagaattccatggactgtatagtccatggggtcccaaagagtcagacacgactgactttcactttccagtggttaagactctgcttccagtgcaagggactctggttcgatccctggt

SEQ ID NO: 55680 - DNA, 410 bp, Zea mays
  unsure at all n locations
  Clone ID: LIB3068-001-Q1-K1-E4
cgaagccatcccggttctcgtgcagagaggagcggacgtggaccagcagtggggcccgctgcaaaatacagctcttcatgaagcaactctgcttggccgggcaggaagggagtgcatcgctgccttactgggatgcaacgccagcgtccagaagaagaatgcgagaggccagacggcatacgacctggccctggaaagtggggatgagcccatcacctcgctctttgctgctaagcttggcctggatgaacgctaagcctgaaagccccacgggcatcattcagagaagtcacccagctccggctgtgctgtgttcgcttccttccaaatgcatattcgaggtttggaaatcgagcttgagagccactcataagatnttaaaaactatgtgacagtgtaagccacccatg

SEQ ID NO: 55681 - DNA, 372 bp, Zea mays
  Clone ID: LIB3068-001-Q1-K1-E6
ctgacgcgtggcctgctgtcaccttttaaagcacttcctttcctaaccgatcacagtggagcggtttcgatgcgggagctctggtacgtggcaggcgggcgtgcagctgggagtgtcccgtgtggtggacgctgctcacacaccttaggagcctgatcggcgcgtgcggagaagggacgcggagcggactcggccgggccttgttgggtcccgcgacggcgcatgcgcgcggggaccgcagctgctcactcgacgacctactttctacggagcccggccggagggctgatgccgcgctgctcatagcggcggctggacgttccgggagcctggcggtgaccgtggctattgctagagcgaaggttacaggtg

SEQ ID NO: 55682 - DNA, 422 bp, Zea mays
  unsure at all n locations
  Clone ID: LIB3068-001-Q1-K1-E7
ccaggctctcctccaacagggaggccggggggccatggaggggcgagggctacagtgtctgggttaatcagaggctccacagagcggctggccgtttggggggccagtgaagttaagagccagcccacctactggggacgggggcctggggcccaagtcgagtctcttggggaggacgtgcagggtgcctgcccggaggagggtggggcccctgagacagcttgcctgcctgcagatgcggctggggcggggcaacagggaaggcctgcggaggccaggctgtcggcctaccggcctnccaggagctgctcagatcccatcgtcatccgggcacgtggggacttttaactctggtgacagtttcagctacctttgggtcagggactgaaactggagagggtgggggggtgggttcttttatg

SEQ ID NO: 55683 - DNA, 409 bp, Zea mays
  Clone ID: LIB3068-001-Q1-K1-E8
catacgcatcgtctacttgcttgctatacctactgttgttcgtgctgatgaaacggcggacgctttctagcacgttcgacagtgctacaggcatgcacacgggtctgctgcgtcataagcaggaggaggacctgtacaatggcgtatgcataccaggtcctgtgtaggtgcctgtgctagactagcgcctcagctcgcaatggcatagatgctaccaatagcatcccaggtcgagatatgattctaaggagagcatgctgtatgagtgttggcagtcttagactagtgctgtacccctaactacgaacagggttcatggagatccgtgcattatcatcatagagcttggagactatgctgactgtacatgcacatagatgctttcaaacagtgccctcagagttttgtt

SEQ ID NO: 55684 - DNA, 282 bp, Zea mays
  Clone ID: LIB3068-001-Q1-K1-E9
tcgcatagccaccgtcaacatgctggggatacggaaggtgctgagcccctacgacctgacccaccgggggcggtactggggcaagttctacatgcctgagcgcgtgtagtgaggctcaagagcaggaatccgcgccttcgtgcccctgagccagtccttcgggtctttgggtacctctgatgtcataaccgaggagcagcatgtgaacagatgctctgaaaaactgtacgtcacctgtcggattcttttaagtacattatattaaagtttgagcgttagctc

SEQ ID NO: 55685 - DNA, 229 bp, Zea mays
  Clone ID: LIB3068-001-Q1-K1-F1
ctaacgcgttgcgttctagatctatagcgaatgtcccattacatattagtgatccaggaggctgatttgaccgcattagtcatcttctattattacctcactaaggctggagtcaattattctcttgctgactcagaattcaaggatcttacctaccttgaacttgattactttgtagaagacagactagattgtgatcactctacgacaaagaaatggctacaatgta

SEQ ID NO: 55686 - DNA, 202 bp, Zea mays
  Clone ID: LIB3068-001-Q1-K1-F10
aattactacttgatggtctcaagagacacgctaggtgctaatcaattacaacataagtgtccaagtgccactatttgtcccgttttctttgtgtatgctcttgtatataggatcacgtatattactttatcccagtctccttacgctgtaggtcattcctctggaaaaccacacagatgtagtcctcatgcagacaggccat

SEQ ID NO: 55687 - DNA, 262 bp, Zea mays
  Clone ID: LIB3068-001-Q1-K1-F11
cgtattgcatatctgttctgagttcttgattcctgcagcggacccagagtcttttggattctaagcttggccaagacgagcatagtagtcatcagaagatataactgaaggttcatctgaatggcactgtgctggtgcctgtattcgagcttggggagatgacatatttatgatggtaatacgtgaagcctatctctttggggggtgtacagctagtgggactgagagcagtgcaagacatagtaagagtgtctgagctgca

SEQ ID NO: 55688 - DNA, 352 bp, Zea mays
  Clone ID: LIB3068-001-Q1-K1-F12
tcgggcccactatggctccagtatttgacagccttgcttctctccccaaggttacaacctagtgtctgattcttccagctactccttggttacatcacagccagcttatggtcttcagcacttccaagagctgcaactccctccagcacttcttacctactctttcgctgccagctggagcttatgctcagctctgggcagtgctgatcacaacccttctgtgggggaaaagtgagttagagcatttggctccagttttggaaggcccctaccttacccataattctgaaggctcctgtagatctagaaccctccaatatcatcacctatctggctgcaagggtcataattt

SEQ ID NO: 55689 - DNA, 342 bp, Zea mays
  Clone ID: LIB3068-001-Q1-K1-F5
ctaaacgatcgccagcctcttatctatttcttatgtgcttagttagtagtacccaatgctccactcacgacagtgctgaacgtctactgatatcatgctaggcgctctacgactgtcaatcattctaactcgatgctgtatgtcatgatcataacctgaatcctctgagttacttctaagatcgtatctgagagggtaccgtcgacttgaagcatacgaataatcttgagcacaagaacggcagtgccttagtactttcgaaaagacttactgctcatctacaaatagatgctgcctaaataaagatcttaacagatgactttcagtattgaggatccatga

SEQ ID NO: 55690 - DNA, 323 bp, Zea mays
  Clone ID: LIB3068-001-Q1-K1-F6
catacccatcggctgctggctcgatattcctacgctgataagcaattactacacgaggcacctaaggtctaacggtgctacgtaatatgttcacttgcacgtgtatcgagtgtcatgtaacctaaactcagcgttgatagccatacatcatatcagatggatgaaggttacctgtcatatagtaccctagcatctaacctagaacagatgcaatgaataccttgccgcaccatgtctgactgacttaccacgattataccagagctctgatgcgactgttcataatggcactgacaccaaataatgaagcccagatctgtata

SEQ ID NO: 55691 - DNA, 189 bp, Zea mays
  Clone ID: LIB3068-001-Q1-K1-F7
attatagatcgccagctgcacacctattcctacggtggtttgcaattactacacaagcaaaacttggtcgcactgcactacgttagatatgaggctgcgcgtgtattgcgtgataatgatgttagtatgaggcattactgtgatgttcaaaatctgtaacctgagagttacctgtgagataatacctga

SEQ ID NO: 55692 - DNA, 416 bp, Zea mays
  Clone ID: LIB3068-001-Q1-K1-E11
cggacgcgtgggttgcttttcccctataccgaccctcataaagacaaaccaaaccacgagagcaacctattacaaacctaccagaagggaaacgtggcagcagaagctaatggagaagaacccaaggcaagctggcccagacatttagccatgcaccattctgttaccttgcgagtctgataataaacttgctgctgacctgctgtgctcacagtagattctaaactggactaattattgtggggttttaatgagaagcctaagtttggaaatccttaagcagtgatgttgaaaaaaaaaatgaagccctgaacagtttaaaggtaacaatcctgtttctagaaagagaaagctgatggcaaaggcacattccaagtgacccgaatccaggtgcccccatcctgcaataggcagtc

SEQ ID NO: 55693 - DNA, 352 bp, Zea mays
  Clone ID: LIB3068-001-Q1-K1-F8
catatacatcggcagcttgctcgcgataccgacggtgctgagcccttactacatgacccaccttaggcgttactggggcacgttatacatgcctgagcgcgtgtatcgaggctcatgtgcaggaatctgcgccttagtgcccattgaccagatcttcaggttttagggtacctgtgatgtcataaccgaggagctgcatgtgaacagatgctctgaataactgtacgtaacctgtcggattcttttaagctcattatattaaagtttgagcgttagctcaaaatgcactgacaccacaaaatggatcccagatcagtctaataggacggttattctatatggtccaagctta

SEQ ID NO: 55694 - DNA, 228 bp, Zea mays
  Clone ID: LIB3068-001-Q1-K1-C5
gtcaaagaccgccaactggaacttcataaagtatgtgctcagttattacggcacaagacagcggacgggaaactgagactcagtgttctgatgcttagaggagcgtgtaacagaggcatcatgcactatctatactagccagagacgaagcgagccaaatctctaggtcttggacgtacctatggcgtcgtatctgaattacataatccagagcagatgctaagaata

SEQ ID NO: 55695 - DNA, 328 bp, Zea mays
  Clone ID: LIB3068-001-Q1-K1-C6
attggctacgtggaaacatgtctgtgaaaagagtatgtagtggcttctttcaaattggtagatgctgaatatgttcacttttaaatcccaattctgtcccgatcttacagactctactgtacttgaatggttaataaaactgcacagtgctgttaaaaaaaataagaatacctatgatatcataaccgacgagcataaatgtgaacagatgctctgaataactagacttgaacatgacagattctattaaatacattaatataaaagtttgagcagaaccaacaaaatgaaataaaaggggctgccctttttaaggattcaaatttaa

SEQ ID NO: 55696 - DNA, 423 bp, Zea mays
  Clone ID: LIB3068-001-Q1-K1-C7
caagaccttctaccggaactcgcagctggttttccaccaaagaactcacagccgggagacgtacttccagtgccccacctgccaaaaggccttcctgcggagctccagcttcatgaagcaccagcggatccacacgggggagaagccctgcaagtgcgactactgcgggaagggcttcagcgacttctcggggctgcgctaccacaagaaaatccacacgggtgagaagccctacaagtgccccgtgtgtgagaagagcttcatccagaggtccaacttcaaccggcaccagagggtgcacacaggtgagaagccctacaagtgcacccgctgcggcaagagcttcagctggagctcgagcctcgacaagcatcagagatcccacctgggaaagaagccccgcccgtagccgggctctctgag

SEQ ID NO: 55697 - DNA, 411 bp, Zea mays
  Clone ID: LIB3068-001-Q1-K1-C9
atttggagccttgataagaatagcaggatgcttcacttcagcagtacatacacaaaaactggaaccatacagtaaagattttcacggcccttgaacaaggatgacacaaattcatgtagtgttctatgtatttacatgtggaataaaaaaaaaaaaaaactcatataaaaagagaacagatatgtggttaccagaggcgagaagtgggaggtaggagaattgggtgaaagtggtcaaagttacaaactttcagctaaaagataaataagtagtaaggatataatgtacaacatgatgactgtagttaacactattgtatacttgaaagttgctaagagcatacattccaaaagttcttacctcaagggaaaccaaaaactttataaccatataaggtgatggatgttaagt

SEQ ID NO: 55698 - DNA, 314 bp, Zea mays
  Clone ID: LIB3068-001-Q1-K1-D1
attatttaatatgatcttcatctatccttagtgtatcagtgcatcttaggaaccaaggaggatgactctagaaaggctttatgtgctacgtaatacatgacatagattgaaaactatgaagagactgccggatatgtcaactagggaattctacagacagaattgtaagtgagtgatgaagacagacctgactggaactaattagaggatgaagatggtgtcacgtattacataccaattatctatggttgatatggtgagaagtttgacagtgtaatgataaagatacatctgattttgaatgctaggatgta

SEQ ID NO: 55699 - DNA, 167 bp, Zea mays
  Clone ID: LIB3068-001-Q1-K1-D10
caccttgatcctctactggcatgaaaatcagacagtggttatccttttcgggagggggggtctttggtccatcggccacttgccacatgttgtctttcccttggctgctggctcctgtgggtcacactgcttcttatcctgaacacttgacatgttgagggcagaat

SEQ ID NO: 55700 - DNA, 403 bp, Zea mays
  Clone ID: LIB3068-001-Q1-K1-D11
cagactcgtggtctgctgactctcaggcactgcgcacatactccatgtatgtacttcggagattagcactgtgggtgctaggggagtgcataactggaacgtgaataacttcccatgtggcctagaataaagctgactcctatctcctgatatgaggttcagggtagcctgatgacctctagtacctccaactatgaggtctgggcagtgcaaccaagagcatggatcagaagagagctgtgaatagccacgcatgggtagtgccatctcccactgaggcttcagtcactgacatccctcattccatggcagttggatataatataaccttacagaatatgggatgtgttgatgatcctcagctagactgctaccttgcgcctctgttctcagactggggctg

SEQ ID NO: 55701 - DNA, 250 bp, Zea mays
  Clone ID: LIB3068-001-Q1-K1-D12
ctctaacgatgtctatggtgtttcagtttgctgagcctgactcactagtgtgactcagaagacggtgcaatgcagtcatcatgttagtggcctgtgagcaaggcatactgctcttgagcatttcaaagaaaggtcaacagagcctccattcttggatctgcaacttggtctctgtaagaggtcttctttaaatccaggacccaggataggaaaagggtttccctgacagtttacaggaaacctgcaggaa

SEQ ID NO: 55702 - DNA, 325 bp, Zea mays
  Clone ID: LIB3068-001-Q1-K1-D2
attaaacaaaagggacctaatctatctttagagtctctgcgcatcttaggaaactatgaggtatgtgacaagacaggcttcagaatgcgagtaatacatagcaaatgttgcaacctacaaacagcctatatgatatgtctacaagcggcttctacagctgaattccaagtaaatagatgacccaatccaataatggacctaagaactgaatggacattttttcacagatgacatacacatgactaacaaacacatggtaagatgctcaacatcacttattatcaagagaatgctgatcaagaccgctatgatgtaccatttcacg

SEQ ID NO: 55703 - DNA, 306 bp, Zea mays
  Clone ID: LIB3068-001-Q1-K1-D3
gacactcagatcgagcctggattatcgttcctatctatgaaaaacatctgcaacttagctgaaatgcaaaaggccggcttttgtgacagagaatacactaacaatacaatgcgctccactgctatctaattcatgtggtccgatcagctgattcacatatttaacgcgtatgggaatgacagtactagcattgtggtgcctggtatttatgtcacattacagaaggtacgacaaacataaaagctcttttacacgtgtgaagaagatgtcagaatattattgatggtaaatgctcataaaatggat

SEQ ID NO: 55704 - DNA, 162 bp, Zea mays
  Clone ID: LIB3068-001-Q1-K1-D4
atcactgatctcgatctagatatacatatattgtatcttacggtatcatggtacatggaggcttactgctagtactgagtcgatttctgcgattatagaattgttcgatacacatactatttgtctacttgatagttatacaatcattttaaaaactagacc

SEQ ID NO: 55705 - DNA, 272 bp, Zea mays
  Clone ID: LIB3068-001-Q1-K1-D5
gtcattcgccgccgactggaacttcatttagtgtgtggtcagctattaagttactaggaagatgacggcaaagcgtgatccaccttctgtgcttaaagagctctaacagtgtcacatacactatgtattctagatagatatgaaactgttttaatgaataaatattgtactatctatggtagagtagcttaaatactaatacacagatgatgctaagcatttcacaggcgtcatcgtcgggttaggaagtcacttactaggagtgccatgat

SEQ ID NO: 55706 - DNA, 426 bp, Zea mays
  Clone ID: LIB3068-001-Q1-K1-D6
gaggaagaggaggaggaggaagagagctcctctgagggcttggaggctgaggactgggcccagggtgtagtggaggctggtggcagcttcggaggttatggtgcccaggaggaggcccagtgccctactctccacttcctggaaggtgaggaggactctgagtcagacagtgaggaagaagaggaagatgatgaggaggaggatgaagatgacgaagatgatgaggaggatggtgatgaggtgcctgtacccagcttcggggaagccatggcttactttgctatggtcaagaggtacctcacctccttccccattgatgatcgtgtgcaaagccacatcctccacttggaacatgacctggttcacgtgaccagaaagaaccatgccaggcaggcacgagttaggggtcttggacatcaaagctga

SEQ ID NO: 55707 - DNA, 420 bp, Zea mays
  Clone ID: LIB3068-001-Q1-K1-D7
aaaaggaactggggttcagagtgattaggggtggggtgctcagggcttgccagctcagaggcagagctgaggtgaaacttcaggttgactgctctctgaagctgaattcttcctgtcctactacactccttctcatgaaatgagccctcgggaaggtctcagtgcgctgtgcatgctgatgacccagcccctgtgcacgaggccaattagctttgtagccagaggacaacaggtcaagccatagtgccgggggaggggaggggggcctgctacaggaaaaataagaagtgtgggtccccagttgggttaggatgtgtggctcttctcggaaacacgtagcatccctaagtcagagctttctgctacacttccggaagaggctcgagagctgaggctggggtccctctcccatgcccaggc

SEQ ID NO: 55708 - DNA, 368 bp, Zea mays
  Clone ID: LIB3068-001-Q1-K1-D9
catacccatcgtctgcatgcttgggatacagacggtgctaagccctttcgacacgacccagattaggcctttctgtggcaagttatacattacttagcacgtgaatcgaggctcatgtgcacgaatccgctccttactaccattaatccatatcttatggtctgaggttacctgtgatgtaataaccgaggagctgaacttgtacagatgctatgaataactggccgtaacctgtcggattctgttaacatcattacattagaacctgatcgttagctcataatgaactgacatcaaataatggaataacaaatctgtctaaagggaccgacgatgtatatggaccgagctaacgaacatcctgcttg

SEQ ID NO: 55709 - DNA, 341 bp, Zea mays
  Clone ID: LIB3068-001-Q1-K1-E10
cttgaatacaagaaaatggaaactgaacagccagaggaaacctttcccaacactgaaaccaatggcgaatttggtaaacgccctgctgaagatatggaagaggaacaagcttttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacgattggagaaattctgaagaaaatcatccctaccttgga

SEQ ID NO: 55710 - DNA, 430 bp, Zea mays
  unsure at all n locations
  Clone ID: LIB3068-001-Q1-K1-C4
gtgaaagagctagacgtcttcaggctaaaatgatgactaatttagttatggccaaggaccgtttacaactattagaaagtggagctgttccaaaaagaaaagatccgttaacacatgctagtaattcactgcctcgttcaaaaacagttatgaaaactggacccacaggtctttcaggccaccatagagcacctagttgcagtggtttatccatggtttctggcgtgagacaaggacctggttctgcagctgccactcataagagtacaccaaaaacaaatagaacaaataagccttctacccctacaactgctgctcgtaaaaagaaagacttgaagaattttaggaatgtggacagcaaccttgctaaccttataatgaatgaaattgtggacaatgggacagctgttaaatntgatgatatagctgg

SEQ ID NO: 55711 - DNA, 385 bp, Zea mays
  Clone ID: LIB3068-001-Q1-K1-A9
tcgactggatttggaaaggttctaaaaacaaatcacagcaacattctggatgatcctttcataagaggacacattggaaagcttttggggaacatcagaacacaagtgcttataaaattaaataagccttacacaaggattcatattccttttaatttctaaaggggttaaacttagatgtagctgatgtgaaagctgctgtgcattgctatgggatacactattcatgggccaatttgatcaagtcaaccagttccttggactggatcatcaaaagaggggtggtgcccgatatactggactagataaatggaccaaccaactaaattctctcaaccaggctgtagtcagtaaactggcttaacagagaacagcttttacagac

SEQ ID NO: 55712 - DNA, 422 bp, Zea mays
  Clone ID: LIB3068-001-Q1-K1-B1
cagggatccctaaggaggaggagttcaagctgatgtacgggatgctcttctctatccgctcttttgtcagcaagaggtccccgctagacatgaaggacggcttcctggccttccaaactagccgctacaaactccattactacgagacgcccactgggatcaaggttgtcatgaatacagacttgggcgtggggcccatcctagatgtgctgcaccacatctacagtgcgctggatgtggagctggtggtgaagaatcccctgtgcccgcttggccagactgtgcaaagtgagctcttacggtcccgactggactcctacgtccggtctctgcccttcttctctggccaagctggcttaaggaagccctctacctgacccctcataagaatccctgtctgcctggggcccaacttaacctgc

SEQ ID NO: 55713 - DNA, 388 bp, Zea mays
  Clone ID: LIB3068-001-Q1-K1-B10
ggatcatacacattgaccaagcaggattcattcctggaggcaagaacagttcaacatatgcataccaataaattcggtatgtcacactaacagaatgaaagataaaaatcatatgattatctcaataggtgcaggaaaagttttgacataatttaacatctgttcattataaaaagtctcaacaaaccagctggaggaaagagatgcacctcagtacataaaggaaggccacgtatatcaagccccccctaacgccatactcaaagatgaaggactaaggactgttcccccaggaccagaatcaagacatggatgcccactctcatcacttctagtcaacagcactggaagtccaaaccagagaaatcaggcatgataaataaaagtc

SEQ ID NO: 55714 - DNA, 268 bp, Zea mays
  Clone ID: LIB3068-001-Q1-K1-B11
cgacgccacatgccaccgcgacttcattaagaacatgatcacaggcacattccatgcggactgcgccgtgctgattgtggccgcatgagtgggtgagttcgaggcaggcatcttcaagaatgggcagacccgggagcacgcgctgctggcctacacgctgggcgtgaagcagctcatcgtgggggtgaacaagatggacttcacggagcccggctacagcgagaagcgctatgatgaaattgtcaaggaggtcagcgcctacattaag

SEQ ID NO: 55715 - DNA, 170 bp, Zea mays
  Clone ID: LIB3068-001-Q1-K1-B12
aaatattatttaacactgttatatgcatacacaaatatggccggtgatacaatctctggctggtggcctaatcggagaggggatgttacgtggccgacgctgtgaagcccatattgtaactgtgcaagcctacgccgttcaagcctatggtggaagcacgtaggaagagt

SEQ ID NO: 55716 - DNA, 317 bp, Zea mays
  Clone ID: LIB3068-001-Q1-K1-B2
cggacgcgtgggttcttatgtcagcaaagatgttaagttttactagataagcagaaaagataaatctcaaatgcagtgctatttactcttttcaaaacagttttcattttcttaagcacactgtacatttctgtagaacctgcattttttcttgcacgctaaaaacggtacttgcgtctggtgaattactgctgacagtttccacagaaaccctgtttcagtggaccaacattgtggcatggcagctaatgccagcattttggggaatagcagctaatctacaagtgaccttggttggttaactatgtttgtttgat

SEQ ID NO: 55717 - DNA, 346 bp, Zea mays
  Clone ID: LIB3068-001-Q1-K1-B3
gctccttagaaatgcttaattcttatttcttaatccttaattcttatttccataaggcttagaaggaactctacaaattctaagtaactggctattattaataagagtaaaaaatctactatacttcaataaaatattttaagacaaaaaataggaagttgcatggtatagccgagttgactcactaaaattttatttacataatttttctaatatgaaaattacttgttttcagccccccttcacaattgtattttaaattaaggttattaatgttttaacctagatcatataatggtaaattaattttttaaatttgatatccgtactgaacttggaaaaactg

SEQ ID NO: 55718 - DNA, 393 bp, Zea mays
  unsure at all n locations
  Clone ID: LIB3068-001-Q1-K1-B4
gccacgcaccccaccgtcttccccgtcaccatcatgttcgccatgaagtgcttgtcgctgctcaagttcctcatggacctcggctgcaacggcgagccctgcttctcgtgtctgtaccgcaacggcccgtacccgcccgccccgccgccctccaacaggttcaatgatgcgcccgcctcggacaaggcgcccagcgcggtccagttctgcgagttcctgtctgccccggacgtgagccgctgggcagggcccatcatcgatgtactcttggactacgtgggcaacgtgcagctctgctcgcggctgaaggagcatattgacagcttcgaggactgggctgtcattaaagagaaagcagaacctncaagacccctggctcatctgtgccggctg

SEQ ID NO: 55719 - DNA, 212 bp, Zea mays
  Clone ID: LIB3068-001-Q1-K1-B5
accttcgtagacccctgggttctagatccttagctttcaccctttgctaatacttattcgaggtgatttttttgcaaccaaacaagtaataaatattatttagcacttttatctatttacaaatatacaacagcttatacactctctgcaaggggcagcaatcagagaggtgatgttacctgtcctacgctttgaagcccttattgaaactc

SEQ ID NO: 55720 - DNA, 399 bp, Zea mays
  Clone ID: LIB3068-001-Q1-K1-B6
caccgagggggtgggctgggtagaggcggttaggatggagaggtgtgagtgcgtggccaggaggctgttggcccagggtgggggagaagtgaccagcgctctctgggtcttcccagggacagctggagagcagtgaaaccctcccctgcatgtgttcgtggctccgcgcagccaggcctcgccttggctcctctccagatcctacagcagggccaggactagggcctggcgagcagagcctctgggctggctgctggccctggcactcagctcctggcttcagggaagcacacagcagtggacggactgtcccaggagcacaggggtgatgcaacccacagctgagaagtgccttaatgctgggaggctgaaaagtgggggtggctcacagtcctggcc

SEQ ID NO: 55721 - DNA, 411 bp, Zea mays
  unsure at all n locations
  Clone ID: LIB3068-001-Q1-K1-B7
cttacatcgaccgcctaagagtcgcgctgtaagaagtaacaacctcttctctccgccatctgctcggcagccgcgaaacagcaactatgcgtgagtgcatctccatccacgttggccaggctggtgtccagatcggcaatgcctgctgggagctctactgcctggaacacggcattcagcccgatggccagatgccaagtgacaagactattgggggaggagacgactccttcaacaccttcttcagtgagacaggggctggcaagcatgtgcccagggcagtgtttgtagacctggaacccacagtcattgatgaggttcgcactggcacctaccgccagctcttccaccctgagcagctcatcacaggcaaagaagatgctgccaataactatgcccggngtcactaca

SEQ ID NO: 55722 - DNA, 403 bp, Zea mays
  Clone ID: LIB3068-001-Q1-K1-B8
cgcggagcgaacccgaccgaccgccgcccccagccaggattaattggcttcttccgtgaaagggggactcatcttcttgggagcccgaggggctttcaaggcgccatgctgctactgctgctgggcctgctgagcccggcggcctacggggctccgggaccggccccggggtccgcggagctgcgctcggacttctcggcggcgcgcaccaccccgctggagggcacgtcggagatggcggtgaccttcgacaaggtgtacgtgaacgtcgggggcgacttcgacccggccaccggccagttccgctgccgcgtgccgggcgcctacttcttatccttcactgcgggcaaggcgccgcacaagagcctgtccgtgatgctggtgcgcaaccgctacgaggtgc

SEQ ID NO: 55723 - DNA, 423 bp, Zea mays
  Clone ID: LIB3068-001-Q1-K1-C1
actgaaggcacttaaatgttgtattttatgtcataaaagggcaaacatgttaaaaacagataggtccttttatcaggatcatcattttacagaattggaaattggagccctgaaaggttcagtgatttgcctgaggagatcacagctgggaagtgatggagtgagggttcagactgtcttccttgtccatgcacttatccattgcctctactgtatcgcatgtgagtgtgcatgtgtgtataaaaatgtgcttctgattgcctgtaggagggttcacacgttgcagagcattagttctaggtagtgttaacagtttgctgcggccctttctgttaagtttcataggtgtgcacacatacatgagcaatagtgggatcatgctgtatatccagtttggatctttttgcactttgattggatatc

SEQ ID NO: 55724 - DNA, 417 bp, Zea mays
  Clone ID: LIB3068-001-Q1-K1-C11
atttttatttaatctgtgtagtgttcaaaaaacatcattttgaaatagttacaaatatctaaaaatggaaatctttaatacaaactctgagtttctggcttttttaggaaagttaaataatctgaaatattggttctgcattagagctgagattaagtcgttaactttctcctctgtgttggatatatagttttcagtgtgcctgagtcctacatttcagtttgtgatatatagtcagactgagtgagttgatctcttgatatttcttttggttctacaatttaaatattcttgaattagaatttaatttttctctctagaaaagcattttctatactttgctctgtagaacaatgcttctacaaaagggtaacagatgacaaggtcttgacggtcaaataaaattggaaatgctga

SEQ ID NO: 55725 - DNA, 396 bp, Zea mays
  Clone ID: LIB3068-001-Q1-K1-C12
tttttgtatttcatttagacccaagaacatgctgatcatgtattcaatatgtatgctataaatgctatggtacctatgttgtatattattgtaaaattattacataattttagtaaatcatggggtgacgatttgattattacatttttagttttcagtaattaaaaagatttctgtgaattcttaaaaaaacaaaaagaaaatcattgaattactgttacctggcacaaatttgctataaaatctgcctgggtggatgacccgtatgcatgcattgggtttgagggctagttagccattccattgaacttccatttgaaagatatgagcaagctttgtcccaatccatcaagggagtctgtttccaaccactcatatacactgaattagaatatc

SEQ ID NO: 55726 - DNA, 78 bp, Zea mays
  Clone ID: LIB3068-001-Q1-K1-C2
aataatcagatgcgacctaatcaaacttacaagcctctgtgtaacataggatactacgggggtcacaaaaagtcagag

SEQ ID NO: 55727 - DNA, 387 bp, Zea mays
  Clone ID: LIB3068-001-Q1-K1-A8
agaaaactactacatacgggtgcacatcctaatcactactgagtatcacagagagattgatacttatataagagtcctagagtatgcaactggtgaaaccagaggctacaatccagtattactgatacgagacatgtatgattctccactgttgtacatgtatgagcttggagtactgtatactttaacacactcaatactaggtagtggagagtacactgatgtacatcctaaatgcaccactctgttaacattttagatgaaagtacaccgagctccgatataggctactccagataacgctgcttaattgacactcgtagcttatggtaaatagttcttaagaagttcaaggccactaataatgtatagtacaagtacgcgctt

SEQ ID NO: 55728 - DNA, 419 bp, Zea mays
  unsure at all n locations
  Clone ID: LIB3068-001-Q1-K1-C3
gtcaagaagcagcaattacaaccctgtacagaacaactggctggttcaggattgagaaaggagtacaacaagtctgtttatagtcatcctgtttatttaacttatatgcagagcacatcatgccaagttggatgagttacaagctggaatcaggattgcagggagaaatagcaacctcagacttgtggatgatatcactctaatgacagaaagcaaagaggaactaatgagacccttgatgaaggtaaaggaggagagtgaaaaagcccacttcagactcaatttgaaaaaaaaaaaacanaaaacaactaatatcaaggcatccggtcccatcgcttcatggcaaatagaaggggaaaaggtggaagcagtgacagatttcctcttcttaggctctaaaatcactggggattatgact

SEQ ID NO: 55729 - DNA, 475 bp, Zea mays
  Clone ID: LIB3068-048-Q1-K1-C6
atccaacccatcttcgtccgctccggccactcgtttcgccgccgtcggtcgccacccgcagggtttggaggataagattcgggagggatggcttccggtgggcagccgcagttccggtccacgcagccgccgtcgaaggtgctccacctgcggaatctgccgtgggactgcactccaaaggagctggtcgagctggggacccccttcggcaaggtcgtcaacaccaagtgcggcgtcggcgccaaccgcaatcaggcttatatcaaattcggagcccaaaataaagctattgccatgatatcatattatgcatcgtcaacagagccagcacaggtaagagggaaaaatgtgcaccttcagtactcaaatacacaggatatggcaacaacaaggcaactggagaaggttcaggcaacgtttttcttgtgggaatggatggtgttgcaccaaattctgtcagcattgatgttctaca

SEQ ID NO: 55730 - DNA, 365 bp, Zea mays
  Clone ID: LIB3068-048-Q1-K1-C7
gccagggccgtttccgaggacacgtcggactccggcggcgactagctcatcgaagacctcagggcaaagtgggacgccgttgaggacaagcccaccgtcctcctgtacggcggcggctccatcctggcgctatggttgacgttcgatgttgtcagcgccatcaacgccttgcctctgctccccaagatcctggagctcgttggcctcggctacaccggctggatcgtgtaccgctacctcctcttcaaggaaagcacgatagagctggtcgacgacattgagaccctcaagaaaaagattgctggaactgcagaataagcgctagctctcgtggaaagctttagaaccaacgactagaggggccg

SEQ ID NO: 55731 - DNA, 475 bp, Zea mays
  unsure at all n locations
  Clone ID: LIB3068-048-Q1-K1-C8
gaaaaaaaaaacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctgttatggaaagacaagaaaacttctgctgttgtaataggcggcgcaactgtcatctgggttctgttcgaagtgcttgattaccacctnctgaccctgatatcccatgtactgattggtgtgcttgccaccttattcctgtggtccaaagcaaccacg

SEQ ID NO: 55732 - DNA, 369 bp, Zea mays
  Clone ID: LIB3068-048-Q1-K1-D10
cgcggtgacgctgctcatccacaacccgggcgtggaggaggacccggcctgcggcccgctcatcgacggcgtcgccatccgtgcgctgtacccgcccgcgctcgccaggcgggcggggggaaacctgctcaagaacggcgggttcgaggagggcccctacttcctgcccggcgcgtcctggggcgtgctcgtcccgcccaacatcgaggacgaccactcgccgctccccgcctggatgatcgtctcgtccaaggccgtcaagtacgtggactccgcgcacttcgccgtgccccaaggcgcgcgcgccgtcgagctggtgggcggccgggagagcgcgctcgtgcaagaaggtgcgcaccgtgcccggtg

SEQ ID NO: 55733 - DNA, 379 bp, Zea mays
  Clone ID: LIB3068-048-Q1-K1-D11
gacccacgcgtccgcggacgcgtgggcagctgtcgatccaattgtcacttgcgctccctccaacaagctaattaaggccggtccatccctcttctagctcgtttcattatccatggctgatgagaagcaccaccaccaccacctgttccaccacacgaaggacgaggagcaggccgcggccggcgggtaccgcgagtccgacgagtacacggaggccactgtgacagaggtcgcgtccacgggcgagaacgagtacgacgagtacaagaaggatgagaagcagcacaagcacaagcagcacctcggcgaggccggcgccatcgacggcggcgccttcgcactctacgagaagcactacgcgaaaaacgacccggagcac

SEQ ID NO: 55734 - DNA, 453 bp, Zea mays
  Clone ID: LIB3068-048-Q1-K1-D2
cgtcttcgcgccggccgcggcggaccgcccgctccccgtggtggtgtacttccacggcggcggcttcgcgctcttctccccggccatcgggcccttcaacggcgtgtgccgccgcctctgcgccgcgctcggcgccgtcgtggtgtccgtcaactaccgcctggccccggagcaccgctggcccgccgcctacgacgacggcgtcgacgcgctgcgcttcctcgacgcccgcggcggcgtcccgggcctggacgacggcgtgcccgtcgacctcggcacctgcttcctggccggggagagcgcgggcggaaacatcgtgcaccacgtcgccaaccgctgggcggcggcgtggcagccgtccgcgcgggcccttcgcgtcgcgggcgtcttccccgtgcagccctacttcggcggcgtggagcgcacgccgtcggagctggagctagagggcgt

SEQ ID NO: 55735 - DNA, 269 bp, Zea mays
  Clone ID: LIB3068-048-Q1-K1-D3
cccacgcgtccgcccacgcgtccggtgctagtggtgactacccagactgcactgaccaagcttatgaaaaggcagttgccgatggtgcggatgtcattgactgtcctgttcaagtgactaaagatggcatactgatatgcatgaactctgttgacctaatggatgttactactggtgcaaaatcacaatttgcttcgcaagtgactaccatcaacagtctgaaggctgggtctggagtctttaccttcaaccttacttgggatgatatt

SEQ ID NO: 55736 - DNA, 333 bp, Zea mays
  unsure at all n locations
  Clone ID: LIB3068-048-Q1-K1-D6
aaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttcgttcttccgccgncggccggtgcatggttcacgtactgtgtgttgtgctactacgatacgtactggcttcttgtgtgttgggttcttgttcttctctcgacagtgcaccttgcgcgccaacaataaaccgtggttggccatgaataaatagtactatgaagttattggc

SEQ ID NO: 55737 - DNA, 405 bp, Zea mays
  Clone ID: LIB3068-048-Q1-K1-E10
ggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaac

SEQ ID NO: 55738 - DNA, 432 bp, Zea mays
  unsure at all n locations
  Clone ID: LIB3068-048-Q1-K1-E11
ggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcctcgtcctcccaggagagctcgccaaacacgccgtctccgagggaaccaaggccgtcaccaagttcaccagcaattgagcagcctncagcgtccacggatttgttaggtctccccttcttacaagggttcttcgtcgtgtcctctacccctnccctccccgcctatgtatgtgctgtgaaatcgttgatgttctc

SEQ ID NO: 55739 - DNA, 186 bp, Zea mays
  Clone ID: LIB3068-048-Q1-K1-E12
gtcttccccggcctcgtcattcggatcacaccgtccaagcccaggtagatcggtggcgatccatcggtcgtcgtgaaccgaacagaatgccgtcgctgacttgctgcggtgtcgtcaagcaccccgtgatctgcatgccgagtacgtactacggtgtgcagactgcactgcacagggatcggagag

SEQ ID NO: 55740 - DNA, 477 bp, Zea mays
  Clone ID: LIB3068-048-Q1-K1-E3
ctcaagtcacagattgcagatagcaaagcaagctattgggaacgacgctccgacaaccaccgcacgcctcaggtttggctagtagacagcatcgacgacgaggaacagaagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgagaaagcatggtcagctgctattaggcacggattcgttcctttgacgaaagcctgaaagcctgtacgcaactctagacgccattcgacgatggctggaaaactacgtttcagcaatcggtagcacaaa

SEQ ID NO: 55741 - DNA, 485 bp, Zea mays
  unsure at all n locations
  Clone ID: LIB3068-048-Q1-K1-E4
ctcccactttactcctatccactgcggcctggacgcgtgcgagaggcttgaccaagcagcagcagcagcagcagcgatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgtgcgatcaaccggtacatcgccagcaagtacgcgtcggagggcacggacctgctccccgcgacggcgtcngcggcgaagctggaggtgtggctagaggtggagttccaccacttctacccgaacgcgtcgccgctggtgttccagctgctcgtgaggccgctcctgggcggcgcccacgacgcggctgtggtggacaagcacg

SEQ ID NO: 55742 - DNA, 492 bp, Zea mays
  Clone ID: LIB3068-048-Q1-K1-E5
gcgctcaagtcacagattgcagatagcaaagcatgctattgggaacgacgctccgacaaccaccagacgcgtgaggtttggctagtagacagcatcgacgacgaggaacagaagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgagaaagcatggtcagctgctattaggcactgattcgttcctttgacgaaagcctgaaagcctgtacgcaactctagacgccattcgacgatggctggaaaactacgtttcagcaatcggtagcacaaattcttcccagct

SEQ ID NO: 55743 - DNA, 487 bp, Zea mays
  unsure at all n locations
  Clone ID: LIB3068-048-Q1-K1-C2
gcacctgcgcgcctcgactggtagcccgaaccctagctagcaggtcggaggcgagagagcagccatggcgcggtgcctngcgctcgtctccctccttctcctcggcctcgcctccgccgcctccgttgccgatgcgcccttggtcgtcgcgcacaaaagggtttcgctctcccgcccaaagccgggcgtagagcgcgtcgccgtctccctggacctatacaaccagggatccgagactgcctatgatgtgtcacttaacgacgactctggcccaacacaagcttgagatcttgccactggagagaactcgacgacattgaaaaggcttgaccctggtgccactggtacacacacatatgtcctggagaccaaaacacagggcagtgtccagggttcaccatctattattacgtaccgtgttcccacaaagactgctcttcaggaggcctacttaactgccatcttcccactggatattctcgctgag

SEQ ID NO: 55744 - DNA, 452 bp, Zea mays
  Clone ID: LIB3068-047-Q1-K1-H12
cccacgcgtccgctgtcgatccaattgtcacttgctctccctccaacaagctaattaaggccggtccatccctcttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgtcacaagatcgaggaggaggtcgcggcggcggcggccgtcggctccggcggcttcgccttccacgagcaccacgagaagaag

SEQ ID NO: 55745 - DNA, 425 bp, Zea mays
  Clone ID: LIB3068-047-Q1-K1-H2
gccgtctcccacgattcgtttgtcttgcgacagctgggcgaccgtcgtcgccgccgcccgtctccaggtgcccaggtcttcgccggtccctttgccgccgacgagcaccagccaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaac

SEQ ID NO: 55746 - DNA, 384 bp, Zea mays
  Clone ID: LIB3068-047-Q1-K1-H7
cccacgcgtccgcccacgcgtccgcggacgcgtgggcatatatgatctagtctgtgtgtcggtgtgtcgaaaaacatgtctgtgattttgttatatgaatgtaacgcgcaatgaaacatacaggactagctgcttgcttgacgatgcgtttgcgtgtatccgtataaattaaaggctataagccacaataaaaaggattatgacttaaaagcgttcaagaaataaaaacacacaaaagaaaatataagccaatggcatttaaaaccaagcgcgatgaccaatttgtgtgaatcaacggaatcctctcgaactaggttgaaattactataaaggggcggccattttaaagggtcaaacttaactgtcttacgacggactatatta

SEQ ID NO: 55747 - DNA, 370 bp, Zea mays
  Clone ID: LIB3068-047-Q1-K1-H9
cccacgcgtccggttgagacaattttgttattggagctagagtgctgaattgaggagcgacatgaatatgcccaagagattagagagacggccaacctgagtatcttgctctgttgcggggttttgcctgcttatgaagctgtgtatggtgattctgttgttgtatgtttatgagtaggctctgactagcgaggatattctgagtgtagaacgtcgaatctagattttttgagggtctgatgttgtttgccattgtcggccggcatttttgtattgcttattgcgaggattttcgtttcttgacgcctgtttctagggacatcatgattggacatttggaatgcaaacaatttctttgtggtgttgggtt

SEQ ID NO: 55748 - DNA, 155 bp, Zea mays
  Clone ID: LIB3068-048-Q1-K1-A1
cccacgcgtccgcccacgcgtccgaatgaaacctatgtgaacattgaatatgaagcttctgagatgtttgatctgcacaatgttgtcatatctatacctctgcctgcagttcgggaggctccaagtgtcaaacagattgatggaaagtggaagtt

SEQ ID NO: 55749 - DNA, 429 bp, Zea mays
  Clone ID: LIB3068-048-Q1-K1-A11
ctatgacggaaatgtggtaggagaaaaggagattgacagcaggctaattcaggaaaatgatgtgatcaaagtagtcccaggtggaaaagttgcttctgatggattcgttatttggggccagagccatgtgaatgaaagcatgattactggagaatcacggccagtagcgaagaggaagggcgatactgtaattggaggaacagtgaatgagaatggtgtgctgcatgtccgggcaacatttgtcggatcagagactgcactggcacagatcgtaagactagttgagttcgcacaaatggcaaaagctcctgtccagaagttcgctgatcagatatctagagtctttgtcccactgggtatcgttctctctttgcttacttggcttgtgtggttcttagctgtgagattccatggttacccatacttatg

SEQ ID NO: 55750 - DNA, 99 bp, Zea mays
  Clone ID: LIB3068-048-Q1-K1-A4
cccacgcgtccgcccacgcgtccgcccacgcgtccgcccacgcgtccgcccacgcgtccgcccacgcgtgcgcccacgcgtccgctagttctagatcgc

SEQ ID NO: 55751 - DNA, 144 bp, Zea mays
  Clone ID: LIB3068-048-Q1-K1-A6
gcaaagcttagggcatatcatcatactgctcaaacaaaggccgataagcaacattattcaagtatgggtcttgacctatctaaaggtatcgttcgcaacaaccttgagtatggcttgttaaagccttcgttgagcaaagtgaaa

SEQ ID NO: 55752 - DNA, 84 bp, Zea mays
  Clone ID: LIB3068-048-Q1-K1-A7
aaaaaaaaaaaaaaaaaaaaaaaaaaaaaaataaaaaaaaaaaaaaaaaaaaaaaaaaaaaggaaaaaattataaaaaaaaaaa

SEQ ID NO: 55753 - DNA, 416 bp, Zea mays
  Clone ID: LIB3068-048-Q1-K1-B10
ctatgacggacatgtggtaggagaaaaggagattgacagcaggctaattcagaaaaatgatgtgatcaaagtagtcccaggtggaaaagttgcttctgatggattcgttatttggggccagagccatgtgaatgaaagcatgattactggagaatcacggccagtagcgaagaggaagggcgatactgtaattggaggaacagtgaatgagaatggtgtgctgcatgtccgggcaacatttgtcggatcagagactgcactggcacagatcgtaagactagttgagtccgcacaaatggcaaaagctcctgtccagaagttcgctgatcagatatctagagtctttgtcccactggttatcgatctctctttgcttacttggctagtgtggttcttagctgggagattccatggtt

SEQ ID NO: 55754 - DNA, 327 bp, Zea mays
  Clone ID: LIB3068-048-Q1-K1-B11
gcgtaaaaaacagaaagatgagaatgaaaaaatattaaagaaagaaaaacaagtaaaggctaaagaaaaaaaaaaatgctaaagctagtctttaaagataatcaagaacaaactgagaactgagacacaaacaaggggtgcaacggttttcaggattcgagatttcttgtcccatggttgaaagctttaaccatctatatcgggtcagttaaataagtgcaatggccttgtttttaaaaacctgttaatgggaaaaccctgggggtttccaaatttaatccccttgaaaaaaatcgccatttgccaggttgagaaattttgaaaaag

SEQ ID NO: 55755 - DNA, 477 bp, Zea mays
  unsure at all n locations
  Clone ID: LIB3068-048-Q1-K1-B2
cggacgcgtgggtggcgcgctccgatccaagagatggcggtgccgctgctgacaaagaagatcgtgaagaagcgggtcaagcagttcaagaagccccatcttgaccgctataagtgccttaagccaagctggcgccagccaaagggtattggactccgtgtcaggaagaagttcaagggatgcaccttgatgcccaacattggttacggctctgacaaatcaaccaggcactaccttcccaataagttcaagaagtttgtggtgcacaatgtctctgagctggagttgctcatgatgcancacagaacctactgtgccgagatcgcccacaacgtttcaaccaagaagcgcatggagattgttgaacgtgccgcgcagctcgacattgtggtcaccaacaagctcgccaggctccgcagccaggaggatgagtagtctggtttcttgtcataacggncaactagatcctgccattcc

SEQ ID NO: 55756 - DNA, 490 bp, Zea mays
  Clone ID: LIB3068-048-Q1-K1-B4
cccaggtctctaggcgactacgtgatgacctgctgaagatcaaatcagaggctcctcagcatgcatatctaggacagaaatcaaaccagccccggacaaatgagtttcatgaatacagtccagcaccagcaccagcacgtcgtcatctgaataacccagcccagtccttggactgcgagatctctgaacccccagctcatcagctcacaggcacaaaggagaacagtcttaaggtgaaactgctgcaagcaaggctagaggggcagcacgctcggctgagcgcgtcagtgttccccctgatcagcacaagaaggaagtgatgccactcgtgagcttccatgatttcgatccgcaacacagagttgcaattgtaagatagctgaatattgttagctcgaggcaattggactcggtgtgaatcctagatccagccgcgtatgttgtagatttgatctgctaactgtcagactagaatcgaatcaagatggac

SEQ ID NO: 55757 - DNA, 345 bp, Zea mays
  Clone ID: LIB3068-048-Q1-K1-B5
acaaagttctgtagatataaaaatataacatcgtccgcgctctggagagtctggatcctcctgaacctccaagcagcaagcgatgaatggaaggacgcaagcaattagcctgatggtgcaccttgctgtgccatggctctgccttgcttcttgggcagctctgctaccagcgctactagcatctggaaatgtgggtgcagcagcttcgacactgagagcagagtacatgaatttgaactttagcaccgcttcggcgacccccgacaagtacaagagctttatcgcttctgttcgtgctggcttggtgagcaaagcggggggcaacagcagcgggatccccgtgct

SEQ ID NO: 55758 - DNA, 352 bp, Zea mays
  Clone ID: LIB3068-048-Q1-K1-C10
gtatttggcacttgtcatcattggattcctgcatgggcttatcttcctaccggtccttttgagtttatgtggccctactacaaaatcggcgaagccaaaagaacaaagtcagccaccttcagcttcaagtgagcggacttgacaggattttatttgagttggacggttacatactaaaaaattgaaataggctagcttggtcggtgtgcgtccatgtgctgtcccagtggagcagcagcagtgaggtgtacagcatttgctgaatgtgaaagcagtcttacagatctgtagaaaatgttgtgtatatccatgttagcagccgaactgttatttggtgtacagtgctacacat

SEQ ID NO: 55759 - DNA, 446 bp, Zea mays
  Clone ID: LIB3068-047-Q1-K1-H11
gcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctggctccgcctcgtcaccggactcctcgtcggatgcgccctcgagcagcagctcctcggactagatagctagccgcttgaccgacgatctcgttctccatctacacggcgatcgagttctagctttgtcgacatgcaatgcaaaattccgattcttcgggaataatcaagccccaaaggaatgtgcctggatcactcactactagtaccttggttttatatatgttttctcttctgacgctct

SEQ ID NO: 55760 - DNA, 409 bp, Zea mays
  Clone ID: LIB3068-048-Q1-K1-C12
atgcactcagtgcgaaggctactcatgcatatgaggatgcaagaagaaaagttgcaaatgttgtcaacgcagctgatagcagagagattgttttcactcgtaatgctactgaagctattaatctggtagcctattcatggggactatctaacttgaaagaaggagatgaaattgttcttacagttgcagagcatcatagtgctattgttccatggcaatttgtttcccagaagactggtgccaccttaaaatatgttggattgactaaagaaaatgtcccagacattgagcagttaaaagggtttctgtcgaacaagacaaagatagttgttgttcatcatgtctcatatgttctaggttccatgcttcctatcgaggagattgtaacatggtcaaacagagttggagc

SEQ ID NO: 55761 - DNA, 284 bp, Zea mays
  unsure at all n locations
  Clone ID: LIB3068-047-Q1-K1-F1
ctcgtcgtcgcgccgcagtgagaggagggggaggcgatggatctcaacgaatgcgagaggagggggccggcggtgccggatccgctgtcgaggcaggggtcgatctactcgctcacgttcgacgagttccagaacacgctcggcgggatggggggagggcttggcaaggacttcggctccatgaacatggacgagctgctgcggagcatctggaccgccgaggagagccaggccatggcgtcngcttcggcctcggcctcggcctcggtgtccgcgctgggggc

SEQ ID NO: 55762 - DNA, 440 bp, Zea mays
  Clone ID: LIB3068-047-Q1-K1-F10
caagcaactgcaaagcagcaagctctactcttcttctgtactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaacaagtccggagacgacggctacgacagcgggtacaacagatcgggcaccaccaacgacgacgaata

SEQ ID NO: 55763 - DNA, 198 bp, Zea mays
  Clone ID: LIB3068-047-Q1-K1-F11
ctgagtttgatgagggtgaggaaggtgatgatggtgatgagtactagaagtatcctgatgcggtcatcgtcaggcttgtgtgctgctcttgtccccgttgtggtttgcaacacctgatgttgtaagactttctggttatgtccgccccgctttgccactgggttattaagaacgtcgttatggatggttgtctacact

SEQ ID NO: 55764 - DNA, 322 bp, Zea mays
  unsure at all n locations
  Clone ID: LIB3068-047-Q1-K1-F2
cccacgcgtccgcacgagcacaagaacgaaacgggcacacgcaactgataaaggcaaccaatattcaccgtcggaaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgncagcgccgggcggaggggctggcgcgcccggtgctcgcgctggtccaggcgcaancgacagcgccgncggatgacgacgacgacgccggccccgtgcacaagcgctcg

SEQ ID NO: 55765 - DNA, 269 bp, Zea mays
  Clone ID: LIB3068-047-Q1-K1-F3
gttggtggttcctcaactctggagtccgaagaactgctcccagctacactcagatcctgtgtagtggatctgtctggtctgctaagggtgccaaaccttattgtttggcaaggtgatgcgctagaagactctccatgcatatgctgctgttcagctaaagctgcgactgcacaagcaaatccaccagaagaagctgcttcagcggtcgttgtcatatcaccatcatcaaaaggccttgaaggaattgatgacggtgtagtgcttacaca

SEQ ID NO: 55766 - DNA, 383 bp, Zea mays
  Clone ID: LIB3068-047-Q1-K1-F4
gcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgccagcgcaggcgggggaaggaagctggtggcggaggccatgcgcaagtacgctgccccgcggtcgtcgcgcttccacggcgtcaccaggctcaagtggagcggcaagtacgaggcgcacctttgggacaaca

SEQ ID NO: 55767 - DNA, 231 bp, Zea mays
  Clone ID: LIB3068-047-Q1-K1-F7
gcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtcccc

SEQ ID NO: 55768 - DNA, 427 bp, Zea mays
  Clone ID: LIB3068-047-Q1-K1-F8
cccacgcgtccgcccacgcgtccgcccacgcgtccgcccacgcgtccggtgctccctccgctagttctcccatttccttccccacctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctcaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattatt

SEQ ID NO: 55769 - DNA, 425 bp, Zea mays
  Clone ID: LIB3068-047-Q1-K1-G1
cccacgcgtccgcggacgcgtgggcagatcctgattttgatttggatattcgagatgatgtccaagatgagtgttccaagtttggtgcagtgaagcatatttttgttgacaaaaatactgcaggctttgtgtatctgcagttcgatagcgtgactgcagcagcaaaggcccaaaatgcccttcacggaagatggttcgctgggaagatgattacagcgacatttatgtccgctctggagtacagtacgaagttcccaaacttgtgagcatatgcccggaagaagtggccagacctgcatagttcggttggagtattcgcaagtgcttgatcgttggatggtagacgaacaccttattgattgtatgacaggatagttgcagcaccgggcgtcactatcagtacaatgcttgatgtactttattta

SEQ ID NO: 55770 - DNA, 81 bp, Zea mays
  Clone ID: LIB3068-047-Q1-K1-G10
aaaaaaaaaaaaaaaaaaaaaaaaaaaaaaaataaaaaaaaaaaaaaaaaaaaaaaagaaaggggggacaatataaagagc

SEQ ID NO: 55771 - DNA, 451 bp, Zea mays
  Clone ID: LIB3068-047-Q1-K1-G12
attcctgatgctgatttggtaagatgactttcattgttcttcagcatttgctgcatacagagctttgattatcaatacagtagatttttcttgggtcttgaccatattcagagggaggtcacaaaagaccctctggctacaatttcagtgggtttgtcataggcttaatttttttattagcaaattgttctggacttgtgtcaccaagcatttttgtaagggtgagagtaataattattttgtaactagctaacatcaagcattttcttggcttcttcaacattttttcatctgttcttttctgatctgaaagctgcatgaattagtcctgcattcctatacaggcaatagttctgttacttcagctatataatttatatggcaaatacacgttacaaagttgcatttcttcacagccatatcttcatgagtcccgacatcgtcatgccat

SEQ ID NO: 55772 - DNA, 427 bp, Zea mays
  Clone ID: LIB3068-047-Q1-K1-G3
tctccccgcacttttctcctctcctcatctccttgccctcgacttccgcctgcaaaccccaggcccgcctccgtcccgtccacgcctccgcctcagcgtccacctcgccggagctgctcggcaagtccgcgctccgccgcatctccgacaagctccgtagcctcggctacctcgagaccgtctccgagccccccactccggccccgaacaagagcggggacgccccctcccccggcgagatattcgtgcccaccccggcccagcttccgcgccaccgcgtcggctccaccctagacccgagctgggccacgggcgacggtgaggctagctccacctcgcggcagcggcggaggggccgcgggcgcgatgcgtcggggtcaccttcggcgccgccgtccgcggcggagttggcgctaccgcgggacga

SEQ ID NO: 55773 - DNA, 316 bp, Zea mays
  Clone ID: LIB3068-047-Q1-K1-G5
cggacgcgtgggcgacggagttcaggcctcctccacgaaacttcatccatgatccgggtggattctgggcgtggtgctgtgttcacaaacaccagtctgtcagtcctgtgttgtgtattctgcttttcgatacagattttggaccaatcaaatcctgcattgcgctgcttgccagctagaaaactcctacttcggacccgaacaataacggggactctacctttccctgcgagatattcttgaccacacccgagcaaattttcgaggcaccgcgtacggttcacccttttaaacaaggtgggccactttcgaaggt

SEQ ID NO: 55774 - DNA, 422 bp, Zea mays
  Clone ID: LIB3068-047-Q1-K1-G7
atctccagttcgaaggcgttctccttctccaccacctaggaggcataggtcaccgatgcgtgtttcacctaggaggggacgtggtagcccatcaccacgcaggcgctcccctgggcctcttaggcggcgctcaccacctccaaggcggttgagaagcccaccaagaaggccaccacctccacgtcgcttcagtcgctctcctcctcgccgaccccttcgctcccgctccagatcaatttctccaagaaggggacgagggcctccattgaggcgtggtaggtcagactcatcatattctcgatcacctactccaccaagaaaggggccaaggagggtatcaaggagccgcagccctagaaagcctcctagaggaggaagaagcgtctccagtgacagccgcagcagcagttcaccttccccta

SEQ ID NO: 55775 - DNA, 330 bp, Zea mays
  Clone ID: LIB3068-047-Q1-K1-G8
tttgcttttcttttctatatcccgttcgtgaggaatctccacaacttggagtctggcgcccttacaaagatgttcacaaagaatcacggagtaagggagggattagcaactcacacaagacacaaagatcacagcatattcgcacacacaagactcagacttaagctcatgagactagcacactataacggaggtgttctttttagcttagctaggaatgcaaatgacttgattcgttggaaaaaaaacaaaaataaaaaaaatataaaaaaaatgactaatatgaaaaattaaaaaaagaaaattatttaaaaatgaaaacaattaaaa

SEQ ID NO: 55776 - DNA, 298 bp, Zea mays
  Clone ID: LIB3068-047-Q1-K1-G9
aaaaatacaaccataaaacaaaaaaaattccaatcaaaaaaaaaaataaaaacaacaaggagaaaggacaaattcaataaaacaacagccaatacttaaaaaacctctatcactacacggccctcctcctattctgaccctttttaccttccccacccttccaactacttagcttttccttgccacaacttccttcacttccattgcccccccttttacaactccgggcctcgaaaaccctatggacctcaaaccttattccctttccagactatccccttttctccaactcacttat

SEQ ID NO: 55777 - DNA, 454 bp, Zea mays
  Clone ID: LIB3068-047-Q1-K1-E9
cccacgcgtccgcccacgcgtccgcccacgcgtccgcccacgcgtccgggaactgtgactagaactagtagatccaatccaacactcgggacgaaattaaaggagacgacgcatcatccggccggcaggcatcgcacggtcaccaccatggcggcgcaggagggcggcatgaggctggtgtcgcacccgatcgcggcgcacgacgggcggctgccgcggcagtacacggcggaggggcagggcgccaagaaggacatgtcgccgccgctggagtggtacggcgtgcccgagggcgcgcggtcgctggcgctgctggtgcaggacatcgacgccgaccccgtcgtgccgtggacgcactgggtggtggccaacatcccgcccgccaccaggggcctccccgaggggttctccggcgccgcgggggcgggggcggtggcggtccgcgaccagctcg

SEQ ID NO: 55778 - DNA, 398 bp, Zea mays
  Clone ID: LIB3068-047-Q1-K1-H1
gatcgatggagagtggaagttcgactcaagaaactctgtgttggaatggtctattctcctgatcgatcagtcgaatcgcagtggttccatggaatttgttgttcccccagctgacccatcatcgtttttccccatctccgttggattttctgcatcgagtactttcagtgatctgaaggttactggaattcttcctctgaaggaaagcaacccttccaagttttctcaacgggctcggttggtcactggtaacttcccaagtggttaaaccctggacccgtgagggttgttccactggaaggttccaataccaaaggtaattgccgggacctattccagccattggaccggagaatattttggggttggaaaaattctttaccaatcgcctcttaatg

SEQ ID NO: 55779 - DNA, 281 bp, Zea mays
  Clone ID: LIB3068-022-Q1-K1-A2
cccacgcgtccgaccacgcgtccgtccacgcgtccgccacgcgtccgcccacgcgtccgggaagcaagcaagcaccgagtacatacatactaggcagccaggcagccatggcgccaaccgtgatgatggcctcgtcggccacggccgtggttccgttccaggggctcaagtccacgcgaagcctcccagtcgccggccgttcctccagaagcctgggcaacgtaagtaacggcggaaggatccggcgcatgcaggtgtggccggcctacggtaacaagaag

SEQ ID NO: 55780 - DNA, 342 bp, Zea mays
  Clone ID: LIB3068-022-Q1-K1-A3
tcgcggacgcgtgggctgggaagaccctattggctagggctatcgccagtaacatgaatgccgacttcttgaaaattgcttcaagagctataattgacagatactttggacaaagtgctcgcttgattatagaaaatgtttggctatgcacgtgatcacctaccatgcatcatgttcatggatgaaattgatgccattggtcggcgaagattcagtgagggaactagtgctgatcgtgagatgccacggacattgatggaactccttgaataattagacggttgtgatgaactctgaaaggcctagatgatcatgggcacgaatagacctgatgtactggac

SEQ ID NO: 55781 - DNA, 352 bp, Zea mays
  unsure at all n locations
  Clone ID: LIB3068-022-Q1-K1-A4
ggaggaagaaaaaccggcctcacctactgcggctccagaaccagaaccggaacaagtgcctgagccagaacccgagccagtgaaagaggaagcaccagaagctgaaccggatttgctgggtctgaacgaaccgaaccctgctgcaactgcgatagaagagcagaatgctttggcgctagctattgttccgatagatgatgctccgaaagctgctcccacttttggaaatggagtcactggctgggaactggcccttgtgacagcaccaagttcaaatgagaccgccgttgccccaagcaagaaactggccggtggtctggacttgctgaccctcgacagnctgtacgacgag

SEQ ID NO: 55782 - DNA, 108 bp, Zea mays
  Clone ID: LIB3068-022-Q1-K1-A5
caactgactctcaatgtaacatcgcattcacctcgtctgaactaacggttactctcatactaacctatacacttatcagcgccctatcacccattggtttaaatttat

SEQ ID NO: 55783 - DNA, 294 bp, Zea mays
  unsure at all n locations
  Clone ID: LIB3068-022-Q1-K1-A6
cggacgcgtgggtgctgtacagaacaaggagaacgagttagtccagagcagtcgtaatgagtacctcaagctgaaagcgagggtggataatttacagaggactcagaggaatttgcttggtgaagatctggggtcacttggtgtcaaagagcttgagcagcttgagaagcaacttgattcatccttaaggcacataagatccacaaggacacaacatatgcttgatcagctcactgatcttcagaggagggagcanatgctgtgtgaagcatataagtgccttagaagaaagct

SEQ ID NO: 55784 - DNA, 278 bp, Zea mays
  Clone ID: LIB3068-022-Q1-K1-A8
cccacgcgtgcgcccacgcgtccgcccacgcgtccggttctttttcgcggcccccgcttcggcgcgggaggttcggggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgtgcaccatcgccctcattgccatcggc

SEQ ID NO: 55785 - DNA, 430 bp, Zea mays
  Clone ID: LIB3068-022-Q1-K1-A9
tgaaattcatctttacagatcggaggaagagtaggttattcagcccgagactcgagatgatcgatcttgaaatgagaagagaaggacccacccaataaataaactattccaatgactttgttcgcttcccctgaggcaacggctgtactcggcacacagacctggcttatgagcaggatttttcagccaagccaagtgcgtatggttgctacctgtattctgataggccacttaatgacactggctcccagttattgacttatgaagaatggcttctcgatggaagagaaacaataataggaaaataggaagctgcaatcagaaccggctaactagacaaaaggagagagattggctcaattcaatatgaggaatttctaccgattattgagtggtttgtttccttttccctgaaaggtaaaatggttta

SEQ ID NO: 55786 - DNA, 344 bp, Zea mays
  Clone ID: LIB3068-022-Q1-K1-B1
cgacccactcgcccaaaaccgtagcgccctcgcctgctcgccgtcgacgtcgttgcgagctgcccatcttcctccgttaaccatggcgacccagatcagcaagaagaagaagttcgtcagcgacggcgtgttctacgccgagctcaatgagatgctgacgcgggagctcgcggaggacggctactccggcgtggaggtgcgtgtcacaccgatgcgcacggagatcatcatccgcgcaacgcgcacgcagaacgtgctcggcgagaagggccgcatgatcagggagctcacgtctgtggtccagaagaggttcaacgttcccgagaacggcgtcgagctctacg

SEQ ID NO: 55787 - DNA, 449 bp, Zea mays
  Clone ID: LIB3068-022-Q1-K1-B12
gccttgcctacctcaacaagcagcccgtgaagcctcagcgcatcgcgcgggaggtggccgcgggcagcatcgcgcgcgccgcgctcagcggctcggacagccggagcatccggaagaggacgtcgcggcggctcacgcagagcccccgctcgtcgtcgttgaccagggcccgtggcggcggcggcggcggttcacccacaccaagaaacacctctcgtcgtcgttgaccagaagaaccaactgcgtgattcgcgttgctctttggagacgggagacggcggcgtgactgcgtgcaggcagactcagacgacaccatgattcggcacggcgccagcatgatatgagacaaaccaagtatatgaagcaagtatgatgtgagagaattgcgatgcaacacataatgtacatacttgttagggagatattgcttagattaatactacgaccga

SEQ ID NO: 55788 - DNA, 215 bp, Zea mays
  Clone ID: LIB3068-022-Q1-K1-B5
cccacgcgtccgtttattcttttttttatttttttttttttttttttattttttagataagtattttttttttttttttttaaaagaaacctaactaaaaaaaaaatacccacagaatgaacataaaaaaacacacccacaaaaaaccatcaccaaaaaacacaaaaaacaacgcaacatcaaacaaaaccacaaccacaacaactaacacagac

SEQ ID NO: 55789 - DNA, 441 bp, Zea mays
  Clone ID: LIB3068-022-Q1-K1-C1
cagatacttactctacagcaaagaatgagtttctacgctgtgaactcgatagtaccctagaggaagagctcatttgactcactgccatacatccactatatagaccgcatcgacagttgtgccatatcaattaataacgcacacgccgtaactaatgaaatcattgcgcatcacttgaatgcgactaccactacattccaataaatgactaatagaaccatatttgcactggaataagtcattgctactctaatgcacgactacttaacaataggattcaccacagatactaatctgtctcactatagccgcaacaacggcctactcattcacatccaccgacccatgcactcacatattgatagacatacaaatcatgacttgcatatccgtggattatctaaagcatagctgatgtctgagagagatcatatgcactac

SEQ ID NO: 55790 - DNA, 203 bp, Zea mays
  Clone ID: LIB3068-022-Q1-K1-C11
tcggtgatatcttctgtgtgtgtgtgtgtgtgtttgtgtgcatggctccagtcccggaggcaggcccgataggtcttcctataaggtgatccactgccaaatacacatcgaaacgtacatgtcggtcacagggaaacacattgcgaacctctacccgggcatttaatgggtcccgtacaaagtcccgttgtacgccatgaaga

SEQ ID NO: 55791 - DNA, 436 bp, Zea mays
  Clone ID: LIB3068-022-Q1-K1-C12
aagatatggagtcgacaggaaagattttgatggagcggtatgaggtggggaggctactggggaaaggcacatttggcaaggtgcactacgcaaagaatcttgagtccaacgagagtgttgccattaagatgatggacaaggacaaagtgctcaaggccgggctttcggagcagataaggcgggagatcacaacgatgcggttggtggctcataagaacattgttgagcttcatgaggtcatggcgacgcggaacaacatctactttgtcatggagtatgtgaaaggcggagagctctttgacaagattggcaagagtggcaagctcacagaggccgctgcacacaagtacttccagcagctcattggtgcggtggattactgccacagccgaggtgtgtatcaccgggacttgaagcctgagaaccttctgttgga

SEQ ID NO: 55792 - DNA, 434 bp, Zea mays
  Clone ID: LIB3068-022-Q1-K1-C3
cggacgcgtgggctcgccgatagctagcatcatggcgtccaaggcgctcctcgtggtagcgcgtcctgctcgccgccaccttcctcgccgcctccgctaacgagcaagcccaggcggccaaagaggagaagaaggcggaggtccaagactggcacggcggcggcggctacccggggcacggcggcggcggcagcggaggctacccggggcacggcggcggcggcggcggcggctacccgcactgccggtggggctgctgcaaccgcgggtaccatggcggctgccggtgctgctcgcaccctgatcagataccagagcccatgtaccgtcctgagctcgtcgaggtccacaactaaatagtaatgagatgcgctgctactatatatacggggacgtatgcccgatgggaagcagagcacacgcgtagtacgctc

SEQ ID NO: 55793 - DNA, 299 bp, Zea mays
  Clone ID: LIB3068-022-Q1-K1-C4
caaagaattccctcccctagccgccgccgtcgctcgtctccctgaaagggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagcttcccttg

SEQ ID NO: 55794 - DNA, 55 bp, Zea mays
  Clone ID: LIB3068-022-Q1-K1-C6
tcttactaccacgctttcttataaccacaacttttcttcttcctttacaatacca

SEQ ID NO: 55795 - DNA, 420 bp, Zea mays
  Clone ID: LIB3068-022-Q1-K1-C7
cccacgcgtccgcccacgcgtccgcccacgcgttcgcccacgcgtccggtcttcacgaacggcggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcacccagactggtgctgggaagcacgttcccggtccaatcttcgttgatctagaaccaactgtgatcgatgag

SEQ ID NO: 55796 - DNA, 298 bp, Zea mays
  Clone ID: LIB3068-022-Q1-K1-C8
gcctccctctcctctgccgccgtcaccgccccttccttcgccgcaccagcgccaggccgcgcgcgtggtcagaaggaggtccttcaccgtgcgcgcctctctccgcaaggccaccggcaccgacgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgac

SEQ ID NO: 55797 - DNA, 408 bp, Zea mays
  Clone ID: LIB3068-022-Q1-K1-A11
cacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcggtc

SEQ ID NO: 55798 - DNA, 182 bp, Zea mays
  Clone ID: LIB3068-022-Q1-K1-D1
acgcccacgcctacaccttagagaagtgcgcatttaccatataaaaggctcacacgatctgtgggataggataccatcattcatgataactgcaccgatctcacggatcttcaagacatcgacgcatcatccaaatgttctgccctatcaactctcatatagaatatcaataacctaccatc

SEQ ID NO: 55799 - DNA, 203 bp, Zea mays
  Clone ID: LIB3068-022-Q1-K1-D10
aaaactaaaaaaaagggggggataatataacatgggccgacgctttttccgatcccattcttgctccccctctcttgccagaacacactttccctgtagtgtcccctaattcaatctaactgcccctgtttttataaacgcttctcctgggaaacccctggctttcccacctttactcgctttactatccttcccattctctt

SEQ ID NO: 55800 - DNA, 371 bp, Zea mays
  Clone ID: LIB3068-021-Q1-K1-F2
gttctccgtccccacgcctcgccggacccgccatcaccgactgctcgttgggccacgaaacgctagcggcgcctgcagcccctggatactgcgtaccgctcccttgcgcctccgcccgtgccctgctcccaccgacgtcgcattagtgtatgatgatctcattcttcgctatttttttagctccctacaccaaagaccacagtcagatccgaggctacccgccgtcccagcaaggattttacccggccgaagctctgcaacatcggtgggatcgatggctgcgaccatcacgagctccggtgcccacgaatcgaagtcagcagcgtcacgtggactgaggcacgtgccatgttcgccgtactgtccgacgc

SEQ ID NO: 55801 - DNA, 291 bp, Zea mays
  Clone ID: LIB3068-021-Q1-K1-F3
tcgcccacgcgttcgcttttgtttcacacgagatttctgttctcgttgagctcatcttatgacaggggctttatcttttaacagatgtgccgctctagccaaactcctcacctgacaatgtctttcgtccggatcggcccggtgaggcctgtccttggaaccaaaaggaggggctgtgccccggtatcgacccacggaattatgttaaataacgttaaaagtattggtatttcacttcgcgccccgaggcttccacttattccaacactttttaagtcatttttacaaaat

SEQ ID NO: 55802 - DNA, 208 bp, Zea mays
  unsure at all n locations
  Clone ID: LIB3068-021-Q1-K1-F4
gttctccgtccccacgcctcgccggacccgccatcaccgcctcctcgttgggccacgaaacggtagcggcgcctgcagcccctggatactgcgtcccgctcccttgcgcctncgcccgtgccctgctcccaccgacgtcgcattagtgtatgatgatctcatttttcgctatttttttaagctcctacaccaaagaccagagtcagat

SEQ ID NO: 55803 - DNA, 418 bp, Zea mays
  Clone ID: LIB3068-021-Q1-K1-F5
catcagccaagagctacgcaaacgcacagcgatgcaccagcacgagataccagccaccatgcgcctgtccctcctcctcgtcatcgtggccgccctctcggcgcgcgccgcggcgcagctgccgccggcgggcggcgccctgaagccggacttctatagccagtcgtgcccgcgcgcggagcggatcattgcggaagtgatgcagacgaagcagatggcgaacccgacgacggccggcggcctgctccgcgtcttcttccacgactgcttcgtcagcgggtgccaagccttcgggctgaacgggttcaaccaggttcagaaatccgaaccccacgccgagatcaaccaattccttcccggggacccctttgacgccctggtgccccccaagcttgcccttgaacttgaatgccccggg

SEQ ID NO: 55804 - DNA, 272 bp, Zea mays
  Clone ID: LIB3068-021-Q1-K1-F6
tcgcccacgcgaccgctcacgcgacccgccatgagcgcgtcctcgctgggccacgaaacggtaggggcgcctgaagaccctggatactgcgtaccgctcccttgcgccttcgtccgtgccctgctcccaccgacgtggcattagagtatgatgatctcatttatcgctatcatattagctccctacaccaaagaccagagtcagatccgaagctacctcgccgcccagcaaggattttacccggacggagctctgcaacataggggggatcg

SEQ ID NO: 55805 - DNA, 58 bp, Zea mays
  Clone ID: LIB3068-021-Q1-K1-F7
acccacgcgttcgcttttgttccacacgagatttctgaccacgtataactcatcttat

SEQ ID NO: 55806 - DNA, 341 bp, Zea mays
  Clone ID: LIB3068-021-Q1-K1-F8
ggccctcaccaagaggacacaagatggtgggacagaggtggttgaagcaaaggcgggtaaaggctctgcaacgttgttcatggcatatgctggtgctgtttttgcagatgcatgtttgaagggtctgaatggagttacagacatttgatagtgctcttttgtgcaatcaactgtgatagattcgccatacattagatccaaagttcagcttggcatgcatggaatcgaggaagtgcttggtccgggtgagttcaacaagttcgagacgaaaggtgtggaaaacctcaaggtcgagctcaagtcttccatcgacaagggtatcaagtttgctcacgggaact

SEQ ID NO: 55807 - DNA, 336 bp, Zea mays
  Clone ID: LIB3068-021-Q1-K1-G2
atttcctaggatgagctgaaggcatggtggtctgctgctatgaagggtgagtggaagctaccgtcgaaggaagaactgggtgtgaaactaagagaaaaagagctacttcgcgcgtagaatggaacggttgcgcagtactaaaatatggaggcttctattgtacccatcctactaggaaattatgagccagttgatgaggcatgaattatttcacgacttggccgcggttagtgtgaaaaggcgacgctgctatatatggtcatcacccttggtttgtccgttcgccagatatcacgattatcatatttatcggttgtaatataagcttcttgtatt

SEQ ID NO: 55808 - DNA, 332 bp, Zea mays
  Clone ID: LIB3068-021-Q1-K1-G3
ggccgaggaggccggcggcgagaagaagcaccacttcttcggctagctgattgatcctcccatatcgatcgtcgtccctccccgtttgctacgcgtgcgtgtgagagtgatatcgagcgccggccggcctgcacgcccgccgtgttgtgcgtacgtacgtacgtatacatgtatgtatgtatatgcgcgcgtgtgatgcacgaataagcgtggctacgtaatctatcgtatgtacaacgtggggaatgcatgggcttgggtatgatccgggtaccgggacccaaaaaggtttccacccttggtttccttaaaaaaaaaaaaaagggcggccc

SEQ ID NO: 55809 - DNA, 53 bp, Zea mays
  Clone ID: LIB3068-021-Q1-K1-G4
gacgtacgcgtacgtcacgcgtctgactagcactagatctttagtttacgata

SEQ ID NO: 55810 - DNA, 200 bp, Zea mays
  unsure at all n locations
  Clone ID: LIB3068-021-Q1-K1-G5
cttgctcataccgcgacgctctctctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctncatgctcaccttcg

SEQ ID NO: 55811 - DNA, 379 bp, Zea mays
  unsure at all n locations
  Clone ID: LIB3068-021-Q1-K1-G6
cccaagccgaccccaccgacgtacactcccacaccgaagccgccggccaccaagccggccacgtacactccgacgccgccggtgtctcacacccccagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctnctctttgtgtgctgccatccgtccccgttagacgatcgaggagagaataacgcatagctctctgctcccggcctgtcttctgccgtcccggccgtttaattact

SEQ ID NO: 55812 - DNA, 373 bp, Zea mays
  Clone ID: LIB3068-021-Q1-K1-G7
gggcgatgaggatgatggagaggaagaagatgacgaggacggtgaaggggacgaagaagaagaaggtgatgaggaggtgactggattctaagcgaggctactcatcacctgtaactttggaagtgtgagttagttgacatactattcacttgtacctcgtgcgatttcttatacgtgtacttgtgtgcgttctatgggacgcactgagcccataaatcgattcgtgactatgtaggtatgtgtagtgctggtgtgtgtaccttggatttctttctacatcttcctggggtggcattgaatgcctgcagtaaggtatgggctaccttctggttgacatgccttgtgtatttatggtcgatatgtgtttttgttt

SEQ ID NO: 55813 - DNA, 446 bp, Zea mays
  Clone ID: LIB3068-021-Q1-K1-H11
gacaatgtgcatgaagttcgctgaactagagagaagccttggtgaaattgatcgttcgcgtgccatctatgtgcatgcatccaactatgctgatccaaataatcctgacttttggaagaagtggaatgactttgagattcagcacggtaacgaagacacattcagggagatgcttcgtatcaaacggacagtggctgctagccgtagtcagacacatttcatactaccggagtacttgatgcagaaggatcagaggttaaacctggacgaagcagttgacactctgaaacgtgctggcgtccctgaggacgagatggcagccttggaaaggcaactggctcccggaccatccactgcaccagtagcaacaccaagcactgccccagcctctgctaacaggacgatgaacttcgtcagtgctggagtagaggcgcaagccgagagca

SEQ ID NO: 55814 - DNA, 434 bp, Zea mays
  Clone ID: LIB3068-021-Q1-K1-H12
cccacgcgtccgcccacgcgtccgcccacgcttccgcccacgcgtccgcggacgcgtgggctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatccttcagcagctgcaggagatgggcatcattga

SEQ ID NO: 55815 - DNA, 338 bp, Zea mays
  Clone ID: LIB3068-021-Q1-K1-H3
ccggaattgaagggtcgagtcaagcgacgcgttagatcacgagtgcgagcacgtgtttcgaaagaagaagggcatagcaatgtacaacggaatgggcaccatacctgtcatacctgcgacgatgctcttaagaggtcttctagacgatgtctgcttccgcaccaccgacggcagatacagacacgcccgtcacacgacatcgactaatcgaatatgattcccaagagctttggcccttgtggtccaccgttgaaatgcttgtacttccctattaaagacaccttccttccgggatggcgcttcaacgacctggtggacaagggcttcgccgactggca

SEQ ID NO: 55816 - DNA, 418 bp, Zea mays
  Clone ID: LIB3068-021-Q1-K1-F12
ctgacgcgtacgcccacgcgtgcttcgacccttgagatcaaggcaaggtggtgctcgtggagtgctccctgctaggctcagtgtagtccatcctgatgctcgtcatcgcaactctcgtgttctttggtggcctgactaaccatggaactgatcaactatgcgacaaatttcatgtagtatgtcagtacaggacttctcattctaggtgtgctatacaaatctgtgctattgatgctaagatatgctgtgagctatggggagcacgcagaattctaccgagattcaggactggagctgtcccgagcatgcagcattgtcatgctccttgcctatgtaatctaccgtttcttgcaactgataacccacaagcagctatttcaacgccaaccccaagaggttgaagatggcgatgcttcag

SEQ ID NO: 55817 - DNA, 309 bp, Zea mays
  unsure at all n locations
  Clone ID: LIB3068-021-Q1-K1-H7
cccacgcgtccgcccacgcgtccgaaagaagaaaggcatagcagcgggcagcggcatgggcaccaagccccgtaatccttgcgacgatgctcttcgtcgctcttcttgtcgctgnctgcttcggcgccaccgccgccaggtccagccacgcccgccacaccgacgccgacgacgcgattcgtctccccagcagctttggcgctggtggtcgaccgtggaattgctgagactccgctatcagggacgcctccctgccggcgtggcgctgcaacgacgtggtggacaagtgctccgccgactgccaggact

SEQ ID NO: 55818 - DNA, 320 bp, Zea mays
  Clone ID: LIB3068-021-Q1-K1-H8
cggacgcgtgagcggactcgtacgtgctaatgctaaataaggatggctgaatgtgggtgcagcaatcatcacttccggagatccgatttacactccatccgaccagcctacttctgaggatcaagaagcgacatgaattttaactcttgagtgccatcagcccaatatacctgatgttactgttatgacacctgtagcttgaaactactatagtctaattgattgatacgtcatgctttcacagctcgctttacaactggacattcatatcttacaagcttctatccatttagtccgcaaccgatttatggtacagatca

SEQ ID NO: 55819 - DNA, 323 bp, Zea mays
  Clone ID: LIB3068-022-Q1-K1-A10
tgaaattcatctttactgatcggaggaagattatgttattcagcccgagactcgagatgggggagcttgaaatgataagagaaggacccacccattaattaaactattccatggactttgtccgcttcccttaaggcaccggttgtctccggaacaaaactctcttataaacaagattttttaatccaaccaaatgcctattggtgctacactgtattctgatatgccacttaatgacactggcttccacatattgactcatgaaaaataggttctctatggaaaagaaacactcctaggaaaatatgaagctcctatcataa

SEQ ID NO: 55820 - DNA, 442 bp, Zea mays
  Clone ID: LIB3068-021-Q1-K1-C12
cccacgcgtccgcgctgggccaccagctttgaccgccgcctcccttcccctccgctactgctcctcctcaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttgtgagtgatccagagaaacgtgagatttatgatcaggatggtgaagatgcccttaacgaaggaatgggcggtggaggatcccatgttgatccatttgacatc

SEQ ID NO: 55821 - DNA, 177 bp, Zea mays
  Clone ID: LIB3068-021-Q1-K1-C2
agcacgcgtacgaacgccttacggaatgcagatagatgtgcttgcacgtcgaagagctactttgtgagggactaggcaggaaagcacgccatactcttgattctctgccacctattgatgacttcgaagctcaggagtacacgtatattcacctcgtgcttacgcacaatggggttc

SEQ ID NO: 55822 - DNA, 368 bp, Zea mays
  Clone ID: LIB3068-021-Q1-K1-C3
cccacgcgttcgcaagccatgtggaggagggctctagcgatggtcctgttcatggctggcgccgcgctgctcgccggggctgcccgcgccggcgcgcagcacgtcatgtggagcatcatgacccagaccatgctgcacagcatgctgagccaccgctgcgacagcgggtgccacagcgactactacacctacgacgccttcatcgaggccgccagcaagttccccagcttcggcaccaccagcgacgagcagacgctcaggcggtagctcggcgacatgttcggccagacgtcccacgaaaccaccactggatgggctactgctgctgatggaccagtcggctggggatactgacaggtgaaggaaca

SEQ ID NO: 55823 - DNA, 260 bp, Zea mays
  Clone ID: LIB3068-021-Q1-K1-C4
agcggcagcagcgctcgtttgatccccgcggcggtccggcgtccgggtaggggagcgaggatgacggagtccctggtgcggaacaagccggggatggccagcatcaaggagatgccggtgctgcaggacgggccgaccgcgggcggttttgcgcccgtgcgctacgcgcgcccgatttccaacttgggccccagcggcaattggcattttcttaacggccttgggggctttggggattggaatgtcccaggtcggcaagg

SEQ ID NO: 55824 - DNA, 289 bp, Zea mays
  Clone ID: LIB3068-021-Q1-K1-C7
cccacgcgtccgcccaggcccgcgtcacggcgcaccctgtgaagctggccgccctctccaccgcccaccaatccgtcaccaaggccatcgacaaggccggcggcatgctcctgctgacgtcgctgctcggaccgtttacgtcccacgccgtggggaccgatgcggtcgccattcttgtcagcggtgtgacgcttgacgctgacacgaaggccgcgctcatgcagccggcgaaggtgtcgctcgtggtcgacatgctcaacgagggcgcggcggacaccatgatcaactg

SEQ ID NO: 55825 - DNA, 380 bp, Zea mays
  unsure at all n locations
  Clone ID: LIB3068-021-Q1-K1-D1
ggaagaacagctcgtccgagaccatgaagagcagcccacacctggtgctgatcctgtgcctgcaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctnctactcgggcaacaacaagttcaggtgcaccgacaccttncttcgcatgtgcccgcccaagtgctagatcagagaggaaagacgcgcgctgctgctagctgctatagcttcgttc

SEQ ID NO: 55826 - DNA, 444 bp, Zea mays
  Clone ID: LIB3068-021-Q1-K1-D10
cagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataggttgtattctagtatgttgaaagctcatggtgccgtgctgtatcaataaggtgttatgcgcatagagtggctcaggaccagggctgcgtttgcgctttgccactggctgtgttgtatgtttcttctgctgctatgccattagggtttagggatggtgtgtggatggcgtcgtgcttgtagtgttagctggatttgaagcggactacatgtaggtttgttcaatgtcta

SEQ ID NO: 55827 - DNA, 221 bp, Zea mays
  Clone ID: LIB3068-021-Q1-K1-D11
cagacacgcttcttcatactcacatatcttcgcgacccaaatcgtacccgcttctctgagtcttatctcatttatcaccaatcgcgccgttaccgcatttcgacaacaccacgacggagtgcatctagctccacataggccaggccgtaattcagctctgaaacacatgctgtgagctagctctgtatcgagcatggcattcaagctgatggtcaaattcc

SEQ ID NO: 55828 - DNA, 240 bp, Zea mays
  Clone ID: LIB3068-021-Q1-K1-D4
gctgcggcatcatcgttccaccttactctccaggctccagctccgaccccggcgagccgctagagcaacgagaacgaatcagctagtagccgcccgcgtatctccatcatggccgtgctggtcgcgaggcagggacgcgagctgcagcggtacagccagagcaccggcgggcgcatcgtggtgggctgcatcccgtaccgcgtgcggtgcgacggcgaagctgaggtgctggcgatcacg

SEQ ID NO: 55829 - DNA, 179 bp, Zea mays
  Clone ID: LIB3068-021-Q1-K1-D5
cccacgcgtccgcccacgcgtccgcccacgcgtccgtcaacgcgttcgtccacgcgtccgcggacgcgtgcgcaagcgtcagcaccgtcggctgcctccgtgctatctatacgctgacgatacttccctacgccaggcacgccaagatgaatcttgacaggttccttatgaatctgaac

SEQ ID NO: 55830 - DNA, 198 bp, Zea mays
  Clone ID: LIB3068-021-Q1-K1-D6
gccacgcgtgcgcccacgcgtccgtccacacgtgcgcacacgcgttggtgcacgcgtgcgtagagaacaactaaggtcatgggcgtcttccccgatttggctaaataaaatgccctgtttgatagcaaggacatcgacatcaacccgtggcagcttaagagctgcaccaacttcaacttgtccttcatggagctctac

SEQ ID NO: 55831 - DNA, 264 bp, Zea mays
  unsure at all n locations
  Clone ID: LIB3068-021-Q1-K1-D7
gaccgagccatcatccccccccgagccgtgccaaccaaaagccatccaccaacaacaacaagcccggccgcttccttgtccctgcccctccgttggtctcctttgcccatctcatcctctctctctctctccctctctctctctctggcggtcggcgtggctccgggggcgcgaagcgcgggcttcgcggggcgactcngccgcngcgacctgcanngttggtatgaaaggggtcacccacgcggcgccaaccacaagcgcccc

SEQ ID NO: 55832 - DNA, 144 bp, Zea mays
  Clone ID: LIB3068-021-Q1-K1-D8
cggacgcgtgggcggacgcgtgggcggacgcttggtcagacgcgtgggcgtggcaatgaggggcatcttggatgccctactagcgtggccggcgaggcggttgtgttcacggtggtgaaccagtgccgagttcaccctgtgggc

SEQ ID NO: 55833 - DNA, 127 bp, Zea mays
  Clone ID: LIB3068-021-Q1-K1-D9
aaaacaaaaaaaaaaataataaacacaaatattaaaaacaaaaataaaacaataaacaaagcagacaattcaaaaattctctttatacaaaaaattattaaaaaaattaataaaattcactaataaa

SEQ ID NO: 55834 - DNA, 346 bp, Zea mays
  Clone ID: LIB3068-021-Q1-K1-E1
gcccaagctaatgcagcatggatttagtgatgccattgcaaaagtaggtttgacaaaggttgtcagtgacctattcttggttggactgttctaccatctgtataaccagattgctacaaacaccttggagcgagtggctcctctgacacatgctgtcggcaatgtgttgaaacgtgttttcgtcatcggtttctcaatcattgtttttggcaacaaaattagcacacaaactggaattggcacgtgcattgccatagctggtgttgctatgtactcttacattaaggctaagattgaagaggagaaaaggaaaaggagcgcatgactgctgtgaaatatataatca

SEQ ID NO: 55835 - DNA, 302 bp, Zea mays
  unsure at all n locations
  Clone ID: LIB3068-021-Q1-K1-C1
gatgaattggccacaccagtacctcccactgattatacgttcacaaaacaaccagaacaagtgcggccaatctcttccgagagtgaggcaagtatcgacttggacgatgttctatctgctgctcagacagctgctgaatcagcggagcgagctgcgtccgcagcccgcgccgctgcgaaccttgtgcagctacgcattgcagacctaaagaagaattcaagggtctataacaagtacaccgacagtgctcaaaaggaaagccctcatcatgccgagggtacacagnaaccagtatttgatca

SEQ ID NO: 55836 - DNA, 440 bp, Zea mays
  Clone ID: LIB3068-021-Q1-K1-E12
cccacgcgtccgcccacgcttgcgtcgacgcgtgggatcaaggcaaggtagtggtcgtgaaatgctccctgctaggctcagtgttgtccatcctgttgcttgtcctcggaacctccctgttctttggtggcctgactaaccttggaactgagcagctatgcgacaaattgcatgtacatgtcagcacaggacttctgattcttggtgtgctatgcaactctgtgccactgatgctgagatatgctgtgagctctggagagcacgcagaattctctcgggattcaggactggagctgtccctagcatgcagcattgtcatgctccttgcctatgtaatctaccttttcttgcaactgaaaacccaccagcaactatttgaacgccaaccgcaagaggttgaagatggtgatgattcgtgtctttaagacgtggcactactg

SEQ ID NO: 55837 - DNA, 113 bp, Zea mays
  Clone ID: LIB3068-021-Q1-K1-E2
aaggaggggaaaaggaccatactgttgattcatgagatcatgctagagatttttcctggcagggcgtgtaaaactgtcgaactatttgaacgaaagttgtacactgcagtatg

SEQ ID NO: 55838 - DNA, 215 bp, Zea mays
  Clone ID: LIB3068-021-Q1-K1-E4
cccacgcgtacgcggacgcgtgggcggacgcgtggggaaatcctaaacggaagtgagacgcgcaatgggcgatccaccgcttgcgcgtcggtaccatgtccgctggaagcgagaggccgtacgccttctcgccctcgtcggcggtcccgggccccttctcccgcggctccggctccgctcccaccacggccgcgacagatagcactgggaggagc

SEQ ID NO: 55839 - DNA, 251 bp, Zea mays
  Clone ID: LIB3068-021-Q1-K1-E7
cccacgcgtccggcaactgcaaagcagcaggctctactcttcttctgtactgaacgtgtgactagagaacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggta

SEQ ID NO: 55840 - DNA, 446 bp, Zea mays
  Clone ID: LIB3068-021-Q1-K1-F10
cggacgcgtgggcgagcacgcaccagcatccttggcagcgatctgcttgcttctcccagctggcgcgcgcggccaagctaggggatccatcagatatccacgccggccatggccgccgccgcctccaccacgtcgaggaccaactcgcgggtgaactactcgaacgagatccacgacctctccaccgtgcagagcggctccgccgtccccaccttgttctacccggacaagtccatcgccgacatcttcccgccgcaccttgggaagaaggtgatctcggaggtggtggcgacgttccttctggtgttcgtcacctgcggggcggcgtccatctacggcgaagacaacaggcgcatctcgcagctggggcagtcggtggccggcgggctcatcgtcaccgtcatgatctacgccaccggccacatcttcggcgcgcacatgaaccc

SEQ ID NO: 55841 - DNA, 262 bp, Zea mays
  Clone ID: LIB3068-058-Q1-K1-H8
cccacgcgtccgaggacggctcacgaatggctacaaccttgccgatttagtcgcgcgacgtctggggttcaagatgagtccacctccaggccccccagccggccacgccctacctcctggccccacccacggcgcagcacttcccccagtgcatcctcatctcttccctcagcaacctctgatgcacaggttcccgcaccgtactcaactacgaccacccctaccccatcaccagcgtctcacacgcttatcatcaatatca

SEQ ID NO: 55842 - DNA, 446 bp, Zea mays
  unsure at all n locations
  Clone ID: LIB3068-058-Q1-K1-H9
tggagaaccgccatgggatttcaccggcgactgaaccccggccggctccctcgcccctggcaccgttcaacgccgtcagcctcccccctttctctggaacgtgggcccacgcccacggcgtccgccgtgccgtcccccgctcctcgtgggccgtctgggcccaattggccgcggccgcgcgctcccgaccaggccgaaatcccccccccccggcccggttaacctggaattccttttcttttttccttttcccattttcacatatataattatatgttgatattttatgcaccaaaaatagtttaaataaattatagggcacaaaaataataaggtataataattggcacaccccagtaagtcaccatgattgatgtattgttcttatttgtgcttgttagcggaagagggatcagatcctncggaatttgtagctccgggacaag

SEQ ID NO: 55843 - DNA, 441 bp, Zea mays
  Clone ID: LIB3068-059-Q1-K1-A1
cggacgcgtgggcggactcgtgggcggacttgtgtgctatccgcaagcctcgtcccgccgcgcccatgtcggaggaacccgcggttgtcgtggcctcctccagctacgaggttgacctcgggaacctcatggcgtacgatccgtcgcatcacgtcgccaccgcctccagggaggagctgagacaggagtgcctgcggaagggtacagagctggcgcaggcggtggccgacgtcctcttcgcgctgccgcccaacgaggaccgcgacggccccattatccacctcccgccgcccaccttcagactcccgcgggagaagcatctacccaagcccaagccaccgaccaagtgggagctgttttgcaaagcgaaaggaattaccaagcgcaaaatgaacaaacgtgagtgggatgagcaaactcaatcctggaagcggactcatg

SEQ ID NO: 55844 - DNA, 419 bp, Zea mays
  unsure at all n locations
  Clone ID: LIB3068-059-Q1-K1-A10
ctcatgtcattatcacggatctattttnaccacctaagctgaaaaagttgacgaatattttaaaaaagacgtgggcgccaactaaagcatctgaagaagcagctaacgttgatggcgaagatgacaaagctatttctaatgaacaagagactggtgttcctgataaagatgagaaaactgttgagataaaaaatcataaaaatgtgactaatataagaacaagtgtcaccaaagagaatggaagccataaacgtgaatccaataacccaggaaagcatctcaagaaaaataagaataatgctaccaaaaaaattgatggctctcacagcactgaaacaaatataagtggcaaagaagagcatcgcgaacaaaccaagaaaatgagtcacaatatgaaatttgcttctgatagaaccaaa

SEQ ID NO: 55845 - DNA, 357 bp, Zea mays
  Clone ID: LIB3068-059-Q1-K1-A11
cgaaagaaaaaaaaaaaaaaaaaaaaaaaaaataaataaaaaaaaaaaaaaaaaaaaaaaaaggaaggattaaaaaaaaaaaagaggcagcaaaaaaaaaaaaaaaaaaaaaaaagaaaaaaaaaaaaaaaaaaaaaaaaaaaaaaaaaaaaaaaaaaaaaaaaaaaaaaaaaaaaacaaagaaaatcaaaaaaaaaccaaagaaaaaccaaataagaaaaaaaaagaatacaccaaaaatatcagaacacaaaaataaaaaaaaaagacaaacacgaaaaaacacaatggaaccataaaaaaaacaaagaaagacaaaaggaaagatacccataaaaaaaacacataaaaacaaaa

SEQ ID NO: 55846 - DNA, 289 bp, Zea mays
  Clone ID: LIB3068-059-Q1-K1-A12
gtccgcccagcgctttcgcccactcgttcgcccactctttcgaaaacaaaaaaaaaaaaaaaaaaggaaggtttaaaaaaaaaaaagggcgccccaaaaaaaaaaccaaaacaaaaaaaaacaaacatacaacaaaaaaaaaacgccaaccgttcaacataacccaaatttactgacccttccatcccaactaaaaccactgctaaaaccccacctaaacccaactaaatggccttgcataaaaaacccctaaacccagaaaaccctacagctaaccaacccaaacccc

SEQ ID NO: 55847 - DNA, 436 bp, Zea mays
  Clone ID: LIB3068-059-Q1-K1-A2
ggtgtgatcagtttggacatatagagaaggtgttgtactgctactcaagctgaattagaacaagagctggcaccacctcatccaaagaaaccaaaataacaaagaaaatccaaatctgaagctgttgaagtctctatggttgatgtcgagccatctcaaaccgacggtgttccaaaagtgatgtctagcccacgtgtaacaacaagaagcatgtcttctgcttatgcaactagtccatgtcctacaacaaggacgaaggcatccatctcaccaggaggaattaatccgaggctcattattagctagatatagtagttgtcattctctatcttgcgtgtcggcatggctgtgcaactattttgtgtaactatttttacgctatgcaacactatgtctgatggtggtgcttatatattctgaattgcatgaactcatt

SEQ ID NO: 55848 - DNA, 412 bp, Zea mays
  Clone ID: LIB3068-059-Q1-K1-A5
agcgaacgtgctgataaaatagctgttcatttttcgagttatcaactcaaggatcagcctagtcaaactcctgaaaaggatgcgagagttgtcctttctggagtaagccttaagtatggaattgatttgttggaaagtatccaaagtggccctaagaagaagagcacaaagaagtcactcaaggatgttgtcacagagaatgaatttgaaaaacgtcttcttccagatgtcatccctccagatgagattggtgttacctttgaggatattggagcattagaaaatgtcaaggaaactttgcaggagttagttatgcttcctttgcaaaggcctgagttgctctccaaaggacaacttatgaagccatgtaaagggatattgctttttggtccacctggcaccggttagacca

SEQ ID NO: 55849 - DNA, 441 bp, Zea mays
  Clone ID: LIB3068-059-Q1-K1-A6
atcgagcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtgg

SEQ ID NO: 55850 - DNA, 244 bp, Zea mays
  Clone ID: LIB3068-059-Q1-K1-A8
acgacttgacctcaacccgccacccttttttatttttctatagcataacattacaagaaagatatggttcaattttaaccactggacaggacatctaatcagacatacgtacatgatcacctcatgtgctacatctaaccccatcaacttagctcttcccacatagacaaccacgacagcaccgattgagcccaaaacaccgaatttccacaattcaagccatacgagataaccaacatcatta

SEQ ID NO: 55851 - DNA, 309 bp, Zea mays
  Clone ID: LIB3068-059-Q1-K1-A9
agccgactaaagcatctgaagaagcagctaatgttgatggctaatatgagaaagctacacctaatgaacaagagactggtgttcctgataaagatgagaaaactgtcgagataaaaactcataaaaacgtgactaatataagaacaagtgtcaccaaagagaatggaagccataaacgtgaatgcaataagccagccaaagcatctcaagaaaaataagaataatgctaccaaagaaattgatcgctctgagagcagtgaaacatatagaggtgggaaagaagagcattgccaacaaaccaagaaaatg

SEQ ID NO: 55852 - DNA, 307 bp, Zea mays
  Clone ID: LIB3068-059-Q1-K1-B1
tgcggacttatgtgacataactttcatttataagtaccacaagagaatcagcaggcacggttactcaagtaacgggccctagtacgatccatctagcaatacattgcagaaactagagcctaaaagaaccaacacaaaaaactgcgctttcaccacggcatcctacgagctgcacgaacacgacagaagccatatacacacaactctctgtgatcacataatcgctagactcaactcgtactacgtaatgaaaggaataactagtggcctacaaaacaggccacttactatcaagactcaccaaact

SEQ ID NO: 55853 - DNA, 417 bp, Zea mays
  Clone ID: LIB3068-059-Q1-K1-B11
cctgtagtagcctgccatgactacgcgctgctgcctggtcgtcgccactctcctcgcggggctgctctcggtcagtgccagcctcgagttcggtttctacaacaagacgtgccccagcgccgagaccatcgtgcagcagaccgtggccgccgcgttcaccaacaactccggcgtcgctccggcgctcctgcgcatgcacttgcatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccggcgtggtgtcctgcgccgacatgctcgccttcgcggccagggacagcgtcgtgctcaccgg

SEQ ID NO: 55854 - DNA, 60 bp, Zea mays
  Clone ID: LIB3068-059-Q1-K1-B2
cggacgcgtgggcacaagtacgctgcgaatctcagtttcatagacccgcgcacagatcga

SEQ ID NO: 55855 - DNA, 439 bp, Zea mays
  unsure at all n locations
  Clone ID: LIB3068-058-Q1-K1-H7
ggccgtacccgtacccgtaccctgcgtggccgtccgactgctgctgccaccacggccacggcgggtgccactgctgctcctgcggcaaggcccccgagccggccccggcccccgccccggccccacccccgccgcagtacttcccgcagtacatgccccagccgtacccctgcaacccctgcggcggcggctaccggatcgtctgcgaggaggacccctcctacgcctgcgccatcatgtgattcgcttattatcaatatcatcccttgatgagtgtaccgtacgtgtgcgtaccatggccttaattaccattatacccaaccncaccctaaaaaaaaccccagtatgtcgtctcatcatcattccgtacctcctcctgtataatcgccgtacagattcatcatatatatactctatacatatatagcatcatgtaaaa

SEQ ID NO: 55856 - DNA, 445 bp, Zea mays
  unsure at all n locations
  Clone ID: LIB3068-059-Q1-K1-B3
atgaaaggcgtctgcttgcggaaacaagatttcttgtagatactttgacagaagaagagaagggcaggaataggactatgcttgacataatttacgttagagatactcatccattgatcactcagattatcttcctgtatcagaactattaccatctatcaagaacagacccttatgttattcccattgagcctgctgctagtggtggaatgaatggattcctatgtttatctgaaaggaactggtatagtgtcactgtcacttctccagttaaggggttcaatggcattgctcagaacagagttttgaatgctgcctatctcaatcctcagtatcacaaacacatcccagagccttcagcggnggtcatcatacctgcgaagatactgaagcctagtgatttcaaaccctttcctgtgttgtggcatcaaagatatagtcgtcg

SEQ ID NO: 55857 - DNA, 433 bp, Zea mays
  Clone ID: LIB3068-058-Q1-K1-F5
gttttgggtagaacgctagctcataggattttgggcttatggcacacagaaaggagttgctggacaagttttggacattattgctgctgtgagatgtagtgctaggcaacagatggtctggttggtggatcatggattccatggcattgagaagcttgcaaggctagattgattgtgttctgccggggtaaatcttgcgtggcgttttgaacgtggattggtaaacagaataccatcttttgaacgtcggtagttccatgtccacagctgatggtggtggcctcgaatgtcgtactgtacgtacatgtcgatgattccgtctcatgatcctactactactatatccctgttctatgtaagatatgtgtactccaattcagacaggatatggacagctcacgatttttttatattgttctacacatacattttt

SEQ ID NO: 55858 - DNA, 368 bp, Zea mays
  Clone ID: LIB3068-058-Q1-K1-F6
gaaaaatagcaaattacagcaaaatttaagcaacatcaacatattcagaccatgacgagggacattggctatcacgaaaatgccgctaagttaaccgactaccaattctgatcacaaaggagtatttggtcagaagcccgcaggaggcattaagttcaacctacagttcccccaactaccaactaatattggttagcagacttctccctgtgatcgcaaaaatattccctgatcctcttatgggggcctagctagctgcttcccacccatgacccttcattgacagtagtttacaaccagcatcaactctgaaaaaatgggtgacccatcgccttccatcttataaatagtgcacgatcaggtacagc

SEQ ID NO: 55859 - DNA, 202 bp, Zea mays
  Clone ID: LIB3068-058-Q1-K1-F7
aaaatatcaaattacagcaaaattgattcaacatcaacatattcagaccatggcaagggtcattttctatgaggaatatgcctctaatttaaccaactaccaattcttatcacatatgagtatttgttcataatccctcaagatgcattaatttcatcctacatttcctccaactaccaactaatattggttatcatacttc

SEQ ID NO: 55860 - DNA, 434 bp, Zea mays
  Clone ID: LIB3068-058-Q1-K1-F8
aagaaaagatggataaggattgtattctttaattatttctctatgttttattacttaatgtacgaatttcaaaaattttgtattctattggattggatttgttcgataattcgaagaattacaacaaaatctttagaaatcacatttttagttaggaacttctatggattttattcttcttcttttctttggatccaaaatagaagaataaaagaataggtataagaattaagttaagtcgatccaaaaaggaaaggaggttcatggccaagggcaaagatgttagaatccgagttattttggaatgtattagttgtgttcgaaagggtaccaataaggaatcgacggggatttctagatatagtactcaaaagaatcgccacaatacgcccggacaattagaattaagaaaaatttgtcgttattgtcgcaag

SEQ ID NO: 55861 - DNA, 164 bp, Zea mays
  Clone ID: LIB3068-058-Q1-K1-G1
cggacgcgtgggaaaaaaaaaaaaaaaaataaaaaaaaaaaaaaaaaaaaaaaaataaaggggatatgaaaaaataaaaaaaaaaatataaaaaatattaaacttcataaaattttcaatcaagtctaagtgctttcaaatgtcttcaccatagtttactactt

SEQ ID NO: 55862 - DNA, 310 bp, Zea mays
  Clone ID: LIB3068-058-Q1-K1-G10
aaaagtcaacagattcagagacctgagatgcgcaaggaagctgacaaagcggggggccgtggcaaaccgaaaccggtggacgaccctgatcttctgagaaaaggttcaagttgaagcacgcactgtgggcacccgtttgatggtgaactatgcttgatcggctcgaagccagacgaaactcttgtggaggctcaaagaaattctgacgtgcagatcgctcgtttaacttgggtatacgggcaaatgactaatcgaaccatgtaatatctggttgcctccgaagattcactcacgatagctggagccttca

SEQ ID NO: 55863 - DNA, 432 bp, Zea mays
  Clone ID: LIB3068-058-Q1-K1-G11
cccacgcgtccgcccacgcgtccggcaactgctgaagtttgtatcttcagaaatcgaaggcatgggtacggagcgatcgtccacctgccagatggaaggcggcgtgatacctgacgcagagatcctgcagaggctgcagggatggacgagcttcagcagggagctccctgggatggtgctggagatcgagaggtcggtattcaaggagctggtggacgaggtggtgcatggggagtctgccgacggcccggagatgaaggcggcaggcaggcggagaaggcggcggctctttgcttgatatggtttgtgtgaccatcaccatgcaccgggtgggttgtccaagtagatgggcctgatcatgctgtaactttgattgccgtatgaactttttttctctctcaagggagaggtgcacaagttgtactgttgtag

SEQ ID NO: 55864 - DNA, 135 bp, Zea mays
  Clone ID: LIB3068-058-Q1-K1-G2
cgccaatgatatctgaagcggcacgcgttctctggagcagcatggaggcatttcacttcgtctgcggcatcattgggcatggggttctgcaaataggttaaactatgctctaacatacactgtattttgcgagta

SEQ ID NO: 55865 - DNA, 238 bp, Zea mays
  Clone ID: LIB3068-058-Q1-K1-G4
gcgggagccagaagccttacggaggatgatgacactagtagctgatctatggttgctgcggtgcaggccttcacgtgtgtttgcctctctacctaaagaataaatcaagctagcagcaaacctaccttcggcgtgtgtctacttgcttatcatagtgtgtgtccgtgtatgagagatgatgtactgtcacgaactcacgtgtgtatgagagaggatacatggtaagactatcactact

SEQ ID NO: 55866 - DNA, 418 bp, Zea mays
  Clone ID: LIB3068-058-Q1-K1-G7
ggaaaattcattattgaaagttttaccatcagcttccaagacatctttagtagagttagtgaccgtatttggtgtcatttcacatgatttatcttcaggtgctgcaatcaagatttaggagagttattaagctaccataaactatgtgaaaaacagtgttttcaactatggtacattctgcatgcgaagtatctagcatgctgatcaaaagaatcattaaccatagggaccaaaaatggttgaatttatttctccagtaggttatctctaaagcataaatgtttaggtacaaatttaagcaaaaaaagggtgaatgaaggttactgcccaacatgaccaatgaaaatcgaaggatctctgaattactgttgaagaccaagggaaggtatgctttcagtcaatcaggtatgacaaatga

SEQ ID NO: 55867 - DNA, 389 bp, Zea mays
  Clone ID: LIB3068-058-Q1-K1-G8
gaggagggtatggaagtggcaatggtagtcctgggtacggcgatgacaatggtggtgggagtggcactggtggcggaaatggcaatgctggtgggtacggaggaggaggcggcggttatggaggcggctacggcagtggtagtggtacagcaccaggaggcggatatcatggcggtggtggtgcacaacgctacgctgggcagaactagcaagaacaaccccttatgctagtttatgttaaataaacgatccattgttcatgtgactgagcaatttaagcagtgaaggatcttgactcgtgttatttgtgttaccatatgtattggttgttctatgtttaagatgaatgtacaccgctatttgtatgtcgaactcgttgcatggagatg

SEQ ID NO: 55868 - DNA, 173 bp, Zea mays
  Clone ID: LIB3068-058-Q1-K1-H1
gtgagtgagagagagacagatagatcgtctagcgttcgacgaccatggctaggcaacgagaattgggttccatgctggcgggtgctctgctcgttgcatacgacgtttgcgtacattcctacaaccgtgcactccatcgtcgtctgctacatgcacgctgggcaacaacctgc

SEQ ID NO: 55869 - DNA, 408 bp, Zea mays
  Clone ID: LIB3068-058-Q1-K1-H10
cccacgcgtccggcggcaccgccaccgcccaccacagaggagaccatcatcgctgtccgcggggcgcagctccacctcatcgaccccgaccgcagcgtcgacctcggcgctggcacgctctccatcgtgcgcctccgccagggggaccactccgtcgccgtcctcgcgcgcctgatccacgagaagtcccaccgccgccgcggcctcttccgcttgttcagcagcgggcggtctgacgctggcgccgagcaggagcccgtccagtggccgctggcccgcgatgtcgcggcggtcaagctcgaccccgcgcactacttcttctcgctccatgtcccacacacggaccacccggacgacaaggatgacgcggacggtgccgaagcggacgcggaggctgcgctgagctac

SEQ ID NO: 55870 - DNA, 324 bp, Zea mays
  Clone ID: LIB3068-058-Q1-K1-H11
gtgggtcggcttctcctacccctacggttcgggttcgggttcgtgaggttctggggcggtgggcttcgtgggtgagcggatcgagatggcggcgtctgatgttgagtaccgctgcttcgtcggcggcctgccctgggccacggacgaccactccctccacaacgccttgagcacctacggcgaggtcctagagtccaagatcattctcgatcgggagacgcagaggtcccgctgattctgcttcgtcaccttctccacggaagaggccatgcggaacgccatcgagggcatgaacggtaaggagctggacggacgcaacatcac

SEQ ID NO: 55871 - DNA, 447 bp, Zea mays
  unsure at all n locations
  Clone ID: LIB3068-058-Q1-K1-H12
gttaggattcagctatgtgcgagtagcaccaaaagcacctgcctccaattcagtgctcgagaagaagtcagctgctgcaaagggtaccactgtaactggcactgatgctgatctccgcagattgagcatggatgcagcccgtgagttgctgctaaaatttggcgtacctgaagagcaaattgataaattaacaaggtggcatcggatcgctatggtgaggaagctttcaagtgagcaagctgcatcgggaattactatcgatgaaattcctgttagtaagtttgcacgtggacaaaggatgtcttttctgcaacttcagcagcaaactagggagaaatgtcaggaaatttgggacagacaagttcagtcactttcagctntagatggtgatgacaatgccagtgacacagaagctcacagtgatctagactcatttgctggggatct

SEQ ID NO: 55872 - DNA, 74 bp, Zea mays
  Clone ID: LIB3068-058-Q1-K1-F2
tcccactcgtccgaaaaaaaaaaaaaaaattaaaaataaaaaaaaaaaaaaaaaataaaaagaaaaagtaaaaa

SEQ ID NO: 55873 - DNA, 432 bp, Zea mays
  Clone ID: LIB3068-058-Q1-K1-H2
gcgcggagcctcgctcgcttgtccccaccaacgccgactcgctcccaccaaacccacgagcctaagatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccaatccagtgtggaacgaagtactgcagctctcagtaacacatcctacgaagccagtgcaccttgaagtttttgatgaagacaagttcacagcagacgacagcatgggtgttgctgagatcaacattactgacatctacgatgctgcgaagctggacctgaagcacgcctcttatgggacaaggatcaagacgatctaccct

SEQ ID NO: 55874 - DNA, 150 bp, Zea mays
  Clone ID: LIB3068-058-Q1-K1-H3
aaaaaaaaaaaaataaaaaaaaaaaaaaataaaaattaaagacaaaaaatataaaaaaaacgaacatgtttaaatccaacatgtgaatcatttaactatattataatgtcaattaaattccaataaaatggtccaatttttactatttta

SEQ ID NO: 55875 - DNA, 393 bp, Zea mays
  Clone ID: LIB3068-058-Q1-K1-H6
ggcgtcgccttcgctgtctccggcgaggggcccggcggtcttcgccgccgcggtcgtggtgtttctgccggtcttattccccgggttgttctcccctcttggccacgctttcccttctgtcttctcggagtggaatgcccctaagccaatgcatccttctcttttgaatgaggccttgcgatggacagttacggccaaaagaaagatctatggtcacccttgccatatcaggggtggaaaccatgcttaacgccatcagtttctcacaaattacctctggaaccaagtggtcattcaagtatttcttgatggtggattgaaccaacaaagaatggggatatgtgatgccattgcagttgcaaagattcttaatgctactcttgtgatcccaca

SEQ ID NO: 55876 - DNA, 411 bp, Zea mays
  Clone ID: LIB3068-058-Q1-K1-D3
gcaacgtgagcttagtggcactcttgaaagcgaggcggatagtaagacgaagaagcagagctcaaatgcaaagtccaaggagctcagcggccacgacatctttgctgatactctggattccaggtctaacagggcaaggaacccatcgaacggcagcacagcctcacacgcacctgccaaacatacaaacgccagcaccttctcgtttggagatgccaacactgacagcacgccaaagacggtaaggaagataaccggcaagaaggtcaacgacctcaccggcaacgacatcttcaagggagacgctccgccagcttctgcagagaagcatctgagcaccgcgaagctgaaggagatcactggaagcaacacttttgcagatgggaaagaaccaatccgcgagcgtgtggg

SEQ ID NO: 55877 - DNA, 266 bp, Zea mays
  Clone ID: LIB3068-058-Q1-K1-D4
cccacgcgtccgggttatgtaaattatccccctgatgtagtcaaccagaactacttacagggagatgcttgtaggtgttgaatgtaatgtatcattctttaattcccccccaagaattaagttattctccccctgtcttatgctgaggcttgtaaagttttgaaagttccaagtgtatagctgtactgtttgtgttgctgagtaaaataaaaaagtacacaatcaaatatcatctaaataatactcagaaaattaacctgctatga

SEQ ID NO: 55878 - DNA, 201 bp, Zea mays
  Clone ID: LIB3068-058-Q1-K1-D5
aaacaaaaacaaataacaagaaaaagcaaaaactacaaggcgaaaaactcaggggtaaggggacaaaacaaagcggcgtggctcgcacgcaatctgtcgtagcagtctccgtggtgggcgtagcgctgctgctggcaccggcggcgacaacctcggatgccggcctcacctgaagactctcgagctccggcatatcgccct

SEQ ID NO: 55879 - DNA, 278 bp, Zea mays
  Clone ID: LIB3068-058-Q1-K1-D7
tcagcagtcaccacttccaaggcattaccgagtcctactagcagtcgcactcaatgttcaagggactaaacagggggcatggctcgcacgcaatctgtcgtagcggtcttcgttgtggccccggtgctgcttctggcaccggcggcgacgaccttggaggccgccatcacctgcgggcaggtgagctccgccattgcgccctgcctcttctacacccgcggcacggggtccggacccttcgcgttctgctgtagcggcgtcaggaaccctctgagcgc

SEQ ID NO: 55880 - DNA, 318 bp, Zea mays
  Clone ID: LIB3068-058-Q1-K1-E1
cccacgcgtccgcccacgcgtcctaggccatcaacaattttacatatacactactctctggggtaacgatatctaacggtctacattccctccatgctaataggctaacctgtcctctatttaatctctttcatatgttgaaattgacttgtacttactaacactcttggctgacttacatatacatgagctcagctatagatctctgcctttattacacatcctcaactgagtactaatccattctcattctactatattggccttattaactatattaccacttctttaccatctttaacaaagacctccactttt

SEQ ID NO: 55881 - DNA, 389 bp, Zea mays
  Clone ID: LIB3068-058-Q1-K1-E10
ctgaacttcattttacgccatgagttatcctcccaggtttccactcgaagatgggactgagctttgcaagttgtgcagtgtgaaaatgcaaatccttccttaacagatcgccagtggtcaagacaagaacggtgaacaaactgctgagttcccttgcacatgcaaggtgatattagctcatcacctatctcagactcagcctcaaggcaaatgcggcaacacgcagcagaagagccgtcggtctcttcatcctcaatctccagcaggttcacagttgctggctgtggcggtgacagctctactgatgactctgactccctgttctccctcccaataagagggtccgaatcatttgggaccacctcttccagttcggtgttcctatccat

SEQ ID NO: 55882 - DNA, 409 bp, Zea mays
  Clone ID: LIB3068-058-Q1-K1-E11
cggacgcgtgggcacgcgcgcgcagtccaaggccggatcggcggcctctcagagctcgggggccgccgtgagacagagaccgaagggggggttgaccggtgctccggaggaagatgtttagcgggacgcagcagaagtgcaaggtgtgcaccaagacggtgtacccgatggaccagctctccaccgacggcgtcgtcttccaccgctcctgcttcaagtgccagcactgcaagtctaccctctcactgagcaactattcctcgttcgaaggagtgccgtactgcaagacccatttcgagcagctgttcaaggagaccgggagttacaacaagagcttccaatcacagtcacctgcaaagattactccggaaaagttggcccctgagctgaccagatcaccaagcaaagc

SEQ ID NO: 55883 - DNA, 423 bp, Zea mays
  unsure at all n locations
  Clone ID: LIB3068-058-Q1-K1-E12
cccacgcgtccgcaaggatatgacaatgatggatcccagggaatgagctgccggtctcaacaagcactctctatccctgggatccatcatctacatacatccatgagcctccttacttcaaggatatgacaatgactcctcctggcccgcgaccggtgaaggatgcatattgccttctgaactttggtgacagtatcacaactgatcacatctcgcctgccggaaacattcacccagacagcgcagctgcaacatatctgaaggagcgtggtgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggngagaagc

SEQ ID NO: 55884 - DNA, 441 bp, Zea mays
  Clone ID: LIB3068-058-Q1-K1-E2
cccacgcgtccgctgagctccacggtcccgtacacggcgctccggcccgacgtgtacgcgccgttcgtcaaggcgttcgacgcggcggcggccgggcccaacttcccctggatgtccagggtcgccgcggtggcgccgttcgaccggtgctacgactccaccaagctcccgcagagtctgctcggctacgccgtgccgcagatcgacgtgatgctggagggcgggcagaacttcacggtgctcggcggcaactccatggtgcaggtgaacgccaacacggcttgcctcggcttcgtccaggcgccggggcaagcgccggcggccgtcatcggtgggttccagctggagaaccacctgctgctgctcgacgtggacaagaagcagctcggattcaccactttcctcaacgcaatcgggctttcctgcagcagcttcaatttc

SEQ ID NO: 55885 - DNA, 343 bp, Zea mays
  Clone ID: LIB3068-058-Q1-K1-E3
cccacgcgtccgcccacgcgtccggtcgtcaaatgcatttgctcgcaagcttctatcttgatcaattgtggttgaggctcttcacttccagtatgatgagatggaccctaattcagccttcaattggttagagaggtggacgataagtcatgtctggaagcccacttcccagccaaggagagttagtgctgatgctaagccacatacaaggaaggccagctatgcaatggaaacagagtcagtgaaattaaagcgtaatgcacggaggagctctgcagtgccatttgaaccttctcaaacaaacactgccattgaaattgagaagacaagacggaatccaagg

SEQ ID NO: 55886 - DNA, 280 bp, Zea mays
  Clone ID: LIB3068-058-Q1-K1-E4
ccaatttccgaatcgaccgcacgcatgcacccactcgtccgcccacgcctactacctttcagaccacgctctatcacactacatacacgatcagcggctatatcaaggttcacagttgctcctggtcccaatttatcctcactctgcattctatatgatacagtccttatcaaccattattatgactcaacccaactatcctaaacttatattcactcctacaaccctattaattacgatacaaatcacatcttccataacatcacctatatacgcacta

SEQ ID NO: 55887 - DNA, 417 bp, Zea mays
  Clone ID: LIB3068-058-Q1-K1-E6
atcgtgttgtggccggagagacgagaggactccagagagattccgacaccgcggggctgagatgccgccggcggcgccgccgtcgcagcagcagcagcagcagtccggcatgactctctgccgccttcccacggacactcttggccttgccctttctctcccctgtttgctacctcgttcccgcccccgcctgtgcttcgccgcacgtcatgccagggccgtcgccgccagggcttcctcatcctctgcatcaccggactcttcattcggttcgcggatggaggagtccgtcaagaagacgggggccgacaaccccgttgtcatctactccaagtcatggtgctcatattgcatggaagtgaaggcgctcttcaagcggatcggtgtgcagccccatgttatcgagcttgaccatct

SEQ ID NO: 55888 - DNA, 422 bp, Zea mays
  Clone ID: LIB3068-058-Q1-K1-E7
cggacgcgtgggcttgggcctttatgttcataacgacgttatgcttgcttttggtactcgagaaaagcaaatcttgattgaacctatatttgcccaatggatacaatctgctcatggtaagacgacatatgggttcgatatactcttatcttcaacgaatggccccgctttcaatgcaggtcgaaacatatggttgcccggatggttgaatgctgttaatgagaatagtaattcgcttttcttaacaataggacctggggatttcttggttcatcatgctattgctctaggtttgcatacaactacattgattttagtaaagggtgctttagatgcacgcggttccaaattaatgccggataaaaaggatttcgggtatagttttccttgcgacggcccaaggcgcggcggtacttgtgata

SEQ ID NO: 55889 - DNA, 411 bp, Zea mays
  Clone ID: LIB3068-058-Q1-K1-E8
cggacgcgtgggcggacgcgtgggcggacgcgtgggttcgcagccgctataatatctggtcctgtatgggttatgaatgttgttcctggtcagaagccattgacacttggagttatttatgataggggccttataggggtttatcatgactggtgtgaaccattctcaacgtatcctcgtacctatgatcttattcatgctgatgcaattgactccttgataagtggcccgatttcaggcactagcagatgtgacctgtttgatgtcatgttggagatggatcgcatactgcgcccagaaggaactgccgttatacgggcctcgccagacgtagtagccaaggcagcacagatcgctcagtcgattcggtggaaggcacaggtgcatgacagtgaaccagaatcaggcagt

SEQ ID NO: 55890 - DNA, 186 bp, Zea mays
  Clone ID: LIB3068-058-Q1-K1-F1
gcggctagttgttcctcctggttctggtattgtgcaccaggtcaatcttgagtatcttggcagagttcgtttcaacacagatgggattctctatcctgacagcgtagttggtactgactcacacaccactatgattgatggtttgggtgttgctggctggggggttggcggtgtagaacccaaggc

SEQ ID NO: 55891 - DNA, 447 bp, Zea mays
  Clone ID: LIB3068-058-Q1-K1-F11
ggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaag

SEQ ID NO: 55892 - DNA, 312 bp, Zea mays
  Clone ID: LIB3068-058-Q1-K1-D2
cccacgcgtccggggactaggcgggctactatcgtctgcatgtccacgtgctacccgcgggcgggcgccgtcacggtgcgcgacggcgagccgctcaccgtcgtgtccaggtacagcagcgaccggcgccacacgggcgtcatgggcctcttctacatcctcgtggccgaccacgcccggcagctgccgccgcaggagggcctgtgcttcagctttccggtcccatggtgcctaccgtcatggctgtcgagcaacctgtgagatcttttggtgttgaaagctggtgctatgttctaattagctgcttggtta

SEQ ID NO: 55893 - DNA, 270 bp, Zea mays
  Clone ID: LIB3068-058-Q1-K1-F12
tcatccttccaccaaaaagccaaaagattataatgattcgattttagcccttcttaaaatgtaacctgttctagaacctctttcacactcatatcacttccttgtactacttaaaaaataaccacatactcatatccaatttttcataatcaactacttaacatgctaattaaccatattatgaaatactaacttttaatcattcatcttattaaatactataccatatccataattatattcaacataagacacattcaaatacctcta

SEQ ID NO: 55894 - DNA, 334 bp, Zea mays
  Clone ID: LIB3068-015-Q1-K1-H3
gagcactaccgacaacagcaacggtaacaacagcaacagcggcggcgcgcaggccgacgccgcccgcgagccgtcccgcgtgttcacgtgcaactactgccagcgcaagttcttcagctcgcaggcgctgggcgggcaccagaacgcgcaccggcgggagcgcacgctggcccggcgcgcgctgcggctcgacgcggcgggcccctactacggctacggctacggctactacgccgacgtcgcgtccctgccgctgtacggctcctgcttgtaccccatcggcatccaggcgcacgcgtcggcggcagcgcttccggagcacgaggacgcgcgc

SEQ ID NO: 55895 - DNA, 215 bp, Zea mays
  Clone ID: LIB3068-015-Q1-K1-H6
agatttaatcaatgccacttgcaattggagcgcgaacgccttaacgctattcacctcgtgcactgatcagaatcaccgcatgcacactggaatcttgacttagaagcgtgcatgcgtaccccttgacacaagaactcctaccgattggcttttcaacaaatcacaatgaccacttgaggcaatcaactgttgctctaggactaggtggatttact

SEQ ID NO: 55896 - DNA, 281 bp, Zea mays
  Clone ID: LIB3068-015-Q1-K1-H8
cccacgcgtccgcaatttttcattcattatcattccttcatatgatagctaccttttgaaaattcagttgtaacatttctgatttaaatgaaagatacatctgaaagttcaaaaaaaaaaaaaaaaaaaaaaaaaaaaaaaaaaaaaaaataaaaaaaaaaaaaaaaaaaaaaaaaaaaaaaaataataaaaaacaaaagaaaatttaacccactggctttttaaccaaacgcaatgaacaaattgtgtgaattaaacagttactttcatactatggtgaa

SEQ ID NO: 55897 - DNA, 273 bp, Zea mays
  Clone ID: LIB3068-016-Q1-K1-A1
ttccactcgtcctaccactcgttcgaccactctttctaaaaaaaataaaaaaaaaaaaaaaaggaaataattaaaaaaataaaaagatcataaaaaaaaaaaatataaaataaaatataataatataaaaaaaaattgaaaaagaaatctactaagtataaatattatgacgaataaaaaaattgtcaaagctacataaaatctgtactcattgtataaatactaacttatttaaatatacgtttatgaacataaaatttattatgttaaaaa

SEQ ID NO: 55898 - DNA, 368 bp, Zea mays
  Clone ID: LIB3068-016-Q1-K1-A10
cccactcgtccggccactcgtccgcccacgcgtccgtgatctggtcgcgcgcgtagtcgcgcggcatcgggcccgtcagctggatgtacgacaggaccagctaccggaactgcccctgcaccagcctctccgggatgctgaccgtcagctggttgtgccccatgtccatcgaccgcacgctgggcaggtcggcgaacgactcctggatgccgtgcgtgagctggctgctggagaggtccaccgagtcgaggccgaacatcctctccagggacttctggatcgcgccggacacctaggtgtgggagacagtcatgaactgcaagttggacagcgcgtgcaggcacgccgtgatggggcccgtcagccct

SEQ ID NO: 55899 - DNA, 200 bp, Zea mays
  Clone ID: LIB3068-016-Q1-K1-A12
tacaggcattcggccactctctatcccacttctccaatagatcctacagctcttatactggggtaatggcaccctacaactggatcatcatcaggaacacagaccgcgactggagttgcagactgcgcatctacatgcagcattcttgccgagatcctcatagatccatactacccgatgctaaacaacatcctgaacta

SEQ ID NO: 55900 - DNA, 372 bp, Zea mays
  Clone ID: LIB3068-016-Q1-K1-A3
gctgggaagcacgtgccccgtgctgcttttgttgaccttgaacccactgtcatcgatgaggggagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggta

SEQ ID NO: 55901 - DNA, 364 bp, Zea mays
  Clone ID: LIB3068-016-Q1-K1-A4
tcgccacgcgtccggccactcgttctcccacttttgactttaaacccactgtcattcattatgtgagagctggcacctaccgtgggctgtgccaccctgagcagctcatcactggcaaggatgatgcatccaacaactttgcccgtggtcactacaccattggcaaggagattgttgacctgtgccttgatcgcatcaggaagcttgccgacaactgcactggtctccagggcttcctcgtcttcaacgctgttggtggaagaacaggctctggccttggttccctcctcctatagcccctgtctgttgactactgcagaaaatccaaacttgggttcactgtagacccctttccccccaattt

SEQ ID NO: 55902 - DNA, 247 bp, Zea mays
  Clone ID: LIB3068-016-Q1-K1-A5
tcgcgtacgcgtgggctgacgcgtggtcttacgcttgtgaaaaaaataaaaaatatacgagataggtaaatataaagacgtagcgaatgaaaaaagaaaacatctattatgtacgtccaacatattctgttaactaaccagcccattatagtcatggctactaattatagagcggtcatttctctagtactacttatgtgcatcgatagcccttaatgcttgcacggcccttaaactgacgttatgc

SEQ ID NO: 55903 - DNA, 366 bp, Zea mays
  Clone ID: LIB3068-016-Q1-K1-A6
cggacgcgtgggcaaggtggctggtgagatgtgtctctcgctatgttggatcactgctggtgcgcgcagatgtaccagggcgagaagctctgcctcaacatgcacttctagctgttgtgggtcaagaactgtctgaggtgcagcctcacgcacacattgtgccttggcctcacgcagtggctggcgtaggagggccgattctggtggacttgggcatggagaaacacaactgcacaatgatgacgaggtggcttcgaccgaggcttctgcctctactgctcctgatttgtatggtaaaccaagaacctgcaaggatggatggagcaatttattatctgtggactctgttatggatggatcagttgc

SEQ ID NO: 55904 - DNA, 173 bp, Zea mays
  Clone ID: LIB3068-016-Q1-K1-A7
gacccacgacccactcctacgaatagccttcccaatctgcttttttatttaactcctatcatcatcaatgggagagctctcacatactcccggctgttacaccctgactaaataatcacttctaactattatgcatcacgacacactcttacctgcatcactaaaacacacat

SEQ ID NO: 55905 - DNA, 259 bp, Zea mays
  Clone ID: LIB3068-016-Q1-K1-A8
gccacgcgtcgccacgcgtcgccactcgtcggcgacctgtcccacggcatgcgaggagggcatagccatggtgcggcgagcctttgcggcgcgaggcgctagcggtcgggctgctgcggcaccggacggcgcctacgcgcccgtcggtcccgtggcgatcttgctcctgcggtggccggaggcgccgggcggcatcgcggcgttcggtgcgcgcagggcgccagaaccggccggcagagcactgcacaacgcatactac

SEQ ID NO: 55906 - DNA, 439 bp, Zea mays
  Clone ID: LIB3068-016-Q1-K1-A9
gctgattccttggaagctaaggagctcaagaagcattgtgaggatttagctattcgcaaggtcgattacattttcacagtgggagcttcttcaattatgaatgcttcttctgaaattcttgtgaacttagagaaattgctagatgagaaatcctcagagccttggagtcagcaccgtcttcccacaatgacagctacctatcctgctgtcattgacagtgatgtagaggaagatgaagcaagagaattccccaagacccgtaaatgtgggaaatctgcatcaaggccatctgcgatgtctagtgatgacagcttccttcagaaagactgcaccgctgaacaagccgtctctaagcagatcagagcacttcgcaagaagctgcaacagattgagattctcgaggctaaacaacttgcaggtcatcagcttgacagtcagc

SEQ ID NO: 55907 - DNA, 290 bp, Zea mays
  Clone ID: LIB3068-016-Q1-K1-B1
cccacgcgtccgcccactcgtccgccaaagggctgtatcacctatgaaagctgcaccccctgctccaaaacgagatgttgctcagattgaacaaggtcttatcagtgctgaaaaggatgcccagcagcgtcctagggaatcatctacacgaaggaagccagcttcaccaccgcggaaacgatctccaaatcgaagggctgaatcgcccacgcgtgcacctgacccatcacctaagcgtcgtcctgattctacgactattcgtcgccgaccagatccttctcctgtcaagc

SEQ ID NO: 55908 - DNA, 443 bp, Zea mays
  Clone ID: LIB3068-016-Q1-K1-B10
gaaaatattggtgctaaattggtccgccaagctgcttctaaaacaaatgacttggctggtgatgggacaaccacttcggttgtccttgctcaagggatgattactgagggtgtaaaggttgtagctgctggtgctaatccagtgcagatcacccgtggtattgagaaaacagccaaagcactagtcagtgaactccaaaagatgtccaaggaggttgaggacagtgagcttgctgatgttgctgcagttagtgcgggaaataactatgaaattgggaatatgatagctgaggctatgaaaaaggttgggcggcagggagtggtcacacttgaagaaagaaagagtgctgaaaataacctctattctgttgagggaatgcagtttgaccgtggctatatttctccctactttgtgactgacagtgaaaaaatgacagtcgagta

SEQ ID NO: 55909 - DNA, 406 bp, Zea mays
  Clone ID: LIB3068-016-Q1-K1-B11
cccacgcgtccgcccacgcgtccgcggacgcgtgggcgcaaccctctctggtctctggtcgtcctactttcttccacagcagaaggaaacttgagtcgtgagcgcagtggtgcatccaatccacaaagagctgaggttagtcagccatggcggcaccgtcgaccgaggactgcggctggctgctgtacctctccctggccgacaaatgcggcgaccctagccgcctgctcggcttggcggcggtcttcgtcggcgcctgcgtcgtaacgtcgctcctgcactgggcgtgcccgggcggccccgcctgggggcggtactggtggaccaggcgaggcgggctgggcatcggtcgggccgccatcccggacccccgggccctgcagtggtccgcagcatggggctgatg

SEQ ID NO: 55910 - DNA, 389 bp, Zea mays
  Clone ID: LIB3068-016-Q1-K1-B12
gattgttgtactgtactcatgtgctggagctctacttttcattgtctccattcttttgctgagatctgctatctttggcatgctatgggttctccttgggaaacgcgtgtggttcttccccaatataaatgcggaggagacaacttttagagaactcgttcgcttttggcctgaataggatgtatgagtgcggccaaagtggacatgaagacttttttatgcccttgttgctctatcggtgatattactgcttaggcatcatgctcctgacgtagcagcttgagccaggtaccaaaagaaggtttctaacataatctatgacgatcttgaatggtctccgaagttagctatgtctggaatgatcgaaaagcacactgctgctaacatta

SEQ ID NO: 55911 - DNA, 445 bp, Zea mays
  Clone ID: LIB3068-015-Q1-K1-H2
cccacgcgtccgcccacgcgtccgcccacgcgtccgctgtgctcctccatatcgttctgaggattatgctggagatctgagagtagcagcttcaaattggaatggaaaaggctctttcctattcacctcgagtactgctgtgtatgactgcagtgacaatggattctgcagtgaggattctccttgtgtacccattggtcaaagcactcgtactgatgtgcttctaaaagctgaaaatgttgtccttgaggcaggcggctgtgttcttaggctagtaggactttataaatcagatcggggtcctcatgtttactggctgtcaaaaggaaccttggatgtgcgtcctgatcatatactcaatctgatacattatgaagatgcagcctctcttgtaatttccatcatgaaaaagagattacggagctgcatctttgtgggttgtgac

SEQ ID NO: 55912 - DNA, 118 bp, Zea mays
  Clone ID: LIB3068-016-Q1-K1-B2
ttccactcgtctctgctagcggtcttcctcgatctagaactagataaaaaaaatacaaaaaatgataaaaaacaaaacgttaaatcaaattgtaaaatgtcttacaaatgctttaaaa

SEQ ID NO: 55913 - DNA, 374 bp, Zea mays
  unsure at all n locations
  Clone ID: LIB3068-016-Q1-K1-B3
ccaaagatagaagtcaagagggaaaagcgatgcacaacgtggacagagacttgcatgttagtcagacaccttctagattgactgcactccctccaagtagagaaggttgcctggagatatatttgttaagtggagaaggggaaaaccgtacagttcactacanaaagctaagcgtggcttgaaatctgcatggtgctttctgtcgattattaattattcaatgatatagtacgaagttatacatagatgcgtatgtgagacccaatgaaaccaaatttagatatntggcataccatgctgttcttctgccaaaaagatgcaacgctcttctttacaaaggtctctctctagtggtgaagtcttagtggaactgt

SEQ ID NO: 55914 - DNA, 337 bp, Zea mays
  Clone ID: LIB3068-015-Q1-K1-F3
gtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcggcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagct

SEQ ID NO: 55915 - DNA, 429 bp, Zea mays
  Clone ID: LIB3068-015-Q1-K1-F4
cccacgcgtccgcccacgcgtccgatacagctagatagcctctgcatgcctacgtacagcatggccaaggccgagctgctcctcgccctcgtggcttcgctcgtcgtgctgccattctcctccctcgccgtgtaccaggacttctgcatcgccgacctatccgccgccgccacgccgggcggctacccgtgcaaccccccgaaggacgtgaccgccgacgacttccactatggcggcctcgccacccccggcacggcgctgaaacccttcaagatctccctgggctcggccgtcgtcaccacgttccccggcctgaacgggctgggcatctctgccgcgcggatggtgatggtcccgggcggcgtcgcgccgctgcacttccacccgggaggcaccgagctcatcttcgtcatcgagggcagcgtcgtc

SEQ ID NO: 55916 - DNA, 365 bp, Zea mays
  Clone ID: LIB3068-015-Q1-K1-F6
catgcgcggaagagccatgggcagcgagcacgctgcggggtgcgatgctactcatgcggccgacgccgagcttgttgtacaacgcgtgggtgttcgtagcggacaacatcgcgcacatatgtaagcctgccgccatctctgtacgtgatgacgttaaacggcgtcagcacgcagtgcatctcgctgcacagcaccgtgaacgtctgcaacccctacgactaccactttggcatctgcgaggtgacctacacgctcctgtacgcctgcaaggtcgtggtgtgctccaccatgcgactacacctgctggatcctcgacagcctgtgcatctcgcttgagatgatcgtgaaggtgccctacgacttcc

SEQ ID NO: 55917 - DNA, 201 bp, Zea mays
  Clone ID: LIB3068-015-Q1-K1-F7
cccactcgtccggcccttttgttccacacgagatgtctgagctcgttgagctcatgtcaagacacctgcgttatctcataacagatgtgctctcccagccaaactccccacttgacaatgtcttgcgctcagatcggcccacataggccggtccttgctgtcaaaacgagaggcggtgcccagctaaggacccacggaata

SEQ ID NO: 55918 - DNA, 442 bp, Zea mays
  unsure at all n locations
  Clone ID: LIB3068-015-Q1-K1-F9
cccacgcgtccgcccacgcgtccgcccacgcgtccggcagaaccttgaagttaaaaagatggatgatgagagaaaggctgcattggctgcccagtttgcagcagaagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaaggaggcagctctgctagaagcagagaggactgtgcaaattgctatggcaaaagctgctatggttgacgatttgcaaaacaggaaccaagagttgatcaagcaaattgagatctgccatgaagaanataaaatcttagataagctgcatcgccaaaagattgcagaagttgaaaagctt

SEQ ID NO: 55919 - DNA, 362 bp, Zea mays
  Clone ID: LIB3068-015-Q1-K1-G1
cccacgcgtccgcggcgcttctcttcttgctccttgtaacgtgtggctcgtgcgcgagaccggcgagctttaacgcctccgactttaccgccgaccccaactgggaggctgcccgggccacctggtacggtgcgcccaccggcgccggccctgatgacgacggtggtgcctgtggattcaagaacgtgaacctgccgccgttctcggcgatgacatcgtgcggcaacgagcccctcttcaaggacggcaagggctgcggctcctgctaccagatacgatgccagaaccacccagcctgctccggcaacccggagacggtgatcatcaccgacatgaactactaccccgtggccaagtaccac

SEQ ID NO: 55920 - DNA, 120 bp, Zea mays
  Clone ID: LIB3068-015-Q1-K1-G10
cggacgcgtgctaaaaaaaaaaaaataaatataaaaaaaaaaaaactaaaataaatgtaatatgggaaaaaaaaacataaaaaaaaaatacaatagtccttgctctgttctggttccact

SEQ ID NO: 55921 - DNA, 456 bp, Zea mays
  Clone ID: LIB3068-015-Q1-K1-G11
cccacgcgtccgcccacgcgtccggaaccccatttcaactccagctcaaaggacgacgactgctccagccttgagaccatcgtgaagtgcaaggaagctgaggcgaaactgttccagaaactggccgatgatgccaggaaggaggtagacagctaccggcagatcgtccgcaccaagacccagaaactagaggaggagtacgccacgaaggtggcaaagctgtgcttccaggagacggaggagaagaggaggaagaaagttgaagagctgaagacgctcgagaactcgcactacgactaccacaagatgaagctgcggatgcagaccgaaatccagggcttgctcgagcggatggaagccacaaagaagatgtgggtataggctcctgttaacaatttcatgttgctgctgcttaatgtttcgggtatagactccagctaacaactgcctgatgct

SEQ ID NO: 55922 - DNA, 313 bp, Zea mays
  Clone ID: LIB3068-015-Q1-K1-G12
tttactcgtaagctgactctgctttggatttaatagaatacgccctcattaaaggcaacgggggtccattcacccttggtcagttcaatctggtggacattgcgtatgtaccattcatcgagaggtttcatatattctattccaacatatagaactattatattacaaatggcaaacccaaccttcataagtacattgaggaagtgtacacgattgatgcatacacacagactatacatgacccacatcttttacttgatcatacatataatcatcttgggattgctttaaaccttgctgcctatgatgactc

SEQ ID NO: 55923 - DNA, 450 bp, Zea mays
  Clone ID: LIB3068-015-Q1-K1-G2
cttttgcacaacagcaagtctcctatttgggccatgtcatcaatgctcaaggtgtagctacagatccagttaaaattcaagctattgccgagtggccagtgccaaactgtctcaaggatttacgcagttttttgggccttgccggctactacaggaagtttattaggcattttggggtcatttgccagcccttgaccgctttactgaagaagggcagtctgtttgtttggacaaatgatcatggtattgcatttgacactttaaaaaaggctttggtgacagctcctgttcttgcattacctgatttcactgctgcttttatcgtggaaactgatgctagtgctgacggtgtgggtgcagtcctcatgcaaaaaggtcatcctctcgccttgcttagtaaggccctgggtcccaagtctaagggattgtcaacatactaaaaatagtact

SEQ ID NO: 55924 - DNA, 199 bp, Zea mays
  Clone ID: LIB3068-015-Q1-K1-G3
cgcaactgcgaagctccccccagttcccacggtttcccccacgacgccggcgatgggcaagcggaaacagcgcggcggcggcgacggagaacccggcccggaaagccgttcttgccgaagacacaagcccttcaacggggtcggtttcaaacttccctacaccttcaagtccttcgatctctaggcggtgtttatcgag

SEQ ID NO: 55925 - DNA, 382 bp, Zea mays
  unsure at all n locations
  Clone ID: LIB3068-015-Q1-K1-G5
gttccttgttcggtcggaacgcagcgcagcggcggcggcgatagggagagaggagagagtctgcaggatccagcaggccgaggaaggagtcagcggcgggccggagaaaatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcanaagtggtggatatgtacanagaggcttttgaaagcatcgagatcccg

SEQ ID NO: 55926 - DNA, 453 bp, Zea mays
  Clone ID: LIB3068-015-Q1-K1-G6
ctaccagctgcacacttacttgcaggggttttcgctgttgtacaccttcatcgacaccatgactctgtgccctgggtggctctttctggtgatatttatgacggtgtacttcttcgttgtgaggcgcaagtggtcgccgcactttctgaggttccatgtgatcctagcgatccttctagacactggctcccaagcagtggccaccatgtgtacctggatgccaagcatcgtttatcaggggaagccaatgcagtacttctggatgtctatcgcgttcatacagatcttcacagtgctcgagtgtttgcgctgcgctctgtgtggaatgtatcctaatgtcccattcatatcccacaccgctttcattcactctgatctgaatctgttcaggtaggtgcttactacataaggtccaggactcaaggaaagatttcggaatggctacttacagtt

SEQ ID NO: 55927 - DNA, 309 bp, Zea mays
  Clone ID: LIB3068-015-Q1-K1-G7
gtaccatgtgcgcacttacactcaacgcattttcggtggtgatcagcatagaggagagagtgggtatgatccatgagggggtgtaactagtcatatttatgacggagaacttgatcggtagcaggcccaagaaggtggtcgacgtttctgatgatgcatgtgagactatcaatgactgtaaacacttggtcaaaatgatcggcaaccacgagtacctcaatgacatggatggcctatgacgggctgtcaatgacgtacttcaggatgtctataccaagtcatacacagtatccacagtgctatagatgt

SEQ ID NO: 55928 - DNA, 164 bp, Zea mays
  Clone ID: LIB3068-015-Q1-K1-G8
caaagggttccagcggaggtggagatggttttgaagtcacaaagtttgggcatggtcgtgttgcacttattggatttcccagtgttggaaagtcaactcttttaacgatgttgactgggacacattctgaagctgcatcatatgagttcacaacgcttacttgc

SEQ ID NO: 55929 - DNA, 462 bp, Zea mays
  Clone ID: LIB3068-015-Q1-K1-G9
aatccccgtgctgagagctgagtgctgccttggttgctccgtactggactcgattgctcatcgcagcagaagcatcccgtcccctccgcttctccttgctctgctctggtaacacacagacaaaaaaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaacccaaaggaccgctggaggcacttaggcccaagcttcagccaacacgccaacaacagcaacaacgtgcaaggcgccctatttacacttcgtcag

SEQ ID NO: 55930 - DNA, 457 bp, Zea mays
  Clone ID: LIB3068-015-Q1-K1-F12
gacgaagacaaacttcagcaagacaagagactaggtgtggcaaaactagcagtaaacactcttgaatctgagattacccaagacgccactctgaagctgctacattcactggatccaattaaaaataaggacaccaaggataggggcacattacatcttaaggtaaagtaccacccctttacaaaggaagagcagctggaagccctagagatggaaaaacaagccatagaggagaggaagcgtctgaaggaggctgggataattggtagcacaatggatgctgttggttctggtgttggatttgtgggtactggcattggcgctggcctcggtttcgttggttcaggaattggtgctggcgcaggccttgttacctctggtattggtgctgtcagcagtggccttggtaaagccgggaagttcatgggcaggactgtgacagggcctttcagcatgt

SEQ ID NO: 55931 - DNA, 270 bp, Zea mays
  Clone ID: LIB3068-015-Q1-K1-H1
aaaaaaaaaaaaaaaaaaaaaaaaaaaaaaaataaaaatataaaaaaaaaaaaaaaaaaaaaaggaaaaagaaaaaaaaaaaaataataaaaatacaaaaaaaaaaggcccgccttttttacgtttccatgccttgggtttgccttcttttggcttccaggtttttttttgcggtcacctaactccctttttctgttctcgggtccccaactttacttcctgtgaccctccttgtgctaccctcctttttggaatctcctgtttttcccc

SEQ ID NO: 55932 - DNA, 357 bp, Zea mays
  Clone ID: LIB3068-015-Q1-K1-D2
acgcccacgcgtccggcaggtggtacctttgatgtgtccctcctcaccattgaggaaggaatctgggagggcaaggccacagctggtgacacccatcttggtggtcgaggactctgacaacaggatggtcaaccacttcgtccaggagttcaagatgaagaacaagagggatatcactggcaaccccagggctctccggaggctgatgaccgattgtgagacggcgaagaggactctgtctttgactggccagaccatgattgagattgactcgctgtatgaggtcatggacttatactgcaccattacccgtgccaggtttgatgagctcaacatggacctgttcaagaagtgcat

SEQ ID NO: 55933 - DNA, 136 bp, Zea mays
  Clone ID: LIB3068-015-Q1-K1-D3
gttctagatcgcgggcggccgctcgcgatctagaacccactccgcttttgcttggttccagtgggacgggagagggagaagctagctagctagcagcagctctgttggtgtgtgcgtcagtgtgggtgtggagggt

SEQ ID NO: 55934 - DNA, 261 bp, Zea mays
  Clone ID: LIB3068-015-Q1-K1-D4
cccacgcgtccgaaaaagaaaaggcaaagtctaaggaatcccaatcaggcaagcaaaatgaggaaccggcttctgcagagttcggagatctcatctcatctgatctctcattttcgacctgctaatcctcctctcatttgcatacaatatactttatttgaacctcttcgtatctcatttctcatcatctccttcatctattcattatagactatttccttatactcttattaacctatcttacacttcattataggatta

SEQ ID NO: 55935 - DNA, 340 bp, Zea mays
  unsure at all n locations
  Clone ID: LIB3068-015-Q1-K1-D5
gcacggtgcgcttgcgggacgccatctcgggccactggtggagctcgtcggcgacgcggagcgggaacatgaacccctcgtaggtctggtccacgtagcggcggctcttgtagtgccagaagccgaggaccggctcggtgtcgccgaggacgccggcctnctccagggcctcgcgccgggcggcctcgtccatggactcgtccacctcccacccgcccttggggaacatcatgccgtgccccttctgggacgtgatcgccagcaccttcagctcgccgtcgcaccgcacgcggtacgggatgcagcccaccacgatgcgcccgccggtgctctggctgta

SEQ ID NO: 55936 - DNA, 402 bp, Zea mays
  Clone ID: LIB3068-015-Q1-K1-D6
ggaaaatgtgtacatggcgaagctcgtcgagcaggcggagaggtacgaggagatggttgaggtcatggataaggtagccaagactgttgactcggaggagctcactgtggaggagcgaaacctcctgtctgttgcatacaagaacgtcattggagcccgtcgtgcctcatggcgcatcatctgctccatcgagcagaatgaggagggccgaggcaatgaggaccgagttacactcatcaaggattatcgtggcaagattgagactgagctgaccaagatctgtgatggcatcctcaagctgcttgagacccatcttgtgccgtcttgcactgcccccgagtccaatgtcttctatctcaagatgaagggtgattactacagatacctcgctgagttcaagac

SEQ ID NO: 55937 - DNA, 477 bp, Zea mays
  Clone ID: LIB3068-015-Q1-K1-D7
cgtctcgggtcggaggatcccaggccgccacgaaaatgccacttcggtggtattctaccgcgtcgttctgaaccgagaaggacgacggtcatgtctcttgagggagatgcatgaggctcgggtacccccgctctacaacatcaagggctttccttgcctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattttattttggtttagttgtcaaatgca

SEQ ID NO: 55938 - DNA, 418 bp, Zea mays
  Clone ID: LIB3068-015-Q1-K1-D8
attgaaataagcatgtttgaggtctgcaaaatatacagtcgtgtaaaacagcaaacacgtggcatccacaaaatatgcctcagcacacaacaattttgcaggactaagggtctatttggttcgcggctaactgcgccaaactttgcctaagtttagttgtttgaattgaataactaaccttagaaagaaaagttaggcaaagtgttgcaagttatgcatcgaaccaaacaggccctaaatgttttgaaactgtatatatgaagcctgttgatggccacttctaggtagctgggatgatgaatgcattttcaagcacattctgtttggtggtgctgccaatgatgcgttcggctcggccgttctgggagaagtgtacgggcacgagcgacgcaactggatgccatgggtgaggaatgag

SEQ ID NO: 55939 - DNA, 368 bp, Zea mays
  Clone ID: LIB3068-015-Q1-K1-E1
tcgatgacgcatgggcggacgcgtggtttcctctagtcggcggtgccaagaggtggaggagggcgtgatgaagtccggcgagcgggcgaagcagatgcggggcgtccggcaggaatctctgcggttcctgcttctggtcatcgtcgccggcttcttcctcctcttcctgaccttcgtcgttatctacaagcccgattccatcctgtccagcctgaacggcaagctgcccgtggaccatgcgccgacgtccatcctgattcatcagaaggttaactcgccccccgccaccgcacttgagaccttcaccgacgcactgcgtggagaccctagagtggtcgatgacgaagccgatttatgaccacaggggt

SEQ ID NO: 55940 - DNA, 177 bp, Zea mays
  Clone ID: LIB3068-015-Q1-K1-E10
cgcccgccgtgttgtgcgtacgtacgtacgtatacatgtatgtatgtatatgcgcgcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 55941 - DNA, 387 bp, Zea mays
  Clone ID: LIB3068-015-Q1-K1-E12
tctcacgccttgtcttgcctacctttttacgtttacatatatacaattatatctatgcgtctgttccacgcaaaaccaagactacactgactattacaagcttactagcatgcatgcataatcattattataataataataataaaactatctcactgatccactttgctctacctctatcaataatgaaacaactgtatttaccttcattacttaattgtgtatgcttttactcctactttccgatttcatcatgtctttaacatctcattaattcactatatttctataacaaataattttattaaaggtcgatcactctatattatccaatcttacttactcttacattcaacgttatatcttttatataatttaatctaaatt

SEQ ID NO: 55942 - DNA, 413 bp, Zea mays
  Clone ID: LIB3068-015-Q1-K1-E2
ctgtttttagactggtcccctaataattatatatgaatggtgcaggacctgtttggtaggtgtgagagggaagtttttaatagccagtagcttcaaatttcctacaagggggcagattgtttctgttaactcaatctaactcaaaattcgaaataacactttggcctaaattaatcaagttttgtgaatcaaccaattcgagcataggtcaagggatcaagatttaagcaaatgtttaatcgtatcgagttctatatacttattaagcacttacctcatatatgaaggttccaccaggtactcaaagtggagtggaaggagggccatggtattttttttccttaaaacttcttaagtagtgttgcaaactcagggcctcttggctctggactaagcacaaaagccttaaattg

SEQ ID NO: 55943 - DNA, 285 bp, Zea mays
  unsure at all n locations
  Clone ID: LIB3068-015-Q1-K1-E4
ggtgagcgaggaaccccaccccacgtcgccctccccccacctttctctctagtctctagttgctagtctctacccccaggccccagccccccattcctgcctcttctctctctcggccacccgccccggccccaatgtcgccgcccctcgagccccacgactacatcggcctctccgccgncgccgcggcgccgncgaccccgacctnctcctcgtcgtcctcgtcctcgccggcgccccgcctcacccttcgnctcggcctgccgggctccgagtcccccgacc

SEQ ID NO: 55944 - DNA, 354 bp, Zea mays
  unsure at all n locations
  Clone ID: LIB3068-015-Q1-K1-E5
cggacgcgtgggcggacgcgtgggcgcctctagtcggcggggccaagaggtggaaaagggcgggatgaagtccggcgagcggccgaagcagatgcggggcgtccggcaggaatctcggcggttccggcttctggtcatcgtcgccggcttcttcctcgtctccctgaccttcgtcgtcatctccaagcccgattccatcctgtccagcctgaacggcaagctgccggtggaccaggcgccgacgtccatcctgatccagcagaaggttaactcgccccccgccaccgcacttgagacctncaccgacgcactgcgtggagaccctagagtggtcgatgacgaagccgattcaag

SEQ ID NO: 55945 - DNA, 280 bp, Zea mays
  Clone ID: LIB3068-015-Q1-K1-E6
cgactctagagcgatccaaggccttacttacgtcgtagcatgtcgactgtcatatgcttcttctatagtcgtcaccgtagaattcaatgtcgactggcacgtcgcttttacacagcgtcgtgacatgtggaaaactccttggcgttacgccatacttaagtcgcccttgcatgcacattcctccctttccgccatgcttggcgttaatatgcgatagaggcctcgcactcgatctgcccattcccaacaagtttgcgcagccctgaattggcgaatggga

SEQ ID NO: 55946 - DNA, 63 bp, Zea mays
  Clone ID: LIB3068-015-Q1-K1-E7
gttaactccacaaggacagtcgatggtactttgattcacatctcagcccggttccgttgtgtg

SEQ ID NO: 55947 - DNA, 401 bp, Zea mays
  unsure at all n locations
  Clone ID: LIB3068-015-Q1-K1-E8
aaggcccaaaaggcaggcagccatcacgatggcgcttgcccacctccccttcgtcctcctcgtggtgtcgtccgtcgccgctttcgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtctcttcggcacgagcgtgcagctgggcgccggctacctgtcgtccatcacgctggtgttcaccgncggcgagtacaacgggagcaccctgtccgtgcaggggcccctgctcgggttcac

SEQ ID NO: 55948 - DNA, 457 bp, Zea mays
  Clone ID: LIB3068-015-Q1-K1-D12
cccacgcgtccgcccacgcgtccgaaaaaataaaaaaaaaaaaaaaaaaaaaaaaaaaaaaagggcattgatcattacatggaatcctattaagatattatatgaaagtcgaatttcttccattctcatttgagaatgcgaatacaaggaggtattttgtgttcgggaaagtccgaagaaaaaaggatttggaatctaccttttcttttgctttttcccttataaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagctgctgtaagttt

SEQ ID NO: 55949 - DNA, 409 bp, Zea mays
  Clone ID: LIB3068-015-Q1-K1-E9
gagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtgcg

SEQ ID NO: 55950 - DNA, 426 bp, Zea mays
  Clone ID: LIB3068-015-Q1-K1-F1
gttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgtagacctcactgtcagaatcgagaagggggcctcctacgaggaaatcaagaaagctattaaggccgcttctgagggcccactcaagggtatcatgggctacgtggaggaggatctggtttccaccgacttcaccggtgacagcaggtcgagcatcttcgacgccaaagccgggattgccctgaacgaccacttcatcaagctcgtctcgtggtacgacaacgagtggggc

SEQ ID NO: 55951 - DNA, 132 bp, Zea mays
  Clone ID: LIB3068-015-Q1-K1-F11
aaaaaacattctaaacaaacaatacaataacatataaaaaaaaaaaccttaaatacatgataatggataaaacaaaaaaacccaaataaaaatgccaatttttcaaatgaaccaatttttccgaaaacaaca

SEQ ID NO: 55952 - DNA, 77 bp, Zea mays
  Clone ID: LIB3068-050-Q1-K1-A12
aaaatgttgaaagagaccaacacctgctacttcgacagccaacacaataactcccctatacaggcaaaatggcaaca

SEQ ID NO: 55953 - DNA, 369 bp, Zea mays
  unsure at all n locations
  Clone ID: LIB3068-050-Q1-K1-A2
cccggaagncccgggacgacccacgcacccgcccacgcgaccgaacacacgagcgaagagagggaaggaaggaaggaaccagaacggcacagagaaggccgaagggagaaggcaagccagagcagnacaccaggcgacgaagcaagcggcacgaggaggcggacaagggagnggncggcgcgccgccggcgagagccagagaaacgaccaagagcgcgcccacagagacgcgacgacacccgcgccagccgagacgccaagagcnacagccggccgaacagagcacggcgacgcgcaagccagacccgagcgagcccancagaggacacagaccagcagccgaccgacacggaaagaagncaccagcca

SEQ ID NO: 55954 - DNA, 415 bp, Zea mays
  unsure at all n locations
  Clone ID: LIB3068-050-Q1-K1-A4
cgcacacgtccgaaagaaactgcggcgncttttcctgccaaacgataatccgtctgcacgaacaagggtggctgaactatagaggcccttgattacacaggccgatccgtgtgtctggttggatgcaccgggggagaaactgcattcacaaatcctcaaagcacattctgcatgtctcactattctgcatgaccaggctcaacgggtgcaagaaacaacagctagccagacccgttagaaacggacgctcggcgcgtacgcacgcgtgcaggcccggcagagagccaagcccgctagaaacggacgcacggcgcgaacgcgcacttgcaagcccggtgcagccacacccgtacggaccaggctggcacagtgtatgaaaccagaaatgcggtatgtgactgacatggagatgcaa

SEQ ID NO: 55955 - DNA, 462 bp, Zea mays
  Clone ID: LIB3068-050-Q1-K1-A5
cccacgcgtccgcccacgcgtccgcttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgggttcatggaggaatttcgcaaggagttcaaggagaagaaccctaagaacaagtctgtcgctgcggtgggaaaagctgctggcgacaggtggaaatccctgagcgagtcggacaaggctccctatggagccaaggctaacaagctcaag

SEQ ID NO: 55956 - DNA, 455 bp, Zea mays
  Clone ID: LIB3068-050-Q1-K1-A7
cccacgcgtccgcggacgcgtccgcccactcgtccgcatcaacacttccaatgtctcatagttcatgggtcaaatggccatttgctgaaagtagttctactctacatctgattagcccatgacaacgacagctattttgcagaacgcaatcaccatatgcaatgccacatcaattttcacattgtcctggatcggtctcctttttctagtttggatttgttctgctagctaagtagctctcttattcttccagttcataggtgtgctattccctttttcctttttttgtcaagtgctcttcattgattcaaggtcacacaggtttgattctgaagcttgattttttttgtgtatcaactctgcctgctgtgttcttctttggttttgagatgagttgcggtttgagggagcgataagtatgtacagcagaatgcccgcactgtaacatcacaata

SEQ ID NO: 55957 - DNA, 204 bp, Zea mays
  Clone ID: LIB3068-050-Q1-K1-A9
cctccctctcctgatcccccacctgctctttcttcgtccaacgcatctctccccttatcagccatcttggcaaaatcgccatttctgccactttagatgctctttaagctgcaacatcatttccataacatgaccaatcacacctaccttaaaactctctaccatattatcaccttcttttccatccctcttgcacttacttcc

SEQ ID NO: 55958 - DNA, 376 bp, Zea mays
  Clone ID: LIB3068-050-Q1-K1-B2
cccacgcgtccgcagggagggcagctggtgtgcttgagaaccatgaggaggggagacgttgcgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggat

SEQ ID NO: 55959 - DNA, 341 bp, Zea mays
  unsure at all n locations
  Clone ID: LIB3068-050-Q1-K1-B3
gcgcgcaaacgaacacangaaggacgactggtatgctctttgaaccattatgataggacacgggagaccgggcatagcctattaagctttgcgaacgacatgactacttgaaacaggcctacgggcaaaaagtccttcactgaccctaagtgaagcacgccgactggcatagtactactactacgtgctactgaggatttcacacaatgctggcaactcaagctgttggcgacatccatcagctgtaaaagatctttcagcgctagatgatgactcgaattacgtactataggaacacgaaacagagcctacattcctcacggacatcttcaagtgccatc

SEQ ID NO: 55960 - DNA, 338 bp, Zea mays
  Clone ID: LIB3068-050-Q1-K1-B6
cccacgcgtccgcccacgcgtccgcggacgcgtgggggcgtgctgaatccttggcagacggatccgtgcgacgcggggctggatctcagtggatcgtggcagcaaggccactctgccacttacaatgccccgtcgcgcccacgcgtccgaaaaaagaaatactacaactaatactagctacagaaaaattaaaaaatcggatagcaacataatatgagggcggacactcatgagctcccaaaattcctgccagcgctcttgcgatgaccatagcttatgtatggtggcaggtaagtctaatccattggtgccagggttgacaacttcgagtctgataa

SEQ ID NO: 55961 - DNA, 238 bp, Zea mays
  Clone ID: LIB3068-050-Q1-K1-B7
ctcgtgcgatgggcgccgagaaacaacacacaatgctgactgatgaccgcaccatgccaggcaggaaatgatcgtgagcatggcggtggccggcgcgatcatcggcgcggccgtcggcgggtggaccacggaccggctcgggcggcgggcgtcgatcctggtggccgactgcctcttcttcgtgggctcagtgagaatggcgtaggccacgcgccccgcgctgctcgtggtgggccgt

SEQ ID NO: 55962 - DNA, 407 bp, Zea mays
  unsure at all n locations
  Clone ID: LIB3068-050-Q1-K1-B8
cggacgcgagggcggacgcgagggcggacgcgagggaaaaatcgccgnggaggcgaggcggcgccggcactgcccggcacggccagcggctccggcgaaggcggagctcgacacggggattccacatacgttaatcggtcccaccggatccctcgccgcctcccacgggccgggccgcgccgtggcgcgcgcgcaggccgagatgcggaagaggatggagagcgtcgacgatctgatcgaggaggcaaaactgcgcaccgtctggtgggcgctctgcatcttcgccgtctcctacttcctcacgcgtgagcacgtccccttctgtccctctctgcttccgtgcctcatttgcgaccgaattgggtgtgcggctcgtgtgggccccgagaaggaccgggccgggcata

SEQ ID NO: 55963 - DNA, 419 bp, Zea mays
  Clone ID: LIB3068-050-Q1-K1-C1
aacgaacgaacgaacaaaaagcaacagagataaagcaaaaaaaagatgacaaaaaaacaagagaggacagaaaaaaaaaaaagcgaaagaaacaaaagagaacaaagcaaaaaaaaaaaacaaacaaaaaaaaaaaaaccacaaacaaaaagggggccccctccaaagggccccagggtcaactccccggccttccaacgctaaatgactaatagggggagcccaacgctcaatcccgggcccggggttcaacaacttcgtaccgggaaaaccccgggcgtcccccaagaaaaccccgtggcacaacacccccttttcgccagcggggatacaaccaaagggccccaacccaaacgcctttccaaaaatgtgcccccccaaaagggcaaacgggaccccccctgaacgggcccataaac

SEQ ID NO: 55964 - DNA, 356 bp, Zea mays
  unsure at all n locations
  Clone ID: LIB3068-050-Q1-K1-C11
gcgcgatcgccaataatggagtttccgcaccactaccaccaccacggccatcgccgcgactactgcnaatacgaccgcataggcccgcctcccccggtctactgcggctacggccagccaccggcacccgacccgtacggcctcgcgcccgtctaccccgatccgtacggtcgacctccgccccagtccgcgtacggtggggcctgggactcctactgccacagcggccaaagctactcgcccccgccggcctactgcgcctggggctggtacggcaacgtcgtccacgtctcgcacgatgtctgctactagaggccttactactgctgctgctgctgctgtcttggtggcgccta

SEQ ID NO: 55965 - DNA, 409 bp, Zea mays
  Clone ID: LIB3068-050-Q1-K1-C12
cccacgcgtccggtcaaaatacacgaagggcaacgaggcgaggcctagtatagaggaaaacgagtgagaggggggaaatgctgcgccacgccgcccgccgtctcgtctcccgcaccgccgcggcgcccaccgcccgccgggcgctcgtcacggcagaggtgcctgcggaggccgccgaggactccacgtttgtggagacgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccac

SEQ ID NO: 55966 - DNA, 319 bp, Zea mays
  unsure at all n locations
  Clone ID: LIB3068-050-Q1-K1-C3
cttcaaccaccacaagaaggacgaggagcatcccgtcggcgagtacgggtactccgagagcgangtggtcaccgtcaccggcgagggcgagtactagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaag

SEQ ID NO: 55967 - DNA, 175 bp, Zea mays
  Clone ID: LIB3068-050-Q1-K1-C6
cacacacgtccgttcggtgacaatgcgttctgcccctggcacgagccagtggcgttaaggggagccacataaagggacagacttcacagaacccaactcaaggaaactggatcgggcctataaagccaaagatttgaacctatcaggacatcactgccgcaggaccatcccaacg

SEQ ID NO: 55968 - DNA, 116 bp, Zea mays
  Clone ID: LIB3068-050-Q1-K1-C8
atatgtttagcagcagcaggtgtattgtgcgggtatgtaatggtattgcaactatattgggtgtaaaaccataataaatgtgggcaaatatgcaaggaaaaaaggcttctacttct

SEQ ID NO: 55969 - DNA, 407 bp, Zea mays
  Clone ID: LIB3068-050-Q1-K1-D10
gagaattcttaattcatgagttgtagggagggacttatgtcaccacaaacagaaattaaaggaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgt

SEQ ID NO: 55970 - DNA, 415 bp, Zea mays
  Clone ID: LIB3068-050-Q1-K1-A11
acggcctccctctccggatcccccacctgctccgtcgccggccaacgcatcgctccccttggcagccaggatgacagaagcaccatttctgccacgtgagaggctcttcaagctgcaacatcatttccagaacatgaccaagcacacctacctgaaagggcgctacgatgtgatcacctccgttgccatccctcttgcacttgctgcctccagcatgttcatgattgggcgtggagtttacaacatgtctcatggaattgggaaaaaggagtgatctaccacgggttaactagtttttctacttggcatggaagtaccatccagactatgaagtcttctttgcttgctaaataatactgtcaaagaacaagtcgactacatttttgcatcatatttctgtttgtatttgtggata

SEQ ID NO: 55971 - DNA, 451 bp, Zea mays
  Clone ID: LIB3068-049-Q1-K1-G2
gctatactcaaacacaaagaccaacttccgagaggttgccatcaaaggtttctgggacatgtacgacccagagggctactctttgtggttctgtgactacaagtacaatgatgagaacaccgtctcctttgtgaccctgaacaaggttggtggattcctgcagcggatggacctgtgccgtaagtacgcctttgggaagatgctcgtgataggctctgagccacccttcaagctgaagggcctttggctcttccgtggccaggatgttcccaagtttgtaatggatgaggtctatgacatggagctctacgagtggaccaaggtggacatctctgatgaggcccagaaggagcgtgtcaatgcgatgattgaggaccaggagccctttgagggcgaggccttgcttgacgcgaaatgcttcaagtgagtgtgcttgcctggagacagaact

SEQ ID NO: 55972 - DNA, 462 bp, Zea mays
  Clone ID: LIB3068-049-Q1-K1-G3
cggacgcgtgggggcgtcgcgcaacaccaacgaccgcgtcggcatctactacgaccgcgccgacgtgtacgccgagtaccgggcgatgcagatcacggtgcccaccgcgctgccgcccttcttccagccgcccaacgacgccgccgtctgggcgcccttcctctccgcctacaacgtcccgctgccgccctacctcgccaccgcgctcacacaggacgagacggcggggtacctgctcgtcaccatccgcgtcgacggctggatccgctggaaggccggggccttcatcaccagccactaccacctcagggtgcgctgccccgcgctgctcaccgtcaacgacggacaaggaagctacggctccaacgccggtggagggctcggctacttcaagttccagcgcgcagcaccctgcatcgtagacgtctgagatcgatctcgatcacaaatcacatttaagag

SEQ ID NO: 55973 - DNA, 320 bp, Zea mays
  Clone ID: LIB3068-049-Q1-K1-G4
tcccggtcgacccaccgtcgaaaaaaaaaaaacacaaaacaacacaattatttgtcacaactgatacaattcacggagcgatttaaaaaatactgttaaaaactctacatgcaccactttcatgctttctacgacccctttattaccctcacctgccatcttttaacaatgcagtgactggcaaaatcctggtatcaccctatttaaacgcttctctcaacaatctcttttccacaccttacgttatcgcaactttgcccatccccatttccttaccctccaaaccctctaccttaatggccaaattacccccccctata

SEQ ID NO: 55974 - DNA, 192 bp, Zea mays
  Clone ID: LIB3068-049-Q1-K1-G5
gagatcagaccatgagttacaggacatatcgtctgatcatacgacatggacagggacagcgtatcgtacatgtggggggaatatgaactttcgatgctgggactggggccgagcactgtggatactgctgccagagacttactaaaagaacatatatatgcagctctagagagtggctatacatgcaaggaa

SEQ ID NO: 55975 - DNA, 435 bp, Zea mays
  Clone ID: LIB3068-049-Q1-K1-G6
gttcttccagggtatggggcaatttttcatataatggggactggtctgttttggttgttgctgcttatcattgttgttacagcaatggtcccacattttgtgttcaaggctttaacagaacacttaagcccaacgatattcaaatcggccgtgaaatggaaaaatttgcaaatggcaattaagtgaacccggtggaatttccaaccagaggactttcatgacaatagtagggaaactatagtatttcgttcttttcttattttcacgtctttcccccctactggtgtgaataggagctgattcatttagctgtaaggtgataggtttaatctctaatgtgcatgtatgtattcgtataaaatttacagaaaaggaaatagaagtccacgtacaagttttcatctgcttgttgcagcattattgcaggctaaattt

SEQ ID NO: 55976 - DNA, 455 bp, Zea mays
  Clone ID: LIB3068-049-Q1-K1-G7
ctcgaatcgaataaataatcatagtcagagctagcaagcaatgcaattgacatctggtatctcaattgatgacctaacagttctaatgcgctgacacctagtagtcccatctgcacatgccatcgtcttgattgtgtcgctgtcttgattgtgtcgctgcctacctatgttggcacatcattgttgtatggatatacatgtctaaaatgggccaggtttgctaggcggcccatggcctggcacagtttaacctggcttgagcatgatccggcccgttgtccactgggcccatgctagtctggcttgatcaccgtgtcgtgcatgggccttaggtgcagcacgacgggctagacccggtacagatcggttttttttccctatttttcataaaaaatatccttattatgcttgattatagaatataaaacaaaaaatatgtgtgtaaaggtggagtg

SEQ ID NO: 55977 - DNA, 323 bp, Zea mays
  Clone ID: LIB3068-049-Q1-K1-G8
ctcagcgctgtccagatagcgtcgcacccgatcgccgggccaaacgtgcagagcacgatggtgctggacttactgtctggcggcaaaagcacagcgctacccaacttcgtgcaccgtcgcagcttgaggagtttccggggatgaaaggctatcccatgcaacatcgactagttcatgtctcgagcacagagcaaagacatatgtgacgtgtctaaaacatatgtcgtactttatgtattgtaccaattaaacatttaatgaacttaattgatcaaataagttaatggtctgaatgatccttagtttgaatccatgttttgagt

SEQ ID NO: 55978 - DNA, 397 bp, Zea mays
  Clone ID: LIB3068-049-Q1-K1-G9
cccacgcgtccgcccacgcgtccgcttccgttctcaaaccaacctaggcaattcgccgcggcctgtcaccctcgcgagtcccgacctcccgcagccgccgcacagatggcacccaaggcggagaagaagccggtggccaagaagcccgcggaggaggagcccgcgacagagaaggtggagaaggctccggcggggaagaagcccaaggccgagaagcgccttccggcgggcaagtccaaggagggcggcgagggcaagaaggggaaaaagaaggcgaagaagtccgtggagacctacaagatctacatctttaaggtgctgaagcaggtgcaccccgacatcggcatctcgtccaaggccatgtccatcatgaactccttcatcaacgacatcttcg

SEQ ID NO: 55979 - DNA, 214 bp, Zea mays
  Clone ID: LIB3068-049-Q1-K1-H1
cccacgcgtccgcccacgcgtccggagattcagagttacctggtctctatgtttctctagcctaccccaacttgcttgggataaaaggctttgttgttgttgttggaatgtaagattgtttgtttttgaagccaaaaaaaaaaaaaaaaaaaaaaaaaaaaaaaaaaaaataaaaaaaaaaaaagataaactaaataaaaaacatagctaaaaa

SEQ ID NO: 55980 - DNA, 454 bp, Zea mays
  Clone ID: LIB3068-049-Q1-K1-H10
cccacgcgtccgcccacgcgtccgcccacgcgtccggatgtatgtttgctccctgcctgggatgccacacgtcgtcttcggattcgtcagctccctactggcgtcagctcccaactggcagtcctataaagtggatgatccgaatgcgccgagaatgattcttctcgttattttctacgcgaacgtcatcttgctggctgaaattaagaacgtcaggatctacatcgagacggcaactgccgtggtgatatcttacgtgtcactacttaaaatcagctggagttacatctggctcgttctcttccccattgtggcgatcggcttcatcgttgctctgtgcaaggagctcagtcacgaggacgaggccggtggatcacattcacaggagcagagcaatgaaggtgaaagtgaaagcgaagctactacgtcttcatgggaaaaagttcatgctggg

SEQ ID NO: 55981 - DNA, 426 bp, Zea mays
  Clone ID: LIB3068-049-Q1-K1-H11
cggacgcgtgggcgacgcgctccgccaggactgccaggcgggctacctcgtcctccaggtcaaggtcgacggccgcgtgcggtggaaggtcggcagctggatctccggccactaccacctcttcgtcacctgccccgcgttcctcgtcaccgccggcggcaacggcgcccccggcgcttccgggttcaggttccagaccaccacgtactgccacgtcgaggtttaattaggagcgagaggaagcagagaccatggctacctctctagctgctgctcctgccgttgcctggtgtggtaataactctctctatctctctctctctctctgtccgctgctggcgttactactgcagtagtgcagtgatgcgggatgtaaaggaggggtaaaaaaaattcctttcgttctagccaaaagcaaaactacta

SEQ ID NO: 55982 - DNA, 453 bp, Zea mays
  Clone ID: LIB3068-049-Q1-K1-H4
aattagtccccatgttcttcgaatggatctcttaattgttgagagggttgcccaaacgcgggatataaggcatacccagtaaagcttacaagtaaaccagatatggagatggcgactaaagttgctgtttccatttttatagaatttcaagattacaatggatctatgaaaagatcgtgtatttacaactacaacggaatagtatacaaagtcaacaccaatgattaaatagaatttatggctacacaaaccgttgaagatagttctagacctaagccaaaacggactggcgcaggtagtttattgaaacccttgaattcggaatatgggaaagttgctccgggttgggggactactccttttatgggggtcgcaatggctttattcgcgatattcctatctataattttagaaatttataattcttctgtttaactggacggaattttaacg

SEQ ID NO: 55983 - DNA, 429 bp, Zea mays
  Clone ID: LIB3068-049-Q1-K1-H5
aattagtccccatgttcttcgaatggatctcttaattgttgagagggttgcccaaacgcgggatataatgcatacccagtaaagcttacaagtaaaccatatatggagatggcgactaaagttgctgatcccatttttatagaatttcaagattacaatggatctatgaaaagatcgtgtatttacaactacaacggaatagtatacatagttaacaccaatgattaaattgaatttatggctacacaaaccgttgaagatagctctagacctaaaccaaaacctactggcgcaagtagtttattgaaacccttgaattccgaatatgttaaatgttgttcattttgggtgactactccttttaatggggttccaatggcttttattttcgatattcctatctataatttttaaaaattttaattcttc

SEQ ID NO: 55984 - DNA, 370 bp, Zea mays
  Clone ID: LIB3068-049-Q1-K1-H6
cccacgcgtccggtcatttatcgcgattttaaaacatctaacatactgctggatgcggagtgtaacgcaaagctctctgattttgggcttgcgaaagacggacctgtaggtgataaaactcatggttctactcaagtaatgggaacctatggatatgcagaaccaaattttgcaaggactggtcttttaccttaaagaatggtggctaccagtttcgggttggtgcttcttgagatgatgtcaggccgcaggtcgatggacaagaaccgcccgaacggggagcacaacctggtggaatgggcgcgccccctcctaggcgagaggcaacggttctacaagctaatcgacccttgcctggagggcaacttct

SEQ ID NO: 55985 - DNA, 423 bp, Zea mays
  Clone ID: LIB3068-049-Q1-K1-H7
cgtcccccccgagcctcaccaatcgccggccctccgcaggcagggaagggcggttgggcggccggccggccggagatctgattgctcttatcttctcccctcccgttcatccaatctgctgtcaccatatctgatctccctctccccctgattgcccgcggtggccattgcctcgctcgcgtctccttcgccgcgcttctaggaagattcggcggcgtgcccatttgtcggtcgtagccttaaccagttcttccccaactccgagctccttccttgcttgggagcagctgcacacacatccgcccaggatattagttagcgtggaggatggcgtccagggacttcctccgcgtcttcggcgccggtgagggggcgggcccgccgggggacgccggcgccggccagcccgacgacgacgagctc

SEQ ID NO: 55986 - DNA, 431 bp, Zea mays
  unsure at all n locations
  Clone ID: LIB3068-049-Q1-K1-H9
ggcatatcgaggaggtttttagggtggtggtggtgttgtgaggagctgctgccgctgcgctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgcggcggtcgnggggtgggacgcactagctcgccatgagc

SEQ ID NO: 55987 - DNA, 345 bp, Zea mays
  unsure at all n locations
  Clone ID: LIB3068-049-Q1-K1-G12
cccacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcaaaggtcccgcggcttcggcttcgtcaccttctacacggaggaggcgatgctgaacgccatcgagggcatgaacggcaaggagctggacggncgcaacatcaccgtcaacg

SEQ ID NO: 55988 - DNA, 95 bp, Zea mays
  Clone ID: LIB3068-049-Q1-K1-D7
cccacgcgtccgcccacgcgttcgaaataaataaaaaaaaaaaaaataaaataaatatgtaggaaaaaaataaaaaaaaataaaacttaaataat

SEQ ID NO: 55989 - DNA, 444 bp, Zea mays
  Clone ID: LIB3068-049-Q1-K1-D8
cccacgcgtccggtctaggtctagctagggtctggtctcgctgccccgccgcgcgcgcattcacaggcttctagacgttccgaggaggaggggaggtacccgccgccgcagccatggcgtcgaccaaggtccagcgtattatgacccagcccatcaacctcatcttccggttcctacagagcaaagcgcgcatccagatctggctattcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaggaacgatgtttggtgctcgcttcgattatctgtgacacaatgtactcca

SEQ ID NO: 55990 - DNA, 459 bp, Zea mays
  Clone ID: LIB3068-049-Q1-K1-E1
gaccaacttggtgccctacccgaggatccacttcatgctttcctcctatgctccagtcatctgtgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgt

SEQ ID NO: 55991 - DNA, 294 bp, Zea mays
  Clone ID: LIB3068-049-Q1-K1-E11
ggatcccggtcgcccacgcgtccgcccatcatatcttaccttatcgtatccttatttaccttcaaaacttacatggtactgtacctattagacctcttaacttacttgttatacttacactccatgataaccattgtatcattttttttttaaccaatattatatatagacttttatcataaaaatgattttaaaatctatgctcacatatatgatcactttttatacacattttttatccttttctcaatactgtatcaaacacattatatactttgtaaacatcttctattt

SEQ ID NO: 55992 - DNA, 93 bp, Zea mays
  Clone ID: LIB3068-049-Q1-K1-E4
cggacgcgtgggcggacgcttctatcaaatatttcttctatttagaaatctaaatttaatggaagggttcttaaatttaaaagtcattaatat

SEQ ID NO: 55993 - DNA, 442 bp, Zea mays
  unsure at all n locations
  Clone ID: LIB3068-049-Q1-K1-E8
gctctctctctctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgctngcagcatccattctaaggctntccaagattggctcaacaactatggcagcgagat

SEQ ID NO: 55994 - DNA, 355 bp, Zea mays
  Clone ID: LIB3068-049-Q1-K1-E9
ctcatcaccaccttgtatgcagtttccctagcaacagtgatagtcctcctcctttggtggcacaagcccgcagtcgtggggaaagccactgccgttcccggcgacgagaagccacggcgacgactgccgcctgggccatggacccttccggtcatcggcagcatccaccacgtggtgcgcggcctaggacaccgcaccatgatggagctgtcccgtcggcacggccccctcatgttcctccgccttggcgaggtcccgacgctggtggtgtccagcgccgaggcagcggagctggtgatgaagacccacgacctcggcttcttgctccggccgaccaccagcgtcaccatcgaca

SEQ ID NO: 55995 - DNA, 292 bp, Zea mays
  Clone ID: LIB3068-049-Q1-K1-F10
acccacgcgttacgcgactcattgaccatactagccaaacttccgacttgacaatgtattccgaccagatcgagccggggaggctcttccttggagccaaaatgaggggcagggccacacttcctacccactgaataagtttaataacgatcaacgtagtgggattacacttgcgccccgactctcccacttatcctacacctctgaagtcatttcacaaattcggactatactcaaactcaacagggtctactttatgtgctgattgcatcaatcccgtttccttaaatgt

SEQ ID NO: 55996 - DNA, 277 bp, Zea mays
  Clone ID: LIB3068-049-Q1-K1-F12
cccacgcgtccgtgctgacgctcgccgccgtgggcttcccgcacgacgccgcgcgcgggtcgcggacgcccaacagccccgagaggtgaaaaccccggctcccggcctggagtacgcccaaggtctggcccaacagcaacccgcggccggcaaccaagccggctggatcggttggctggacacgcttgaagccgccgaccaagtgccgcggctgggcaactgggcgcacggctttcaacgggcctggattgaccggtggatcgaactaaggccgacc

SEQ ID NO: 55997 - DNA, 463 bp, Zea mays
  unsure at all n locations
  Clone ID: LIB3068-049-Q1-K1-F2
ggaccagaaaacatgcaggcgattcaagttgaacctgtggcctcatcattgaattcatcatattggtacattctacataatggaaacactgtgttcacttgggctggaaatctgaccactgcattggaccaagagttaatggaaaggcagcttgatgttattaagccaaacacacagtctaggtcacaaaaggaagggtcagaaacggaccagttttggagtttactgggaggcaaatctgagtactcaggccaaaaaatggtgcgagaactcgaaagtgacccccatcttttctcatgcatcctgtcgaaaggcaatttgaaagtcaaagaaatacaccactttactcaagatgatctaatgacagaagatgttttcattctggactgtcacacgagcatatttgtttgggttggtcaacaggtggatgttaaaagcaagttacaagctantggatgctggg

SEQ ID NO: 55998 - DNA, 360 bp, Zea mays
  Clone ID: LIB3068-049-Q1-K1-F3
cccacgcgtccgaccacgcgtacgcccacgcgtccggccacgcgttcgcaaatccccccttggccttgcgagggggctgaggggaggtggtacgtggtagtggtagtggtagggtatacaggagtgctctgcccatggagaaggcggggcaacaacgccatgtcatcggcaggcagcaggcaagaaggcgcccgcgctggggctgcagaagcagaactcggggtcgacgtgacatcgagcgcgacgaggcttgggagcgccggcgcagggagcatgcgcagcgggggcacagcgctgctgcgcgctcgcagcgtcacggacgacgaccttgacgagcttcgaggatgcatcgaactgggc

SEQ ID NO: 55999 - DNA, 444 bp, Zea mays
  Clone ID: LIB3068-049-Q1-K1-F4
cccacgcgtccggagaccgagatctcgccgatagctagcatcatggcgtccaaggcgctcctcgtggtagcgctcctgctcgccgccaccttcctcgccgcctccgctaacgagcaagcccaggcggccaaagaggagaagaaggcggaggtccaagactggcacggcggcggcggctacccggggcacggcggcggcggcagcggaggctacccggggcacggcggcggcggcggcggcggctacccgcactgccggtggggctgctgcaaccgcgggtaccatggcggctgccggtgctgctcgcaccctgatcagataccagagcccatgtaccgtcctgagctcgtcgaggtccacaactaaatagtaatgagatgcgctgctactatatatacgggtacgtatgcccgatgggaagcagagcacacgcgtagtacgctc

SEQ ID NO: 56000 - DNA, 461 bp, Zea mays
  unsure at all n locations
  Clone ID: LIB3068-049-Q1-K1-F6
cgcatcgtcatcaatcgagcagaggggagggagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggaggtaatggagatgaacgtactgctgagatcactttaatttgccctgttgctcaatgtttctggatggagactgaatctcagctgtgctgtgattctgctatatagcttgtgccgcctgttctctattcactagtcggtgctcccgcgtaatatttctctcagactctngtgctatagtatgtgatgcatgcaaa

SEQ ID NO: 56001 - DNA, 389 bp, Zea mays
  Clone ID: LIB3068-049-Q1-K1-D5
cacgctttagccaaggtcctcatcatggtttgcgccacgctgctcgccgatgctgcctgcgcctgttcgcaggatggcgtgttgagcatcatcacccggcccatgttccatagcatgctgagccaccaccgctactgcatgtgccaaggcgccttctacacctacgacgccttcatctaggccgccagcaagttccccggcttctgcaccaccggcgacgagcaaactcgcaggcaggagctcgccgccttcttctgccagacgtcccacgaaaccaccagtggatgggcgactgcttctgatggaccctctgcctgctgatactgccggctgaaggaacataaacagacggacccaccctactatggacgacgacccatacaactaac

SEQ ID NO: 56002 - DNA, 372 bp, Zea mays
  Clone ID: LIB3068-049-Q1-K1-F7
cgcatcgtcatcaatcgagcagaggcgagggatagagatgacggagggcacggctaggggcggcgacatcctcatcgccatcatcctcccgcctctcggcgtcttcctcaagttcggctgcaaggtcgaattctggctctgcctcctgctcaccttcctcgtctatctccccgggatcatctacgccatatacgttatcaccaaggactacccagctagcgccgacataccgcgacaaggtgagagagctagccgatcacacagcgtacgtaatggagactaacgtactgctgagatcactataattagccctgtcgatcaatgctactggatggagactgaatctcagctgtgctgtgattctgctatata

SEQ ID NO: 56003 - DNA, 269 bp, Zea mays
  Clone ID: LIB3068-049-Q1-K1-G1
cccacgcgtccgcccacgcgtccgcaagcaactgcaaagcagcaagctctactcttcttctgtactgaacgtgtgactagataacaacaagcgtgaaccatggcggaccaagtacggccgcaacggctaccggaggtcccgcgccggcgaccactaccacagcggcttcaacagcaagtccggcactgatgactaccggcgtggcgaaagtggctacaacaagtcgggcggcgattaccactaccggcgcaacggcggccatgggtacc

SEQ ID NO: 56004 - DNA, 436 bp, Zea mays
  Clone ID: LIB3068-049-Q1-K1-G11
cggacgcgtgggcggacgcgtgggcggacgcgtgggcggacgcgtgggcggacgcgtgggcggacgcgtggggagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaagagccagctgccccggcggagaccgagccagctgccgtcgctgagcccgaggcggcccccgtggcggcggatgaagagacgccaaaagaggaagagac

SEQ ID NO: 56005 - DNA, 194 bp, Zea mays
  unsure at all n locations
  Clone ID: LIB3068-009-Q1-K1-F9
cgtttgcgggttgctgtatcactctgcgtctctgcaagtgctaaaccagtcactttgtggacggtggttcctgtggtctcgagggagcgtcngtagtgacatctactaccagcactggtattccgcttctgccagagaagcactgcgccttgtttgatgaagcttgtggagccatggcgggcagtaatagtcct

SEQ ID NO: 56006 - DNA, 295 bp, Zea mays
  Clone ID: LIB3068-009-Q1-K1-G10
catgaagattatccatctgttgttcgggcactttaaggatggggacctcattcaacacataggctacgacactatctctcaaccaagatatttaagataacatgcatcacacctgtcgccaatcatattgaaccacgtcgagaacaagcaaatgcactctgtcaagtactcctaccatctcatgctacagatcttcctgctatggatatacttcattaccttctgccatcaatacacaatctgctaaaagatctgcatgctctagaccctgcccacacagaggctctacaaatca

SEQ ID NO: 56007 - DNA, 441 bp, Zea mays
  unsure at all n locations
  Clone ID: LIB3068-009-Q1-K1-G11
ntcccccactcctccaaanaaaaaaaaaaattaaaaaaaaaataaaaaaaaaaaaaaaanaggtnnggttttattaaaaaataatgaagattatattaaaaattaacctantaaaatctagtctctaacccagataaccaaaaaaaaaggccccccccttttaaagaaccacaactttacttccccttccttccaanataaaaatttttttttaaggccccctaaattcaattccctccccccctttttacaccctcttaacttaaaaaacccttgctttccccaacttattccctttgaaaaaaatcccctttttcccaatttgcttaataacaaaaaaccccccaccaatcccctttcccaacattttccccccctaaatttcaaattgaaccccccctttaaccccccattaaccccggcggttttttttttttcccc

SEQ ID NO: 56008 - DNA, 116 bp, Zea mays
  Clone ID: LIB3068-009-Q1-K1-G12
cgaccccttggcccaccggtccaggaccttccaaaattggcccccaccttcttcgcggggggggacaacaataataactccaattgccgccgccccttgttggccaaaaacaaaaa

SEQ ID NO: 56009 - DNA, 286 bp, Zea mays
  unsure at all n locations
  Clone ID: LIB3068-009-Q1-K1-G3
cccacccgtncggttctttgcgaaggcaactgaatgtttccagaaagctgctgatgtggaacctgcaaatgagctgtacacgaaatcattatacttttcatcaatagcacctaaactagactctaagatcacatgcataacacttgtcaagcatgataacaaacatcctcatgctaaaatacatctcacttgtgaagaactaacaagatatgcacgctacatatcttccagctatgggtatacgtgattctcttctgccatcaatacacaatctgttgaaagatct

SEQ ID NO: 56010 - DNA, 245 bp, Zea mays
  unsure at all n locations
  Clone ID: LIB3068-009-Q1-K1-G6
gcgnaaacacctcaatgtctagcagtaccatagccctctcctccacaaccttcgggggcggggcactgaacatgccgtggtctctattccactaaacccgcctgacgatgcacatgaccgcggctaaggcaaacccagccgcgagcttcggcagaccgtgatacaggcctgaccgcgttctctacctgggccctctgtgcggcgcacccacaagctaactgactggcgagtctcccggtcgacta

SEQ ID NO: 56011 - DNA, 366 bp, Zea mays
  unsure at all n locations
  Clone ID: LIB3068-009-Q1-K1-G9
tctttgcaaatgctactaaatatttccaaaanncttctgggttcgctacctttaaatgatctgcacaccaactcattanacttntcatcaaatacacctaaactgcactcttatatccactatcaaattgcttctcaagctgcaacacaatcatcctcagcctcaaatccaactcaatcaattaacaataagaacaatgacacctacttctgttactatttttgtaaatctctaatccttttcgctttcatttctgcatttttttaattatcaaaatcaaacattccttccccacctgcaccatccacatttaaacttatctattcacaaaaattcttctcaaaatattctaacatacccccattt

SEQ ID NO: 56012 - DNA, 394 bp, Zea mays
  unsure at all n locations
  Clone ID: LIB3068-009-Q1-K1-H1
gacgggagagagagataggcgtgccttcgtcgtccgtgccggtgcgtggcgtggtgggcgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcngttggtcatgcgggtatgggtgctat

SEQ ID NO: 56013 - DNA, 312 bp, Zea mays
  Clone ID: LIB3068-009-Q1-K1-H11
gggctgcatactgaagtggtgtgaatagagatggtggcacgcagggggtggtgtctgccctgggggggggccttaacctggccgtggagatccaggccgacgccgggtacggttacggtggcgggtacaccccgacgccgacgccggtcaccccgaccccgaagcccgagaagccccccaccaaggggccgaagccggacaagctcgccaaggagcacaagccgtccaaggagcacgggcccaagccggagaagcctgccaaggagcacaagtcgacgccggccacgttcacgccgagctccaaacccacgc

SEQ ID NO: 56014 - DNA, 334 bp, Zea mays
  unsure at all n locations
  Clone ID: LIB3068-009-Q1-K1-H4
cccacgcgtccggtggaaagaagaggaagcgaacgagaggcaacggtggccgggggcgtgacgggtggggccacgcctggcctgacncgggaagccggccggaaccatccaactccgccgcgtcgtcgtcgccttcgtctcgcgtgctcaccaagagaacaaaacgcgagcagccaagaattcaacgtccacggtccgcccaccctccgtttccgcttcctccctccacgtcgtctcggtcttcctctcctgtaatcccgtgacacgggtggctgcgacggcgaatcagatccctacccgtggcgttggtcgtgaattggcgccgtcttcccct

SEQ ID NO: 56015 - DNA, 346 bp, Zea mays
  unsure at all n locations
  Clone ID: LIB3068-009-Q1-K1-H5
cccacgcgtccgcccacacattacactactcgtacgcggacacattnttcgaggcatgctttctatcaaaaacagaacacataataaaaaaaaaaaaaaaaaaaaaaaaaaaaaaataaacataaaaaaaataaatattttttattctttttaaaaaaataaaattataatttcatcttaaaaaaaattttatattttttttataatataaaatatattttaattttttttcctaaaattttaaattttttttattttcaaaaaaattcaattaaccaactttatttttttaaaaataataatctctaaaaaccatgttgtaaacaaaataaaaaattttttaaaa

SEQ ID NO: 56016 - DNA, 369 bp, Zea mays
  Clone ID: LIB3068-010-Q1-K1-A1
tttggtttttttttttaatcgtaactggcgtcttaattaactttgtgcagtggtaacaaggagcaaacgcagtgcagcgtggtaaacaagtgcagtggtaacaaacacaaacgcgccatactctacttgcgttttggacaccgtaggggtagggctacattatttccaagagatcgatcatagacagagcacgacatgttggggcggcggccgacagtccggcactaaggacgacgacatcgacgacgacggaagccttgggcatgttcatgtccagcatgatgcagcatgccccagattcagaagaaggggttgatcagatgttgaccttggcgacttccgggagatgcaccgggtagcggtcgatgc

SEQ ID NO: 56017 - DNA, 456 bp, Zea mays
  Clone ID: LIB3068-010-Q1-K1-A11
ccctgactcgcctcgtcctccagatatcggccgccaccttcacctccaccgccccggcgcgcctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcgttgtagaagaagacactgaggatctggctttctggaatcacatttcttgagaactatctgttggagaactaaactaggctcttggtcatattatggatcagcaagctaagattgatgctgattttcttggaccaact

SEQ ID NO: 56018 - DNA, 429 bp, Zea mays
  unsure at all n locations
  Clone ID: LIB3068-010-Q1-K1-A6
cccacgcgtccgcccacgcgtccgctttccggttcgttcccctacgcccgttggtctctggtcgcgcaacatcagagcacaagcgaggaacccagtccagtcccgggaatggagtgcgtattgggcgtggttggccgcgacttcgcgctggtggcggccgacacttccgccgtgcagagtattctcgtccacaagaccgacgaggacaaggtgatggtgctcgactcgcaaaagctgatgggcgcttcaggggagcctggtgatcgggtgcaatttacggagtttatacagaagaacctccacctgtaccagttccggaacaccatcccgctctcaaccgccgccgncgccaacttcacacgcggcgaactcgccacagcccttcgcaagaatccatatatggtcaatattattctgggtggctatgat

SEQ ID NO: 56019 - DNA, 262 bp, Zea mays
  Clone ID: LIB3068-010-Q1-K1-A7
cggacgcgtgggaaaaaaaataaaaaaaaataaaaaaaaaaaaaaaaaaaaggaaaatatgaaaaaattaaaaaaagaggagaggctttttaacctaattctattttaaatactcgaatttgatattaatatattttttatatagacttctctattttaattactgtccctttttttttacaatgttttctcttacaaaattttggttatcccaatttaattcttcttgaaacatatccctttttaaacatttaatattata

SEQ ID NO: 56020 - DNA, 331 bp, Zea mays
  unsure at all n locations
  Clone ID: LIB3068-009-Q1-K1-F4
cggacacctggccggacacgtgggccttgctagctgaggacggtacancngcgcagagttgcgacgtacgacgacgacgacncangcgccacacatggcatcccagctctccgccgccgtgccccggttccacggcctccggggctacgccgcgcccaggtccgcggtggcggcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcg

SEQ ID NO: 56021 - DNA, 260 bp, Zea mays
  Clone ID: LIB3068-010-Q1-K1-B1
cggacgcgtgggcgcgacggtttctctccatctctccgtgtgtgacagtgtgtgtgtcggagctataggagtgcccggtgcggactgcgagtgacatgggctaaataaagtgtgcgtcgtctggtctggtggtggtagtggggcgcggtgccccatgtgtgccgctgcagcttgtgtctctgtgttgcttcatgttctctgtctatctactctcatgtatggcagtttgggtacgggtatatcaagcatgttcagtcttc

SEQ ID NO: 56022 - DNA, 420 bp, Zea mays
  unsure at all n locations
  Clone ID: LIB3068-010-Q1-K1-B10
cccacgcgtacgctcgtagtaggcaaagttgctaattgaacatgcctttcgaacacatctgctcctcgacgggcgatgcgatagccgaattctgcgacgtccacaccgccgacagccgcaagaccctcgaggctcacctcatcggcaaaacctatgtgtctggtgactccattactaatgatgacattaatgtcttcgccgtggagccgtcgaagcctgacgctgagtttcctaatgccgcccgctggtacgagaccgactctgcggctgcagcctcaagagtccctggtaaggctgntggtgtaaatctgcctgctggatcagctcctgcggcatctgctcctgcggatgaggctgacgatgatgatgaccatgatctttttggtgacgaaactgatgaggacacgaaggcatctgatg

SEQ ID NO: 56023 - DNA, 358 bp, Zea mays
  unsure at all n locations
  Clone ID: LIB3068-009-Q1-K1-C4
ggagccacgcgtccgcccacgcctncgctcaaatagacatgtaatgatctcctcaccatnnaaccctggtcagcatattcaatctgcttctgctttaacaaaagatctctctcccctaaaatgaaatatctgatttctatcacatagcttcagaattataccgcgaatgtggaacgccacaacctgcatctgatgctctagcaaagggtgccaatgcattggaggagaaatctccagaagaagctatcaaaatgtatgatgaggcttgttcacttctataagaagataggaaggaacacatggcttttgacttgtaccgtgccgcagcagctttttatatcaagatggagaaatattc

SEQ ID NO: 56024 - DNA, 284 bp, Zea mays
  unsure at all n locations
  Clone ID: LIB3068-009-Q1-K1-C5
cccacacctcctaaaaaaaaaaaaaaaaaaaaaaaaaaaaaaaaaaaaaaaaagaaagacaaataatatatatgatacaaataaaaccacntgcccgccccttctaaagtatccaatattaccaccccattcttcccacaatatcacttttttatacgctcacttaatttcaataccctggccttacctttataaatactcttttaaaaaaaccctcttttaccccatcttaatatacttaaaagacatcctcttttcgccatttccaataatttcaaaaactt

SEQ ID NO: 56025 - DNA, 257 bp, Zea mays
  Clone ID: LIB3068-009-Q1-K1-C6
caattttatttaataaaaataacctttttcattttaaacaccaccaccatggcccgccctactattactaaggcccaatgccttcttcttggcctttcccttgttcacccctacttctactatatccattttctttcataaataaaaaccgctttttaccttcaaaaaaaaaaaaaaaataaccaaaataacaaaaaaccttaattttaaacacatccatttacaatacatatttattactcaaataaatattatcc

SEQ ID NO: 56026 - DNA, 334 bp, Zea mays
  Clone ID: LIB3068-009-Q1-K1-C7
cggacgcgtggggaaagggcatctgggcggccaaggccagtggggcgatgggaagtgtgggagtgggagcaggagcagcggcagctgagcctactagcaccgtggcacgggagttttggtgtatgtggtgagcaggaatggtgatcccttgttttgggggatgttgctgtgcaggtgtaattatcgttaactcagttgtctatctataggcccagttcagcttgagttttatggttaactcggcgatctatataggctcagctcacctgcaacgcacttcagttcagaaactcggatggtagcagatgtttgtctgttggaagttgtttgtatc

SEQ ID NO: 56027 - DNA, 287 bp, Zea mays
  Clone ID: LIB3068-009-Q1-K1-C9
cggattcccggcccaatccgcgctctcttttccgtcgtttaagtcatggcaggaatggcacctgagggttctcagttcgatgctaagccctatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaagggtcttgatgt

SEQ ID NO: 56028 - DNA, 350 bp, Zea mays
  unsure at all n locations
  Clone ID: LIB3068-009-Q1-K1-D1
tccctcccttcccttctaatccaactccgatctnanttcaccgcacggacatagcagccccggctcccggcccaatccgcgctctcctctccgtcgcttcagtcatggcatgaatggcacctgacggttctcagttcgatgctaagcactatgattctaagatgcaagagctgctgagcaccggtgagactgaagagttcttcacttcatatgatgaagtttttgagagttttgatgatatgggcctccaagagaatcttctgagacgcatttatgcttatggttttgagaagccatctgcaattcagcagagaggaattgttcccttctgcaagggtcttgatgtcatt

SEQ ID NO: 56029 - DNA, 261 bp, Zea mays
  Clone ID: LIB3068-009-Q1-K1-D2
cggacgcctgggcggacgcgtgggcggacgcgtgggcgacgagggtgacgagtgctggagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgttgcttc

SEQ ID NO: 56030 - DNA, 90 bp, Zea mays
  Clone ID: LIB3068-009-Q1-K1-D5
cacacccctgcactgaccctttctccctcacttgcaaaaagctctttactgagcgtagttcgctgattcattaaactgctctctcagaag

SEQ ID NO: 56031 - DNA, 362 bp, Zea mays
  Clone ID: LIB3068-009-Q1-K1-D7
gggccaacccatccttccccctcgccctctggtctgagcggtctacctcgtccgctggttggtgccatagctggcccgactctcctgccgatgctctctctccctttccgggtttcccccgtggcccgagcgcaaattaccgggcctcagcccacagcaccggatgcttatgatgaaagacgggaggcggttgtcacccgagataatcgactcctactgactcgactggaagaagcatacggaagtggcgatcgaccattccgccgaggacaccgtgtgcacacgagtgcaggctcatgctcgaggcgcactcctgtgactagacctacgagtggcgtgccttcttcaacgagggcaacgac

SEQ ID NO: 56032 - DNA, 263 bp, Zea mays
  unsure at all n locations
  Clone ID: LIB3068-009-Q1-K1-D8
ccccttcgccttctaatccgagactcctatctcnnnctcacgtctgggcacataacaaccccgactcccctcccnatcctctctctccttttcctcgtttcactcatcccacaaatcccacctacacggttctcacttcaaagctcagcactattattataaaatacaggagctgcttatcacccgagatactcaacacctactcacttcatatcatgaaacatacgaaagttttgatcatacattcctccaagacaatcttc

SEQ ID NO: 56033 - DNA, 187 bp, Zea mays
  unsure at all n locations
  Clone ID: LIB3068-009-Q1-K1-D9
aaaaaaacacccccctcctaataaattcatttttaatataaaaaaaccaccnggccccccccctttaaaaaaaccaacttttcttccccttccttcccccataatatcctttttttatggcccccaaaatccaattccccccccccctttttacacccccggaccttgaaaaaccccccctttcccc

SEQ ID NO: 56034 - DNA, 295 bp, Zea mays
  unsure at all n locations
  Clone ID: LIB3068-009-Q1-K1-E10
taccgttccaatacttgttggaccaatctcntacctggggcggtcaaaacctaccaagggtgtggaaaaagcattccctcttctttcccttcttagcagcatcctcccagtctacaaggaggtcattgctgagttgaaggcaccttgtgcttcatggattcagtttgatgagcccactcttgtcctcgaccttgattcttacaaattggctgcattctctgctgcatatgcacaacttgaatctgtactttctggattgaatgtgcttgttgagacttactttgctgatgttcct

SEQ ID NO: 56035 - DNA, 377 bp, Zea mays
  Clone ID: LIB3068-009-Q1-K1-E2
ggaggagagccacctcatgggcctgaggaagcggctgtccagcttctccggggggaggcagcccatctccgccgcgtcggccgccgagtgggcgttccgccgctccaagtcggcgccctccctcggcgccgccttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcacctgggcccacatcctgttcaagatgcggtccggcgtccgccgcctcgtcgcgtccgcgcactcgctccccaccacgcacaagcagcagtccctgccgtcgtcgt

SEQ ID NO: 56036 - DNA, 380 bp, Zea mays
  Clone ID: LIB3068-009-Q1-K1-E3
cggcggccattggtagatctccgcgttgtgtaacacgttatcagcatctgttacttaggctaagcgctacattattctgacaaattcagaaatgtagttctgtacagatccgtattctttccccggattcctaagtactgtagaacggtgctcgaaatcgctgggtttccacctcctgtcgctattcattcactgaaagatctgctggctggtggagatttgtcagactgaagtatactggaagctcactggcaacagcgggaactcaagcaagcagagttcttgacggacgttgtcatttgttcttcagcctggtaagtctaacgagctgaatactggtagttcccgtgaatcatctacacgtcaggtgcagaattctg

SEQ ID NO: 56037 - DNA, 340 bp, Zea mays
  unsure at all n locations
  Clone ID: LIB3068-009-Q1-K1-E5
ggcgctcggtgttgataccgtgccagtacttgttggaccagtctcgtacctgttgctgtcaaagcctgccaagggtgtggagaanggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatatgcagaacttgaatctgtactttctggattgaatgtgcttgttgagacttactttgctgatgttcctgctgagtcctacaagaccctaacatccctg

SEQ ID NO: 56038 - DNA, 314 bp, Zea mays
  Clone ID: LIB3068-009-Q1-K1-C12
ccacgccttccgtttaggttccggtttggccgccacgccaaagcttcttcaaaaaagggtggggaaaccttaaacttctcttaaccgcccctttgggttccccgcccccgtgccccccactacctggaccgctcgctggtcggcgactaccagttcgacccgttcggtctcgggaagcccgtggagtacctgcagttccagttggactcgcttgaccaaaacctgtccaataatgaggccggcggcatcatcggcacccggttcgagtcctcctaagtcaactccaccccgttgcagccctacagcgaagtgtt

SEQ ID NO: 56039 - DNA, 215 bp, Zea mays
  unsure at all n locations
  Clone ID: LIB3068-009-Q1-K1-E8
ataacacgttatcaacatctnntgcttggcctaatcacaacattattctgacaaactcanaaatttaattctctacaaatccttattctttccccctattcctaattactatagaaccttctcaaaatctctttatttacacctactgtctctattccttcactataatatatcctgacacgcacacattccccagattaaactttactaccttc

SEQ ID NO: 56040 - DNA, 249 bp, Zea mays
  unsure at all n locations
  Clone ID: LIB3068-009-Q1-K1-E9
ctcctcgttgtgtaacacgttatcancatctcttagttatgctaatctctacattaggctgacaaattcanaaatgtaattctgtacagatccgtattctttccccggattcctaagtactgtagaacggtgctcgaaatctctgtgtttccacctcctgtcgctattcattcactgaaaaatctgctggctcgtggagatttgtcagactgaagtatactggaaactcactggcaacaacgggaactc

SEQ ID NO: 56041 - DNA, 347 bp, Zea mays
  unsure at all n locations
  Clone ID: LIB3068-009-Q1-K1-F10
ggaaacgcggcgcgagccacgcgtccgcggacccctggncggacgcgtgggcctcgctagctgaggacggtacancngcgcantggttgcgacgtacgacgacgacgacncangcgccacacatggcatcccagctctccgccgccgtgccccggttccacggcctccggggctacgccgcgcccaggtccgcggtggcggcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtctgcg

SEQ ID NO: 56042 - DNA, 344 bp, Zea mays
  Clone ID: LIB3068-009-Q1-K1-F2
cccacgcgtacgcccacgcgtccgcactacgcccctttcctgctgaacctccacgactgcaagttcgtgcgggccagcttcagcgccatcgcctcgcggtactgccctcctctggggcacgacctcgtgctggtctccgcgggtctggcgctcattgcctcggcctttgttctctgcctcgtctggatgctcttcgcggaccgcccccgaagggaggaggtgtccgatctggcgtcggggtcgaggatcgcgccggtagacagctctccgtcgtagaagcaagcaagcaagcaagcggcgcaacgggatgtctatgactatgagtgaggctgcttggtcgcatg

SEQ ID NO: 56043 - DNA, 426 bp, Zea mays
  Clone ID: LIB3068-008-Q1-K1-H4
gcaagtctcgctacgtagcagtgcaataaaaaaaagcagccgcaatggcgagcagcaccggggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaagtgatccactcccgctgggccatgctgggcgcgctcggctgcgtcttcccggagcttctcggccgcaacggcgtcaagttcggcg

SEQ ID NO: 56044 - DNA, 397 bp, Zea mays
  Clone ID: LIB3068-008-Q1-K1-H5
cccacgcgtccgcggacgcgtgggcggactcgtgggaaaaaaaaaaaaaaaaagaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaataaaaaaaataattaaacataatattaaaaaaaatataaaatattaaaaaaaaaatacaaaaaataacatatcaaaacataaacatattattaaaaaaaaaaaatcaatatacaaaaaaaaaaaataaaatataaaaaaatatattaaaataaaataaaaaatttataaaaaataaataatataaacaatttatt

SEQ ID NO: 56045 - DNA, 447 bp, Zea mays
  unsure at all n locations
  Clone ID: LIB3068-008-Q1-K1-H7
cggacgcgtgggcggacgcgtgggtgagaatgtcactgtaacaccccaccttggagctaggactgtcgaggctcaggaaggcgtcgctatcgagattgcggaagccgtggttggtgcgctgagaggggagctcgcagcaaccgctgtgaatgcgcccatggtcccagctgagatcctgtcagagctggctccatatgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggtcaagcagcgcggccttcgnctcacggaggagcgcgtggcgcacgacag

SEQ ID NO: 56046 - DNA, 426 bp, Zea mays
  Clone ID: LIB3068-008-Q1-K1-H8
cccacgcgtccgcccacgcgtccgcccacgcgtccgcccacgcgtccgcttcttcggcggggacgccgtcgggctcgtggacatcgcgctcgggagcttcgtggtgtggatcagggtggtggacgaggcggccggcgtaaagcttctggacgaggccaagttcccggccttgacggcgtgggcggagcgcttcttggcggtggacgccgtgaaggaggtgatgccggacgccggaaggctgttggagcactacaaggggtttctggctaaacggtctccacctgctggttactgaacgctgtaactgtaagcctgtaacagcaagctcagtgttcgtgtacttttccgtgcgttaacgtgtactagagttcaggaaaggctttgattctgtccagagtccagacgaataaacgaatggtttttatt

SEQ ID NO: 56047 - DNA, 241 bp, Zea mays
  Clone ID: LIB3068-009-Q1-K1-A10
tactgaattccttcctccggattttcaatggccacctggggcgcaccagacacctctcgatttacggtgctcttcctgccgcttgaccctacctccagctgaaccaattccagggttggcgggcctttaaccataaaagataactcttcccgaagccccctccggcgtctccggacttcctaacatctccgtctgccgtcacgtcccatctctggaaatcttaaccccattcccttttctt

SEQ ID NO: 56048 - DNA, 315 bp, Zea mays
  Clone ID: LIB3068-009-Q1-K1-A11
cccacgcgtccggaacatactgaggccacagggaagggaacttgatctgctgatcgtgatactgcctgacaacaatggttctctttatggggatctcaaaaggatctgtgagactgaactcggattggtctcccagtgttgtctgactaaacatgtttttaagatgagcaagcagtaccttgcaaatgttgcactcaaaataaatgttaaagttgggggaaggaatactgtacttttagatgctttgtcaaagagaatcccccttgtcagtgacagaccgaccataatatttggtgctgatgttacccatccaca

SEQ ID NO: 56049 - DNA, 346 bp, Zea mays
  unsure at all n locations
  Clone ID: LIB3068-009-Q1-K1-A2
cccactctttctaaaaaaaaatttaatataaaaaaaaaaaaaaaaaaaaaaaggganagggtttaaataaaaaaaaagttttaaaaaaaacaaatataatattttaatttatttataaaattaaataaaataaaatatatttttaatattttataatttctttttttttaaaaaaatctatatatttttattttgactgcttcttatatttaatcactttttttaatttcactttatttaaatattttttctctttttaaacaattctaaaaataaaaattttctattttttttttaaattttttacttttataaaattatttattttatatcttttttttttttt

SEQ ID NO: 56050 - DNA, 387 bp, Zea mays
  Clone ID: LIB3068-009-Q1-K1-A3
gccgcgcccagcctcggcgtcatcttttccttctcgctgctcctcaacagcggacgggcggtactgtcgggcgtggccgccagggccagctggcactggctggtggcgtacatcaacctcggctgctactacctcgttggcatccccgtcgggtacatcatcgacttcccgctgcgcggcggggtgcaggggatgtggggcggcatgctcacgggcgtcggcctgcagaccctcatcctggtcgccatcacgctgcgcaccaactgggacaaggaggccagcgaggcccattccaggatacagaaatggggtggatcggcggcggacaaaagttcacatgcatgactagtctgaatgacgcgcgccaccatgagaatacaatacaac

SEQ ID NO: 56051 - DNA, 404 bp, Zea mays
  unsure at all n locations
  Clone ID: LIB3068-009-Q1-K1-A8
ggaagttgctgcacttaaccgctactttggcggcctgaaatctggtggtaatgcttgtgtggttggagatccagcaagacctggacagaantggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatg

SEQ ID NO: 56052 - DNA, 304 bp, Zea mays
  unsure at all n locations
  Clone ID: LIB3068-009-Q1-K1-A9
taaagagcgggtgcttgtggatgagtttgaagaaaagaagtcnaaggaaatgttagaactttgcaccaggggtatatgcctcaaagttaggtctccggaccaagagaacagtaatctcgcccaacaagacaacgtggcaccggatgcagtgtctggcgatcaatgattatttcaggttgtgcctcctgatttagggtggggtgacagctgccatgacaactaattatgatgttatacacagaagggcaggtggacctgtaactagtccacatgaaccacatctaacatgttaagctgactttca

SEQ ID NO: 56053 - DNA, 384 bp, Zea mays
  unsure at all n locations
  Clone ID: LIB3068-009-Q1-K1-B1
acgcgtcncctcaatcaaatcgagcgcgcgccaatcaagtcttccagcctnccccnaatggcgcgatcaaacaagacaggagggtgaaactcgccttctgaagcgtctgcgactccttcagcgccacctccatcaaggcctacgtggccgagttcatcgccaccctcctcttcatcttcgccggcgtcggttccgccatcgcctacaggcaactgacgaatggcggcgcgctggacccggcgggcctggtggcgatcgcgatcacccacgcgctggcgctgttcgtgggcgtgtccatcgcggcgaacatctcgggcggacacctgaacccggccgtgaccttcgggctggccgtgggcgggcacatcaccatcctgaccggcg

SEQ ID NO: 56054 - DNA, 344 bp, Zea mays
  Clone ID: LIB3068-009-Q1-K1-B11
gctggatagactaatgtcagatgctgtttggtataaaaaggtaaccatctgaatgaggatatggcgcgaactatttgttcagcacgtacctactatatgacaagtcacaaggtattattaaaataccccaactaaaaactcaaaatcaaaagaaaaaagagaaactggtaaaactacatttgtgaagaggcatctcactggagagtttgagaagaaatatgaaccaaccattggtgtggaaattcatccgttggatttcaccactaactgaggtaagatcaagttctactgctgggataccgcatggcaagagaagtttggtggcctcaaggatggatactata

SEQ ID NO: 56055 - DNA, 392 bp, Zea mays
  Clone ID: LIB3068-009-Q1-K1-B2
agaaaaaagaagcggagaaaacaattgttggtgaatttagtagtgtcaagcgtgtcgggggaatcctctccatgggaaggcactctgatccagacagtgctggctcttccttttctattcttctgggcaattcaccgcatcttgatggccagtatgctgtatttgggagggtcactaaaggtgacgatacattgagtaagctagagaggcttccaacccggagagaaggcatttttgtaatgccgatcgagcgtatcaacatcctatcaacttactattatgatattgatctagagagctgtgaagcagaaaaatctattctccggaggagactttctgaatcagcatcagaagttgagcgatggagaagaaaatgctttgcttaatggtgg

SEQ ID NO: 56056 - DNA, 220 bp, Zea mays
  unsure at all n locations
  Clone ID: LIB3068-009-Q1-K1-B4
cggacgcgtgggctaacaatcccacttccgatcagcagctgatcnctcactggtgcaggtcgatcattctttagctgcgctaactctagcctctagccctagctagtagctagccactcggtcgtgtagtcatcagccttctgatcgtcacccatggccactgccgaggtccagaccccgaccgtcttggcgaccgaggaagcgccggtggtggagaccc

SEQ ID NO: 56057 - DNA, 395 bp, Zea mays
  unsure at all n locations
  Clone ID: LIB3068-008-Q1-K1-H3
cgctggcacgccctactcactcgcgtctctcgagctccaggagagggacatcacgacgaggccngagtgggagcggctctaccagtacgagattccagtgttggccaaggtgctccccgacgggaccgaggaagtacttcccagattatcgccacgtctaagtgttgagctcgtacaaaagaaaatttattttgcgtttgatcagtagggagaccgttctgggggaaacggtaattttattttattaattaatagctccagctgtaagattgccagttgttatattttcatgattttgacacatgaatttcaatttgcttgacttatgtttgcaaggaattactttaggtttgttcattgctctgatgaaatataaattatatggagtgacatcc

SEQ ID NO: 56058 - DNA, 164 bp, Zea mays
  Clone ID: LIB3068-009-Q1-K1-B5
aaaaaaaaaaaaaacaaaaaaaaattataaaaaaacagcaatcgattttccggtttccgacatacaatcttgcttgtgcgtccatgcaatttatatatagtcctaaaatgatttcaaaaccaaactatctaaactcctctttacagactgagaaactgctaaaa

SEQ ID NO: 56059 - DNA, 371 bp, Zea mays
  Clone ID: LIB3068-009-Q1-K1-B6
cggacgcctgggtagggttttgctgctctccgaccccgagctccgaaagccgcagcggaggcgcggcccccctcgcgtgtgaccgaaatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgt

SEQ ID NO: 56060 - DNA, 191 bp, Zea mays
  Clone ID: LIB3068-009-Q1-K1-B8
cccacgcgtccggattgatctgttggagttggaggtgttggtggaatgggaggcagggctggtccgcaagattatgattcaagtgcagactaagtagcagcaccgatgtttcctttttgtttctttcgtttttggtaaagttgtagtgtttgttgaagaaaaggattgcaataaaattagtgtttatacac

SEQ ID NO: 56061 - DNA, 244 bp, Zea mays
  unsure at all n locations
  Clone ID: LIB3068-009-Q1-K1-C10
ttgctgggggtagtacagattaccctgaagtgagcgcggaaaacactgatcacatcatatcaagttattgctgaaatgaaacctatttaaaaactgatggtgaaggttctgacaaattcttagcaactgacagtgctctttcttgtgaagatgatgcaacttgcatggatcgtgtgaatgtgattgtatcactggatgtaccccgtagcactaagaatgatacattntccaagaacacatcttc

SEQ ID NO: 56062 - DNA, 450 bp, Zea mays
  Clone ID: LIB3068-046-Q1-K1-A8
cccaagccgaccccaccgacgtacactcccacaccgaagccgccggccaccaagccgcccacctacactccgacgccgccggtgtctcacacccccagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactata

SEQ ID NO: 56063 - DNA, 60 bp, Zea mays
  Clone ID: LIB3068-046-Q1-K1-B1
aaaaaaaaaaaaaaaaaaaaaaaaaaaaaataaaaaaaaaaaaaaaaaaaaaaaaaaaaa

SEQ ID NO: 56064 - DNA, 78 bp, Zea mays
  Clone ID: LIB3068-046-Q1-K1-B10
tcggattccatgctttggcggtgaacatgaatgtgttctactccacacgagacgcacatgcgtgggagatcgttcacg

SEQ ID NO: 56065 - DNA, 394 bp, Zea mays
  Clone ID: LIB3068-046-Q1-K1-B12
cgatctgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggcttgtcggcggacccggagacgttcgccaagaaccgggagctggaagtgatccactcccgctgggccatgcttggcgcgctcggctgcgtct

SEQ ID NO: 56066 - DNA, 121 bp, Zea mays
  Clone ID: LIB3068-046-Q1-K1-B3
cccacgcgtccgcccacgcgttcgaaaaaaaaaaaaataaaaaaaaaaaaaaaaataagtgcataggaaaaaaaataaaatattaaaaaaataaaaaaaaaaaaacaaagacaatctatat

SEQ ID NO: 56067 - DNA, 376 bp, Zea mays
  Clone ID: LIB3068-046-Q1-K1-B5
gccaaccagaagagcttgcagttactgagagtgtgtgtgagagagaggatgggtggcagcggcaaggcttcttttgttgttggccttggtggtggtggccttaagcttggccgtggaaatccaggccgacgccgggtacggttacggcggcgggtacaccccgacgccgacgccggccaccccgaccccgaagcccgagaaagcccccaccaaggggccgaagccggacaagccgcccaaggagcacaagccgcccaagagcacgggcccaagccgaaaagccgcccaagagcacaagccgacgccgtccacgtacaccccgagccctaaactcacgccggcgacgtacactcccaacccgaggccccccaagccg

SEQ ID NO: 56068 - DNA, 239 bp, Zea mays
  Clone ID: LIB3068-046-Q1-K1-B8
ctttaaatgagctcttggaatctgatgacaagtttgggttcattgttatggatggtaatggtactctttttggcacactaagtggcaatacccgtgaagtgcttcacaaattcactgttgacctcccaaagaagcatggtagaagaaggcagtctgctctgcgttttgctcggcttcggatggagaaacgccataactatgtccgcaaaacagctgaacttgctacccagtttttcatc

SEQ ID NO: 56069 - DNA, 441 bp, Zea mays
  Clone ID: LIB3068-046-Q1-K1-B9
ccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattcttaggtctgatcaagtcggaggattcggcagggcgcagccatgaacgagaaggcgtccgtctccaaggagctcaacgccaagcacaagaagatattggaaggtcttctacggcatcctgagaatagagaatgcgcagactgcaagtcaaagggtcctcgatgggcaagtgtgaatctagggatctttatatgcatgacatgttctggcattcatagaagcctgggggtgcccatatctaaagtaagatcttgccacctggatacatggctgccagagcaagttgcatttattcaatccat

SEQ ID NO: 56070 - DNA, 170 bp, Zea mays
  Clone ID: LIB3068-046-Q1-K1-C11
cttaaaggaggggattaatgatggtcaacgcaaaatatctggcaatggcttaaaaaaggtttccaaatctttggtgggcgattaccccattgtttcgattgaagatccttttgaccaggatgactgggttcactatgctacgatgactgaagatattggagagcaagtgc

SEQ ID NO: 56071 - DNA, 449 bp, Zea mays
  Clone ID: LIB3068-046-Q1-K1-C12
cccacgcgtccggtacttgatgctttccttgcgccaggatcagagttgtggatgtttaatgacgtccctgaggttgacagagaaagaaagctaattgatggaggtttggacttcagtcgcctcgataatattactttggtgcatcgtgagggaaatgctgttattcgccgtcacttggagagccttcctttagaatcattcgattctatcctgattttggcagatgaatctgtagaagattcagcaatccaagctgactcaaggtcacttgcaactttgctgctgataagagatattcaggcaaaacgtcttccatgcaaggaatcattgatttcacatgttccccgagggaccttttctgaaagttcttggataggggagatgcaacaagcatctgataaatctgtcataatcagggaaattttggaccccaggacaaaaaatttggt

SEQ ID NO: 56072 - DNA, 453 bp, Zea mays
  unsure at all n locations
  Clone ID: LIB3068-046-Q1-K1-C2
gagcataccagagctctcaaggaaattcttcagagaattatcccaacaatacaacagtctttgtaggtgggttagattccaatgtaaatgaggagtatctaaggcaaatttttactctgtatggagaaatttcttatgtgaagattcctgtaggcaagcattgtggatttgttcaatttaccagcaggtcatgtgctgaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttncagtgcacaagacccaagcatacaaaactactacggatactctggttgtggtaactatgaacagcagcagccaacac

SEQ ID NO: 56073 - DNA, 287 bp, Zea mays
  Clone ID: LIB3068-046-Q1-K1-C5
actttgtgaaatgacttgagaggtgtaagataagcggagcctccgggcgcaagggaagaccactactttaacgttattttacttattccgtgggacggaagctgggcaccgcccttccttttggctccaaggcccgacctattcttgccaattctggcctatgacattgtcatgttaagagttcggcttgtgcctcacatgtcttaactgataacatatgagtcctattatgagctgagctcgttcagaaatcattcgtgttacataacattataagctcgcgcgac

SEQ ID NO: 56074 - DNA, 409 bp, Zea mays
  unsure at all n locations
  Clone ID: LIB3068-046-Q1-K1-D11
cccaggcttccggaacaatcgacggccagggagccctggtgtggaccaggaaccagtgccagggttcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctacatcggccccgggagcaagatgatccgcattcatggcgtcaagtgcggcccangccacggcatcagcgtcggcagcctggggcgctacaagga

SEQ ID NO: 56075 - DNA, 331 bp, Zea mays
  Clone ID: LIB3068-046-Q1-K1-D12
cccacgcgtccggtgctgctcctgctcggcatcggctgctctgctgccgtggcccgtgcgtgggatttagctcaggaacccacgcctgacatcccctcttcctccccggccggcgatgtcgtcttcgtcttccgcgctggccaaaggcaagtcggcaatcggatccgcagccggatctgccaaattcgaggccaaggggaaattctcctactcctactccccagctgcggcagctaccaagcgtggaaccaccaccaccagcagcagaggtagaggtagagggaaagccgacaagaaagtctacttctttgccgggccagaaagttcgatc

SEQ ID NO: 56076 - DNA, 429 bp, Zea mays
  Clone ID: LIB3068-046-Q1-K1-A6
aactccacgtcacacacctcacagagctgcaacagcatcagctgccacctccttgcttcgttcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacatggagattgaggacaagaagacagagctggagcccaaggtcgtggaggcctacgaagcatctcctcctgaggtcaaggctctgatcaaggataagaagccagtcaaggtcagcaagaagaactcggctgcagtcaccaagttcctcgatgagctggctaagattgactttcctggagccaaggtggtgagcgaggccgtggcca

SEQ ID NO: 56077 - DNA, 369 bp, Zea mays
  unsure at all n locations
  Clone ID: LIB3068-046-Q1-K1-D3
cccacgcgtccgcttgtttttgttttattttcttggtaggggggagtcgtcttctccatgtctccttagcctaggagaacgagagatccagaggcaaaagcttcagggtttgtacaaattctagatctaaccggactaaccagaaaacaaaacaaaaaaagacgaaagcatgagccacttcgccgccgccatgaagagcccccttgcggtcgccgtcgccgcgcccgccggcgccgccgacgctaagagcccgctcttctgccccaagccgcggcgccccgcggcgccgctgcggtgccaccagagcggcggcttctccgacgccggcacggatctgctcgacctnctcctctcgaaaggcgacgagag

SEQ ID NO: 56078 - DNA, 454 bp, Zea mays
  Clone ID: LIB3068-046-Q1-K1-D4
cggacgcgtgggaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgccgcgcccagcttggcaagcctaagcgcgaacagcttttgcgcaaggtgttgggggagggcacctaacgacttggcaccgggctcggctttcttggcgtgcttggctttaacatcttcggctacattat

SEQ ID NO: 56079 - DNA, 466 bp, Zea mays
  Clone ID: LIB3068-046-Q1-K1-D7
atccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctgggccatcaccaagtagcccggccggtgcgttagcatgcaatgcgcgcgcagggtgatctcgtggcgggggaacgcgtgtgcgcgtgtcttgagatgtgattccttcctttcttggttagttgctgctgctcctgctggtgtagtactggtgtatccagtccttttaatttcttg

SEQ ID NO: 56080 - DNA, 442 bp, Zea mays
  Clone ID: LIB3068-046-Q1-K1-D8
atcgaccacgcaccccaccaacctatacccataccagaggctctctgattctgcgggtcgagagcagatcggctgagcgagcgagcgagcgaggcacacggagctagctaaacagagcacactgattgaaaagcaagatgtcggacggcacggcgacctgcatcgacatcatcctcgccattatcctgccgccgctcggggtcttcttcaagttcggttgcggtgttgagtgctggatctgccttatcctcactttcgttggctacctcctcggcatcatctacgccgtctgtgccatcaccaagtaaccggccggagcggtagcatgcaatgcgcgcgcagggtgatctcgtagcggcggacgcggtgtgcgcgtgtcttgagatgtgattgcttccttccttgcgtagctgctgatgctcctgctggtgtagaactggtg

SEQ ID NO: 56081 - DNA, 339 bp, Zea mays
  Clone ID: LIB3068-045-Q1-K1-F8
aaaaaaaaaaaaaaaaaaaaaaatttaataaaaaaaaaaaaaaaaaaaaaaaaactgaaggaaaaattaggccgggcgttcctttattaacgatcttactttcctcttctttcaattccatatctttgttatcttgtcccctaacttaaattcattcgacgggattttataactcaactcttgggaaatcaatttccatacctcccttaactgactcgtcttgcattacttattttctagatgaagcagataacctaagacttccgctccatctcgtttttctaacaatacctttacctaaaattattttggatatctccctctcttttttttttaatt

SEQ ID NO: 56082 - DNA, 128 bp, Zea mays
  Clone ID: LIB3068-045-Q1-K1-G1
gaaaaaccggcgcgagccacgcgtccgcccacacatccacccacgcatcctttttttttctgctatacaaccccaatctccgggggctgtattattaggagccctccctctcttatgagacctacatg

SEQ ID NO: 56083 - DNA, 224 bp, Zea mays
  Clone ID: LIB3068-045-Q1-K1-G10
cccactcgtcctaaaaataaatttattttataaaaaaaaaaaaaaaaataaaaagagggattttttaaaaaaaaatataataacacctataaaaatttttaaactaaaaaatcttatacatacaaactcctaactcttatatatttaaccgcccccctcttttaattatccaactttacttcccttttttttcaaaattttatttttttattatgtccccctaa

SEQ ID NO: 56084 - DNA, 108 bp, Zea mays
  Clone ID: LIB3068-045-Q1-K1-G11
tctacacctccagcgaccgctcttaatttacaaccccacacgtccgactagttgtaggtctctaggccgcccttgcacaccaacaataaaccgttgtttgccatgaat

SEQ ID NO: 56085 - DNA, 110 bp, Zea mays
  Clone ID: LIB3068-045-Q1-K1-G12
cggacgcgtgggcggacgcgtgggcggacgcgtgggcggacgcgtgggcggacgcgtgggcggacgcgtgggcggacgcgtgggcggacgcgtggggttctagatcgcga

SEQ ID NO: 56086 - DNA, 280 bp, Zea mays
  Clone ID: LIB3068-045-Q1-K1-G3
aatcaaaatcaaacttattttttacccttaccttccacacaaaatggctgtgctttttaaactgatcttaccacacctcatctaacttttaacacatattccatcccatccaaactacccaacttacaatctcttcctccctgatctgcccttctaagcctaaccttcaatccaaaataaagatcttatcccctatttctacccacaaaaataatcaaccatccttataaatatttaatttttactatctcaccactaactcccatttattctacaccct

SEQ ID NO: 56087 - DNA, 308 bp, Zea mays
  unsure at all n locations
  Clone ID: LIB3068-045-Q1-K1-G4
gaaaaanggctggacgcacgcgtccgaccacgcgtncgcccacgcgtacggtgtttttctgctctccgacccctagctccaaaggccggatcattaggcgcggtccccctctcatgtaaccgacatggcgctgccgaatcaggggaccgttgattaccccagcttcaagctcgtcatcgtcggcacatggtggaactggtaaaactacatttgcgaagaagcatatcactggatagtttgagaacaaatatgaaccaaccattggtgtgaaaaatcattctttggatttcaccactaactgtggttag

SEQ ID NO: 56088 - DNA, 295 bp, Zea mays
  Clone ID: LIB3068-045-Q1-K1-G8
ggaccgttgattaccccagcttcaagctcgtcatcgtcggcgatggtggaactggtaaaactacatttgtgaagaagcatctcactggagagtttgagaagaaatatgaaccaaccattggtgtggaaaatcattcgttggatttcaccactaactgtggtaagatcaagttctactgctgggataccgcaaggcaagagaagtttggtggcctcaaggatggatactatatacatggccagtgtgcgatcatcatgtttgatgtaacctcaaggctacttacaaaaatgtttct

SEQ ID NO: 56089 - DNA, 308 bp, Zea mays
  unsure at all n locations
  Clone ID: LIB3068-045-Q1-K1-G9
ctgnaaatcacaatcaaacgatcttttaccctgctgttccacactatattggctgtctcttttaactcatcttactacaccttcactatcttttaacagatgtgccgccccatccaaactccctacctgacaatgtctttcttccagatctgccctttaatgctcttccttctaatctaaaagatgtgctgtttctccctttcgacccaatatataatctaaatatctataaaagtattgatatttaaactttctccccgttcgcttcctctttttccttaaacctttccaagatcatttttcacata

SEQ ID NO: 56090 - DNA, 178 bp, Zea mays
  unsure at all n locations
  Clone ID: LIB3068-045-Q1-K1-H10
ccacgcatacaaccttctcctcgaagctggagctccttttcacccacctacccaccgcccccggggtcgtttatttgctatgagattactccccccaaaactcctcctncttcaccacttccatgcccaaagtcaatcgcttcttcctctcactgtaacgcccctaactcaacaatct

SEQ ID NO: 56091 - DNA, 397 bp, Zea mays
  unsure at all n locations
  Clone ID: LIB3068-045-Q1-K1-H2
nccacgcgtncggtgggcgctggggcaggcgaagcaccagaagctggccgccgacgggctgcggttccgccgcgtggtgcgcggcgagcagcangtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaaccatacggacacgggtgggccgaagcgaccacgacgatgttctccgtcaattacgtgtcgagctaatcttattattggttctattattataataatgcttctccctgttcctatggacctatagtagtatactagtatgttgcgagggagcagt

SEQ ID NO: 56092 - DNA, 315 bp, Zea mays
  Clone ID: LIB3068-045-Q1-K1-H4
ggagaaggcgcgccccgagtgcctctgctacatcatccagcagacgcacaccgggcgcgaacgcaggtgcagtcgctcgggctgcgcttccaccgactcatggcgctccccgccgactgcaacctccccaactccaacgtctcgctctgcatcaccctgctgaacctgaagccaggctctgcggactacgccctcttcgccaacgcctccaagatcacgccgtcagccggcggcaaccctgcgagcgacagcgccgcgggcagcggcgtcaagttccgggctggggtcagcggcggcgtcgcgcttcgccgggtc

SEQ ID NO: 56093 - DNA, 237 bp, Zea mays
  Clone ID: LIB3068-045-Q1-K1-H5
agctgcggtattatattcaccagaagctggacaccaacgggcgggggttgcatcatgtggtgcccgactagcagcaagtcatgtccttgatgaactaccgtctctacgtcgacgcctacgaccccgacggccgcaccgtgccctacattgacgtggtgtacgagcagttctggacccgcaccacccagattaacttcttcaacccggtgctctgagctccctgaaaccatactgaca

SEQ ID NO: 56094 - DNA, 412 bp, Zea mays
  Clone ID: LIB3068-045-Q1-K1-H7
cttaaccttgcgctccaggttcatgttttgagcgcgtactacaatgcatgtggtttgggaaatggtgacgctggcgttcccatggaaatctggccacctgtatgctatcatcaccttcggcgcgctggtcttctggacttcatttgccgggagacaggacagcttcttgatggatcaagacgtcctacgtcaacaagaatgagagggagcacgaactgagcagaaggaagcggtagtgccactggtgcaagctcggcggctcaccgtcaagacgaacgattacagcagctatgacccttccccgtccatggacaagccacactccaagctcataccgaactgatcaatcatgtacgcgtccaggttgcagcagcggagttgccgatgaggaattaacagcttaaatgtgtgc

SEQ ID NO: 56095 - DNA, 276 bp, Zea mays
  Clone ID: LIB3068-045-Q1-K1-F6
tgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaagacgatgctatcacatcgagcccgttcctggggacccaaatcaatatatctgttatgtagc

SEQ ID NO: 56096 - DNA, 403 bp, Zea mays
  Clone ID: LIB3068-045-Q1-K1-H9
accttctccgggaagctggagcgccagctcacccacctggccggcgccccggaggtccaagaggtgcgaggagatgacgccgtcgaagacgccacctcccgcaccacgtccatgcccaaagtcgatcgcttcttcgccgcactggaaggccccgaactcgacaagctcaagacgtctgaggaactggtgctgccgtcggacaagacgtggccgttcctgctccggttccccgtgtcggcgttcggtatctgcctgggcgtgagcagccaggcgatcctgtggaagacgatcgcgtcgtcgtcgccgaccacgttcctgcacgtatcccacaaggtgaacctggtgctctggtgcatctccgtgctgctcatgtgcgccatcacggccgtctcgcgctcaagct

SEQ ID NO: 56097 - DNA, 448 bp, Zea mays
  unsure at all n locations
  Clone ID: LIB3068-046-Q1-K1-A1
cccacgcgtccgggacactggaacttaccatgaaaaaacaatatctacttcagaggacacagtacaagataatttgacagaagatgagccaagttttggtagtcaagaagtagatgatgcagagtcaacagaagaaactaagcaaaacatagctgagaatattgcagaagtctctgatgtggcgattgttgatgacgcaattgaacagaatgtgctacagactgaggatatcgttgaaatgcataaacaggagctggaacgagaagaaacagagagaatagaacctgttgaatcagaggaagcttctgatcagaggaatgatgcaccattcgattattcagctcgagaagataatacataggaaagtgagatacagcagacagaatcagcaacgganacaaatgaaattgaacccactgaaattgaagcagttcctcgagaaaagcat

SEQ ID NO: 56098 - DNA, 351 bp, Zea mays
  Clone ID: LIB3068-046-Q1-K1-A10
cactgaccatggggttcccgccggtgtgctgctgcgcccccatccccaagccggtcgtcgccgtctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccggtggatcg

SEQ ID NO: 56099 - DNA, 67 bp, Zea mays
  Clone ID: LIB3068-046-Q1-K1-A12
cccacgcgtccgcccacgcgtccgcccacgcgtccgcccacgcgtccgcccacgcgtacgatcgcga

SEQ ID NO: 56100 - DNA, 349 bp, Zea mays
  Clone ID: LIB3068-046-Q1-K1-A2
cccacgcgtccgggacactggaactaaccatgaaaaaacaatatctacttcataggacacagtacaggataatatgacagaggatgagccaagttttggtagtcaagaagtcctatgatgcagagtcaacagaagatactaagcaaagcatagctgagaatattgcagaagtctctgatgtggcgattgttgatgacgcaattgaacagaatgtgctacagactgatgatatcgttcaaatgcataaacaggagctggaacgagaagaaacagacagaatagaacctgttgaatcagaggaagcttctgatcagagtaatgatgcaccattcgattattcagctcgaga

SEQ ID NO: 56101 - DNA, 461 bp, Zea mays
  Clone ID: LIB3068-046-Q1-K1-A5
aactccacgtcacacacctcacagagctgcaacagcatcagctgccacctccttccttccttcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatc

SEQ ID NO: 56102 - DNA, 428 bp, Zea mays
  unsure at all n locations
  Clone ID: LIB3068-045-Q1-K1-B2
gccggaancccgggcgaccacgcgtccgccacgcgtccggaaaagcttcaccaccagaacgttatcaagctcaaggagatcgtcacctgcccaggcccagagcgggacgagcaagggaagccaattgacggtaacaagtacaaggggagcatttacatggttttcgagtatatggaccatgatctcaccgggcttgctgatcggccaggaatgcggttcactgtgccgcagattaagtgttacatgaggcagctgcttacaggcctgcactattgtcatgtcaaccaagttctgcatcgagatatcaaaggatctaaccttttgatagacaatgaaggtaacttgaagcttgctgattttggccttgcaagatcattctcgagtgatcacaatggcaaccttactaaccgtgtgatcactttgggtat

SEQ ID NO: 56103 - DNA, 349 bp, Zea mays
  unsure at all n locations
  Clone ID: LIB3068-045-Q1-K1-B5
cgcgtccgcccacgcgtncgatactatacctacctacctgtgtcggtttcgggtacaggtacccttggggggaatgtcgttcgagcttttcctgtgagtatggcatgggttacatacttcagcgccgtagcgcctggtatgagcctggtggagaagcaatggctagtacacggtgctcatacttcagcgctgcagcgcttggtactcggaccttggctcgaggcattttctctacgcctacttaccttgaaaaagcagggtcacctcgtgtccttaaacctattactcattgtcggctaacctaacctgcgccggacctccggtccaacaatgggtagtacaggaatat

SEQ ID NO: 56104 - DNA, 445 bp, Zea mays
  Clone ID: LIB3068-045-Q1-K1-B7
cccactcgttctaaaaaaaaaatttattataaaaaaaaaaaaaaaaaaaaaaaaaaaaaggattatattttataaaaaaaatataatatatatataaaaataattaaataataataaaatatattatatattaaatataatatttttttttttctttttatttttaaaattttttattttttaaactcatttttatctttttattaattttttttttataatatattttttattttttctttattttattttttataattttttttttttaacattttttttttattttttttaatttcttattttatattttttattcttttttatttttttattttttaatattttaattttttatctttttattttctatttttttttaatattatttttttataatttttattaaaacctcattatttttttttttttctcaatttttttt

SEQ ID NO: 56105 - DNA, 338 bp, Zea mays
  Clone ID: LIB3068-045-Q1-K1-B8
agagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagc

SEQ ID NO: 56106 - DNA, 319 bp, Zea mays
  Clone ID: LIB3068-045-Q1-K1-C4
gtcacgtctccaaaacctaactccccccgactcacgaatcccaaagagcctccatggggacgcaccgccactgcctcccactcctcctcggggccgccgccctcgccctcgccgccgtacctgctcgcgcggcgctgggcggcgggcgcggcccgctgctgggcgggtggaacccgatccctgacgtgagcgactcgcacatccaggagctaagcgggtgggcgctggggcaagcgaagcaccacaagctggccgccgacgggctgcggatccgccgcgtggtgcgcggcgagcaacatgtcgtgtccgggatgaacta

SEQ ID NO: 56107 - DNA, 197 bp, Zea mays
  Clone ID: LIB3068-045-Q1-K1-C6
ctcgggaccgtatggtggagatctacttttggacctgtggtatgcttcatgaggaggagtactccctggcacggatgttcttcgccaagacgttcgggatggtgtcactgatggacgacactttcgatgtccatgctactctagacgagtgtcacaagctcaaagaagctatgcagagatgggatgaaagtgaggtc

SEQ ID NO: 56108 - DNA, 279 bp, Zea mays
  unsure at all n locations
  Clone ID: LIB3068-045-Q1-K1-C8
agatgtggccgaccccagctcaaacctatcccaccatgactaatgtcttcccgctccggatccggcccctggcgaggctcggtgccttgtgagcgcaaaagggaggggctggtgcgcccgctatccgacctcactggaatatagtaaaatacacgtctaaaagtaagtggtattttcacttttgcgcccggaggcttcccaactctatacctacacctctcaaagtcagtttcacaanagtccggacttagaagtcaaagcttcaacaggnngtcttct

SEQ ID NO: 56109 - DNA, 132 bp, Zea mays
  Clone ID: LIB3068-045-Q1-K1-D1
gccaaacattaagcccataagatggctttaccataggcaacagaagctgtctaggggtgtcatattgtgaaggtttgggtccgcactggacatcttcagcaactaaccctgtaacttgcgagttgacggccc

SEQ ID NO: 56110 - DNA, 60 bp, Zea mays
  Clone ID: LIB3068-045-Q1-K1-D12
cggcccgacccacgcatcctccgactcgttctcaaacacatattcttttactaaccacac

SEQ ID NO: 56111 - DNA, 358 bp, Zea mays
  Clone ID: LIB3068-045-Q1-K1-D2
tggacgcgtgggcagcacgctgatgccgtgcctgccgttcgtccagatgggcgggggcatgccgccccagccgtgctgcggcggcatcctcagcctgctgcagcaggccaacaacacccccgaccgccgcaccatctgcgggtgcctcaagaacgtcgccaacggcgccaacgggagcggcacctacatcagccgcgccgccgcgctgcccagcaagtgcggcgtcgccctgccgtacaagatcagcaccaacgttaactgcaacacgattgattaaatgaagcgtcctgtgcgcgtccgggcgaggaatgcatgcatggcggagagtaataaagtaatgctgctggtattttaagct

SEQ ID NO: 56112 - DNA, 306 bp, Zea mays
  Clone ID: LIB3068-045-Q1-K1-D5
cacccgtccgcccacgcgtccggggggacttcgggaagctgacggactgcatggactacgcgacggggcacgcggcgtcgccctcgtacacctgctgcggcgacgccggcgacacggagaaggcgcgccccgagtgcctctgctacatcatccagcagacgcacacggggcgcaaccaggtgcagtcgctcgggctgcgcttcgaccgactcatggcgctccccgccgcctgcaacctccccaactccaacgtctcgctctgcatcaccctgctgaacctgaagccaggctctgcggactacgccc

SEQ ID NO: 56113 - DNA, 400 bp, Zea mays
  Clone ID: LIB3068-045-Q1-K1-D8
ggcggaccaagccttccggccaacattaagcccctggggggggcacaacatttttggcaggaacttgctcggccctgcaaccttggaaaggttaagggagcacttgacaaatccagcaacagttccagcaacttgcgattcgtaaccaaagcttagccagccaagctggtcagatggcaccagcgtcaagcaaatctgttaggttcccattgcgccctggcaagggtacgcatgggtccaggtgcattgtgaaggcaaatcatttctttgctgagctgcctaataaagaccttcaccaatacgatgtatcaataacacccgaggttacttcacgcggcgtcaatcgtgctgtcatggcagagctagtaaaactttacagacactcccatttggatgggcg

SEQ ID NO: 56114 - DNA, 436 bp, Zea mays
  Clone ID: LIB3068-045-Q1-K1-D9
cggacgcgtgggttttatttcaacttctgctgttatgtctttctataatcttttaaactagtctcacttgctctatattcttaaaagctgctagcgatgtgtatcatctttattggttcttgacacctctaagctgctcattttgtagtgggatctggtgggcacttggaaaggcttgataacctaattagcatggatgaccgaaatatttttctttggaacgtagacatgtcaaataaatcagctaaggtgatctcacagggatcagctgacatgcttccaaatttgagtggtggggcttgggatccacacaatcataattcaattgcttcaatatctgattcatcacttcatttgtgggatctacgttctatggaaaaatcatctgcaattgaaatgcacatatacgggatgtggattataaccccaaaaagca

SEQ ID NO: 56115 - DNA, 306 bp, Zea mays
  Clone ID: LIB3068-045-Q1-K1-E10
aaaaaaaaaaaaaaaaaaaaaaatatattataggcaaaccatataaaaaaaaacaagggggggtactcatacatgcaaacaaataaactaaactataaagacacctaaatataaatttaatgtaacaaaaattaacggccttctcttttttaaaaaccctgccttttcctcccacttgaataccccttgcaacacatttcttcttttggccacctaacttaattgccatgagccccgttctacacgcccttcccaacaaaacccctgccttaaccaaaaataagaccctccctgtaaatgcccttt

SEQ ID NO: 56116 - DNA, 419 bp, Zea mays
  Clone ID: LIB3068-045-Q1-K1-B12
gagaagagaggtcccggagggaagaaatcaagctgcaagatatccaaaggagatgggttgcatctaaccgatgggctgaagctgcccagtttgcgcttgctagaagcctcacatcatcacatagtgacctccttgcattagaagctgccgagggaaataatattctgaggagaacaaaggatgctgtaatcactctgcaaagcgtactggaagggaagcacaatactgaaatcgatgaatctctaactcagtatcaggtcccagctgatcgatggtggtcttcactttacaaagtgatcgaaagcctcgccacaatgagcagattgggccgcaaccgtctgcagcaaccttcttataattttgagaacaacaattctattgactgggccaaatgtagatgtagaattctggatcacaac

SEQ ID NO: 56117 - DNA, 373 bp, Zea mays
  Clone ID: LIB3068-045-Q1-K1-E8
aatagcaacatgaactaaatgtcctgttgctatttcccgattcaagggggagtaccttcgatgggataatttcttaaaagtattaacctatccccaaggggtgggtccccttcttacgggtcagtgggatctttatgcccaaaaaactgattcgagtaatcatttatttggtaccactcaaagagcgggaactgccattctgacccttcttgggggattccatccacaaacacaaaatttgtggctgaccgatattgctcatcatcatttagctattgcatttatttttctcattgccggtcatatgtatcgaactaacttcggaattgggcacagtatcaaagatcttttaaaagcacatactcctcggggg

SEQ ID NO: 56118 - DNA, 345 bp, Zea mays
  Clone ID: LIB3068-045-Q1-K1-F10
ccagcttctctaaagatcacaatgatgagagccctggcggtggtggccatgctggccggcgccttcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcggcgtggcgtccatcatccccgagtcgctcttcaaccagatgctgctgcaccgcaacgacgcggcgtgccccgccaacggcttctacacctacgcgggc

SEQ ID NO: 56119 - DNA, 370 bp, Zea mays
  Clone ID: LIB3068-045-Q1-K1-F5
cacgagagagacgaatcttccgaatctctcggtggcgatggcgctctccgaccgctgccgcgagtcgctcctcccgagcttcctctacggctcctcggcgcgctctttcgctgccacaggagccgccgcgcgcctccctgtctcctccccggcgcctgccgcggctggagcatgaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccaacgaaatacaagaatatctcatctggatttggt

SEQ ID NO: 56120 - DNA, 344 bp, Zea mays
  Clone ID: LIB3068-062-Q1-K1-F7
cccacgcgtccggttactcgtgccgagcacttgatctcggacgaatgcatctacttcaacatggagaggatttagctgtaatcacatggcctaagtattctctaggacctccgtagtgctgtgatcaaactaaacatcgtgattcatcgtgaccgtaccagttctgactccgacggtcgacgccaccggaaagcccccgatggggccgaccccggttcctcccgccgtcgggacgcaacaggctgctctcgccgcccaagccaatgtagcatagccagatgagccgacggataccgagccaggtcccgccagttcaaccgttatagccaatgcttttgccgaag

SEQ ID NO: 56121 - DNA, 419 bp, Zea mays
  unsure at all n locations
  Clone ID: LIB3068-062-Q1-K1-F9
cccacgcgtccgcccacgcgtccgatttacccggaggatgcgagcaagaacaaggacgtgaagaagttccaccgggtcacgcacagccgctacgagtactcgacgccgacgtggacggtgtttgccacggatgatcccaacgcgcagtggaacatgctggtgaagaaagactcgtacacgccggcgtgcccctacgcgtacccggacggcggcgagagctggcacatgaccgggcacctctgcatccctaggaggtgctgctgattgtgtcattggattttggattgcatcctccttcgtcgtcacgagcagctaccagctactgcgaccttcncccccaaatcagtaataaaccactagggaattagcagggctcttggtgcacctgatgatgacatcagcggagccctgcctctctg

SEQ ID NO: 56122 - DNA, 279 bp, Zea mays
  Clone ID: LIB3068-062-Q1-K1-G10
ccgcacgcgtccgaaaaaaaaaaaaaaataaataaaaaaaaaaaaaaaaaaaaaaaaaagaaaagaaaaaaaaaaaaaaaaaaaagaaaaaaaaaaaaaaaaaaaaaaaaaaaaaaaaaaaaaaaaaaaaaaataaaaaaaaaaaaaaaaacaaaaaaaaaacaagaaataaattcaaattataaaaaaataaaaatataaaaaaaaggagaacattaaaaatgattaaaaccccaaattaaaaaaaattgaaaaattaaaaaaacactatcgactatt

SEQ ID NO: 56123 - DNA, 326 bp, Zea mays
  Clone ID: LIB3068-062-Q1-K1-G11
gcgaatcctgctagccaacaacgccgttagttaaagcccatgcgccatggcgacacaggaggataaaaaaaaaacaaaggcagcaaaaaaaaaacataccaaaaaaaaaaaagacacccagaaaacaaaaaaacaacctaaataaagcaacacaattcaacacaaacacacatatacaccataacttacatctaacaaaatcgacctacgcatccaaaaccacagcacccaatcagaccacagcaacggctgcaacccctgctagaacgccacgaaacacatacccatcccggctgccaaaaacacccgcggactaacactccacg

SEQ ID NO: 56124 - DNA, 442 bp, Zea mays
  Clone ID: LIB3068-062-Q1-K1-G2
accggagcagcggcgctcgcgcgggcggattcttggcggacgacgattacaacgaaatcgacatgggctatgaggatgagcctgcagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaggagcttaaagcgcgcaagataccctttacgatcagacggtacctacctgatggaagttatgaagactggggagtagacgagctcattggggaagactcctggaaacg

SEQ ID NO: 56125 - DNA, 400 bp, Zea mays
  Clone ID: LIB3068-062-Q1-K1-G3
cggacgcgtgcggtgaaccagaaggcgctttttcctggcgactctgagatcgatgacctgggggggattttcagaattttgggcactccaactaaagaaacatggccaggcgttacttcgttgcccgattacaagtcaactttcccaaagtggccacctgtggatcttgcaacggtggtcccgacactcgaaccggcgggaatcgatctcctatctaagatgctgcgtctagatcccagcaagaggatcaccgcccgcgccgacctcgagcacgactacttcagggacctcgagcacgcctagcatgatatggatggatggatgaaccatttaccctgccatgctccctctgtaaattacggtagcagccgagatgcttggggccggcgagtacccgttt

SEQ ID NO: 56126 - DNA, 126 bp, Zea mays
  Clone ID: LIB3068-062-Q1-K1-G4
accacgcgtccgccgactcctcagtcgaattaaaacctaaacaacaaacaccaaaaaaaagagagagactacaaaaaataacttaaaccagacacacaaagatcaaaagagagaaaccagctacaa

SEQ ID NO: 56127 - DNA, 460 bp, Zea mays
  Clone ID: LIB3068-062-Q1-K1-G5
atctcgtttcccccgcctgcgcagccagcgtttaccctagccaacaagcgccgttctgcgagggtctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaagtgtctgatggtgaagaatttgaaactgacagtgaagattctgatgtgagtggttccgagggagaggacacgtcctggatttcatggttctgtacattgcgaggcaatgaattcttttgtgagatcgatgatgactatatacaggatgatttt

SEQ ID NO: 56128 - DNA, 396 bp, Zea mays
  unsure at all n locations
  Clone ID: LIB3068-062-Q1-K1-H12
cggacgcgtgggagcagctgccacagtgacatcagagagcggtcctccttgtgagtgtgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaaaagggccccagggggacatgctgctggtggtgccgcaggcgcgcacgcngtgcggctgggcaa

SEQ ID NO: 56129 - DNA, 397 bp, Zea mays
  Clone ID: LIB3068-062-Q1-K1-H2
ggacggccgcaacatcaccgtcaacgaggctcagtcccgcggcggccgtggaggcggaggcggcggctggtacagtggtggccgtcgaggcggcggctacggcggtggcgggcgccgtgatggcggcggcggctacggcggtggcggcagctacggtggtggcggcggcggctaccgtggtggtggcggcagctactgcggtggcaaccgtggcggcggctacagcaacttcgacgggaactggaggaactgagcggtggggcccgcgcggacaagttatcctgttcgctaccgtgttgtttaccctagtccagagtgtttatcttcggtcgactcgcgtttgctgttgcccatctgtgtttttgattgaaggtcgctctgtgtcagttgttagtgc

SEQ ID NO: 56130 - DNA, 442 bp, Zea mays
  Clone ID: LIB3068-062-Q1-K1-H7
cattggtatcctacctgccagcgaacctgtttcgtcttcttgttacccacgtggcctcgccggggccgctagctccaccttcctgagctccgccccgagcgcgatgtggcgagcgacgaggcggtctccgccgttcctgcgatggctatcgtcggacgcagcctcctctaaggcgccgcggcagcgcgtagcggcgctgtgggggaacggtgactacgggcggctggggctgggttcgctggagtcgcggtggagccccacggtttgccccttcttcctcgcccgcgccggcgacccgcccgccttcctcgcctgcggcggcgcacataccctctttctcacccagaatgggcgagtgttcgctacagggctgaacgactttgggcagcttgggataggaacctctggtacacatatgctggagccctgtgaaatttctgga

SEQ ID NO: 56131 - DNA, 403 bp, Zea mays
  unsure at all n locations
  Clone ID: LIB3068-062-Q1-K1-H9
gcgcatcctgctcgcctcctctgctgatanggaaagcgtatgtgtgatggtgacagtgattaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttaaaagatccaaaatttacaaccccggaaatgcaactaaaaaatttttcaaaggggaccccaaaataaaatacaggggccggatttaaaaaacgtagaaacgggaaaaacctgggataaaccaaactaaaaaaaatttacccttggaaaaaaatccccttttcccaaagtggcgtaaaaccaaaaaggcc

SEQ ID NO: 56132 - DNA, 430 bp, Zea mays
  unsure at all n locations
  Clone ID: LIB3068-062-Q1-K1-F12
cggacgcgtgggcggacgcgtgggtccttacatacagctagatagcctctgcatgccgacggacagcatggccaaggccgagctgctcctcgccctcgtggcttcgctcgtcgtgctgccattctcctccctcgccgtgtaccaggacttctgcatcgccgacctatccgccgccgccacgccgggcggctacccgtgcaagcccccgaaggacgtgaccgccgacgacttccactatggcggcctcgccacccccggcacggcgctgaaacccttcaagatctccctgggctcggccgtcgtcaccacgttccccggcctgaacgggctgtggggnnccccatctctgccgcgcggatggtgatggtcccgggcggcgtcgcgccgctgcactcccacccgggaggcaccgagctcatcttcgtcatcg

SEQ ID NO: 56133 - DNA, 353 bp, Zea mays
  Clone ID: LIB3068-062-Q1-K1-D10
cgacccactcccgatcagcagctgattgctcactcttgcagctcgatcattctttaggtgcggtagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccggcgaagccaaagtggaagagccagctgccccggcggagaccgagccagctgccgccgctgagcccgaggcggcccccgtggcggcaggagaggggggaaaagagacgc

SEQ ID NO: 56134 - DNA, 429 bp, Zea mays
  Clone ID: LIB3068-062-Q1-K1-D11
cttgatcagggagacacagtgctcggtctgcctagcagaatacgaaccgtacgagaggctgcaaaagatacctccctgtgggcataccttccacatcaactgcatcgaccactggctctccacaaacaccacctgcccactctgccgagtatcgctccttcccgcccccaaggcaaccagcaccggactggatctggaagcacagactgtggtagaagaggagtccccgaacgcacatcatcgccaggaggagggactagttgatgccaacacaccacaggaaggtgaggcggccgtaggtgacggagcaagtagcgtccagattgaagaacccccccggggcaccacgatgcggccgagccactggtagtgacggtggtcgctgtcgctgcacctcacgctgacgctgaaggttcaccgagtacagca

SEQ ID NO: 56135 - DNA, 289 bp, Zea mays
  Clone ID: LIB3068-062-Q1-K1-D12
cccacgcgtccggtcaaaatacacgaatggcttcgaggcgaggcctagtatagaggagaacgagtgagaggggggaaatgctgcgccacgccgcccgccgtctcgtctcccgcaccgccgcggcgcccaccgcccgccgggcgctcgtcacggcagaagtgcctgcggaggccgccgaggactccacgtttgtggagacgtggaagaaggtcgcccccaacattgagcccccaacgacgcccctcttgctcatgcagacgcgcccggccacgccggctaccattcccac

SEQ ID NO: 56136 - DNA, 470 bp, Zea mays
  Clone ID: LIB3068-062-Q1-K1-D2
ccgatgccccaattcctccttcggatctcgttttcagcgcagcgcacgtgtgaaggaaggggggcgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttattcttgttgtggacagcaatgaccgtgaccgtgttgttgaagccagagatgagctccacaggatgctgaacgaggatgagctacgtgatgctgtgctgcttgtttttgccaacaagcaagatcttcccaa

SEQ ID NO: 56137 - DNA, 275 bp, Zea mays
  Clone ID: LIB3068-062-Q1-K1-D3
acgtctggctgcagagcactatagccctgctgttttcccttgccgccttgcgtattgtgtttacggggcacaatatagcaagagctgttgcctacagaggagcaactgccgtatatggcttcatctcgccgtggcttgacatgctcgtgtcagacatgctctccgtctgggccatcacactcagcattctcctctgtggctacagcttatacttccctatatcaatatacaatcctgccgttagtgcggctatagcagctggtggcggatggggc

SEQ ID NO: 56138 - DNA, 479 bp, Zea mays
  Clone ID: LIB3068-062-Q1-K1-D7
ctttcgcccgtcctccctcgccttcgccttctccttcgccggcaggagatttccaccaccacggggggaccgtccagaccctccggcgctatcacgctatggcccatactgttgtgctcaaggttggcatgtccattgagggctgtattggagctgtcaagcgtgtcctgggcaagatggaaggcgttgagtcctacgacgtagacatcatagaacaaaaggtcacctgtaatggcaatgttacacctgacgccgtcctgcaaactgtttccaagactggcaagaagacttcgttctgggaggctgacgccgtgacaagtgaatccgtcacacctgccggtgccaacttctgacaagttcgatgatcacgaagtgccctgcaaggcagctaataaaaaaatgtgaatgtatctagcttggaactgttacaaataatttcaaactgctaactcggtctggacattttacatttgctattc

SEQ ID NO: 56139 - DNA, 188 bp, Zea mays
  Clone ID: LIB3068-062-Q1-K1-D9
ctgaatcgaacaggaacagaaaccgattggatttgcaacacaccagacgaaccatgggctggtttatatacacacatgggcgccagactatcactagaacagcctctatgaatggcagacttgacacatcaaatggcctccaatctacactgccgctcaacataccgctaatgccataacgaacgaag

SEQ ID NO: 56140 - DNA, 286 bp, Zea mays
  Clone ID: LIB3068-062-Q1-K1-E10
cagcagcgtcggggcaaaaatttcacctcgctcgatcaagcgattgatgcccccgtcggggcgtccgtgccgctgtcctcgccgtcgcaggccggcctccttggccccccgttcccgctcctgccaccgcccttcggtgcatgcctccgctaccgcttgccgaggctgcctacaggcctctcgtcgagcgtgaggaagggagggctcctgccgctgccgctcctggtgcctcccagggccgcggggggcaaggacgggcgggccgtgaccaaggaggagttggaag

SEQ ID NO: 56141 - DNA, 143 bp, Zea mays
  Clone ID: LIB3068-062-Q1-K1-E12
cccacgcgtccgggcatcacgaatgtgtaacctcaaagccctggtcacctcactactgtgcatctcggcgttgtcgtcgtcgccatggccatgcaccgcaaccggtcaactgggccgcaagcccctggtcaccggcgtcacca

SEQ ID NO: 56142 - DNA, 468 bp, Zea mays
  Clone ID: LIB3068-062-Q1-K1-E3
ttcatgttatcagtttacttaactgacattttccacaacaaatctcttgattcggaattaggggctcatgttccgtctgatgaatcgattttctcttttttttacacttctgtatctcactctatcttgttttttattattatctaaaataaccgatgaattatgaattttccataacttaaacttacgtaagtgctttaccaacatatgtagtgtactaaaaaaaatggaattgaaccccttcatgcttactataactagttatttcggttttctactggctgctttaactataaccccagctctatttattagcttgaacaagatacgtcttatttgaaatgaattgaatagaataatctttcttttggattcttggtattctagactcttttccacactaattaccaattcttttcttggtcattgagattcgtgggtagtttagactattatttagagatagat

SEQ ID NO: 56143 - DNA, 467 bp, Zea mays
  unsure at all n locations
  Clone ID: LIB3068-062-Q1-K1-E6
cccacgcgtccgattggacagtcgtcaagtgtcatgacacaggttccactcctctatatccggggtgcattcataccagcaacgatgatcgctgttctctactacttcgatcacagcgttgcgtctcagcttgctcagcagaaagagttcaacttgaggaagcctccatccttccactacgatttgcttctcttaggtttcctgacgttaatgtgtggccttattggtatccctccatcaaatggtgtcattccacaatcacccatgcatacgaagagtttggctactctcaagcaccagatccttcgtaaccggctagtagccaccgcacggaagggcatgagccagaatgcaagcctgagccaactgtatggcagcatgcangatgcttatcagcagatgcagacaccactggtttatcagcaacagtctgtcagaagaggcttaaatgagctcaaggactcaac

SEQ ID NO: 56144 - DNA, 430 bp, Zea mays
  Clone ID: LIB3068-062-Q1-K1-E7
cccacgcgtccgcccacgcgtccgctctccttatcctgctgctcgccctctccttgccaagtggggaggagtcccgagccccctggtatgatcattgcgctggacgacgaggaggtcgaccaagggtacgggtacggcgccatgtcgtcagagctggagctctgcgtggcgcgcatcagggacctgagggcggagctggagttcgagcggcgcatgcggcgcatggcggatgcgctgagcgaggcgctggccgcggagctggccgacgagcggcggcggagcgaggccgcggaggccgagtgccgggcgctgctggaggaggccggcgcctcgcgcgcggatgcggagcgcgccctggaaggcgtcgaggaggagcggcggatgctgcgcgtcgcccagctgtggcgcgaggagcgggtgcagatgaagc

SEQ ID NO: 56145 - DNA, 419 bp, Zea mays
  Clone ID: LIB3068-062-Q1-K1-E8
cccatgctatcagtctacttaactgactgtctacacaacacatctctcgattcgaaattacgcactcatttaacgtatgatgaatccactaaatactatcattacacttctgcatctaactctatcttaagatttattatcatctaaaataaccgatgaattatcaatttttcatatcttaaacttaaataaatgcttcaccaacatatttattgtatcaaaaaacatggaattgaaccccttcatgcttactataactagatatttcagctttctactggctgctctaactataaccccagctctatctattatcttcaacaaaatacgtctcatattaaaccaattgactagaataatcctacttttggattccttatattctaaactcttttccacactaatcaccaaatctattc

SEQ ID NO: 56146 - DNA, 301 bp, Zea mays
  Clone ID: LIB3068-062-Q1-K1-E9
cggacgcgtgggtttgattatttgttgtctttgtagtccttatttggtgtcgcatttgttaggtgtgtgttacatgaagaccatatgtgagctagcgatggcttcttgaggtgatggctgtgtttgtacatgaaaaccatatgtgagctagcgatggcttcttgaggtgatggcttctatgagatagctctatgaggccagggtcgtcactgggggatgaaggtcctgaaaaatatagttactgctctgtacatgtgccggtacatttcattcaaaaaaggatggcacaaggacatggcct

SEQ ID NO: 56147 - DNA, 366 bp, Zea mays
  Clone ID: LIB3068-062-Q1-K1-F1
cccaggcgtacgcctcctacacctaagctttttacgcctacgtacactacaagccctaaggggggacctaccaagcctcccacgcgccaaccgaccccgccaacgtacacccctgcagcaaagcctccgacacccaagccgtccccggctacgtacaccctttctaccaagcctacgacgcccgacccgaccccgcctacagccactccaagccccaagccttccacacacccaactcccaagccgaccccaccgacgtacacgccttccccaaagccttcgacgcccaagccgaccccaccgacgaacatctattcctcatagcctcctacacccatgcctacaataccgacgtacactttcaca

SEQ ID NO: 56148 - DNA, 410 bp, Zea mays
  Clone ID: LIB3068-062-Q1-K1-F10
cgggcgcgtccgcctacgcgttcgatttatttgaggatgcgagcaagaacaaggaggtgaggtagtttgagcgggtggggcgcaggcgctacgagtactcgacgcctacgtggacggtgtttgccacggatgatcccaacgcgcagtggaacatgctggtgaagaaagactcgtacacgccggcgtgcccctacgcgtacccggacggaggcgagagctggcacatgaccgggcacctgtgcatccctaggaggtgctgctgattgtgacattggattttggattgcatccttcttcgtcgttacgagcagctaccagctactgcgaccttttattcccaaattagtaataaaccactagggaattagcagggctcttgttgcacctgatgatgacatcagcggagccct

SEQ ID NO: 56149 - DNA, 182 bp, Zea mays
  Clone ID: LIB3068-062-Q1-K1-F11
aaaggaggaagaggtggcttatgatgcatctaaggaagtgaaacaacttatatgtgaacttagatctctgtattgaactgattgtgtgaacttgtctgtgtgaaacttttgtgtgtgaacttgatggctatgtgaaactgttgtgtgctaacttgatggctttatgaaactactatgtgaag

SEQ ID NO: 56150 - DNA, 440 bp, Zea mays
  Clone ID: LIB3068-062-Q1-K1-D1
cacaaggtctacttcgacatcgagatcgacttgtaagcccgcaggccggattgtcatggggctgtttgggaagactgttcctaagacggcagagaacttccgagctctttgcacaggagagaaaggggttggcaagagtggcaaagccctccactacaagggaagtaagttccacagaatcatccccagcttcatgctccaaggaggtgacttcactctcggggactggaggggtggtgaatctatctacggcttgaagtttgcggatgagaacttcaagatcaagcacactggtccaggccttctgtccatggccaatgccgggagagatacaaacggatcccagtttttcatcaccacagtgacaacaagttggttggacgggaagcatgtggtgtttggcaaggtgttgtctggaatggatgttgtgtacaaggtcg

SEQ ID NO: 56151 - DNA, 427 bp, Zea mays
  unsure at all n locations
  Clone ID: LIB3068-062-Q1-K1-A12
gcgtccgcggacgcgtggggtgaaccagaaggctctttttcctggcgactctgagatcgatgaggtggggaagattttcagaattgtgggcactccaactaaagaaacatggccaggcgttacttcgttgcccgattacaagtcaactttcccaaagtggccacctgtggatcttgcaacggtggtcccgacactcgaaccggcgggaatcgatctcctatctaagatgctgcgtctagatcccagcaagaggatcaccgtccgcgccgtcctcgagcacgactacttcagggacctcgagcacgcctagcaggatatggatggatggatgaaccattttttccngcccctcccctgctccctctgtaaattacggtagcagccgcgatgcttggggccggcgagtacccgtttgggcggacgctct

SEQ ID NO: 56152 - DNA, 414 bp, Zea mays
  unsure at all n locations
  Clone ID: LIB3068-062-Q1-K1-A3
ccatttccccatctcccagatccaattctctagttcttcctcctctgccgccatggcgctggctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgtcgtcctcatcgagaccctcaccgcgctcggcgccgaggtccgctggtgctcctgcaacatcttctccacgcaggaccacgccgtcggcgtcatcgcgcgcgactcggccgncgtgttcgcctggaaaggggagaccctagaggagtactggtggtgcac

SEQ ID NO: 56153 - DNA, 400 bp, Zea mays
  Clone ID: LIB3068-062-Q1-K1-A4
cggacgcgtggggtgaaccagaaggcgctttttcctggcgactctgagatcgatgagctgtggaagattttcagaattttgggcactccaactaaagaaacatggccaggcgttacttcgttgcccgattacaagtcaactttcccaaagtggccacctgtggatcttgcaacggtggtcccgacactcgaaccggcgggaatcgatctcctatctaagatgctgcgtctagatcccagcaagaggatcaccgcccgcgccgacctcgagcacgactacttcagggacctcgagcacgcctagcaggatatggatggatggatgaaccatttcccctgccctgctccctctgtaaattacggtagcagccgcgatgcttgtggccggcgagtacccgttt

SEQ ID NO: 56154 - DNA, 280 bp, Zea mays
  Clone ID: LIB3068-062-Q1-K1-A5
ctcatgaaaggctcagaccaatacaagctgttgtaacagccatggcttcagcgaagcagagggagaaaatgcgcatacttctgatcccattcttcgccaccagccacatcgggccctacaccgacttcgccgtccgtctcgcagcggccaggccaggagccgtcgagcccaccgtcgccgtgaccccggccaacgtcgcggtggcccggtcggcgctcgagcgccacgggcccgcggcgagcggcacggtcaggatcgtcacgtacccgttcccgcgcgt

SEQ ID NO: 56155 - DNA, 431 bp, Zea mays
  unsure at all n locations
  Clone ID: LIB3068-062-Q1-K1-A8
ccaagtgtccaggcctggcctcgcactgctggtccaccggttgtcatgaaccccatcagccggcgtaacttcatcgtcaagtccactgagtaggtttgggctggagaagctggttctgcgacttggtgccgccatgaagccagagttccttttctaaggtcttaatcaattgtaataaaacgaaatacagtcaggatttttttgtgattttttacttgatctgtgagcgaacactgggtctttcaccttgtcatccaatgggttctgctccttggtgaaatctcccaccagccagtaaagaactgggttgttttcataatatatgcttttgctacgcagcctctgttgttgtaaggaattgcattggtatcttatatcactgnatggtgatgtttaactagtttgttgatgtgccgcttgtggttggggtt

SEQ ID NO: 56156 - DNA, 419 bp, Zea mays
  Clone ID: LIB3068-062-Q1-K1-B1
cccacgcgtccgcccacgcgtccgcggactcttgggcgatcagctgaatggagtgcatgagaggggagttcatgatctgtggagagtgctgaaggatgagatttgcctgccactgatgatatcattgtgccaactgaacggtctgcgcttgccgccttgcttgatggctttgcctgctgatctcaagactaaggtattggggtttttacctggggttgatcttgcaaaggttgagtgcacatgcaaggaaatgatgaatcttgcatcagatgatagtatctggaagaagcttgtatccaagtttgaaaattatggcgagggctctaagctggcaggcaagaatgcaaaggccatatttgtagaagcttggcaggccaataagagacggcagaagaggcccaatccaaccttttggaact

SEQ ID NO: 56157 - DNA, 108 bp, Zea mays
  Clone ID: LIB3068-062-Q1-K1-B10
atgacagctcgagaaaaccccctaactcgccacaccgtgtaagacgtggggcaaggtctcgaatgactggcgtaaatgcacgtagcgggaatcgtttgaaagtgaaag

SEQ ID NO: 56158 - DNA, 427 bp, Zea mays
  Clone ID: LIB3068-062-Q1-K1-B2
ctcgacaacgaggccatctatgacatctgttttcgctccctcgacattgagaggcccaactgcgccaacctgaatcgccttgtgtctcatgtgatctcatctctgactgcttccctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcatgtacatggcttgctgcctgatgtaccgcggcgacgtggtgcccaaggacgtgaacgccgcggtggccaccatcaagacgaagcgcaccatccagttcgtggact

SEQ ID NO: 56159 - DNA, 221 bp, Zea mays
  Clone ID: LIB3068-062-Q1-K1-B6
cccacgcgtccgcccacgcgtccggatctattgttgctgcaatgcaagccttcacgtgtgttggcctctctacctaaagaataaatcaagctagcagcaaacctaccttcggcgtgtgtctacttgcttatcatagtgtgtgtccgtgtatgagagatgatgtactgtcacgaactcacgtgtgtatgagagaggatacatggtaagactatcactactag

SEQ ID NO: 56160 - DNA, 441 bp, Zea mays
  Clone ID: LIB3068-062-Q1-K1-B7
ctcatgaaaggctcagaccaatacaagctgttttaacagccatggcttcagcgaagcagagcgagagaatgcgcatacttctgatcccattcttcgccaccagccacatcgggccctacaccgacttcgccgtccgtctcgcagcggccaggccaggagccgtcgagcccaccgtcgccgtgaccccggccaacgtcgcggtggcccggtcggcgctcgagcgccactgccccgcggcgagcggcacggtcaggatcgtcacgtacccgttcccgcgcgtggacggcctcgctccgggcgtggagaacctcttcaccgtcggagacgacgcgtggcgcatcgacgccgtcgtcatcgacgaggccctctcgcggccggcgcaggaggcgctcctcagggagcggtcccccgacgccgtcgtgtcggactaccacttcttct

SEQ ID NO: 56161 - DNA, 464 bp, Zea mays
  unsure at all n locations
  Clone ID: LIB3068-062-Q1-K1-B8
cccacgcgtccgcccacgcgtccgccgcgactctctctctctttcgccgagctcctcgaaaccggangagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtccccagggaggcatgctcgtcttcgtctccggttccatacgcaccggccccgaagagcaccccatcaagttctcccaagcattccatttgctgccggccgctgggtccttcttcgtgcagaatgacatgttccgcctgaacta

SEQ ID NO: 56162 - DNA, 176 bp, Zea mays
  Clone ID: LIB3068-062-Q1-K1-C1
cccacgcgtccgaaaaaaaaaaaaaaaatatataaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaataaaaccaa

SEQ ID NO: 56163 - DNA, 431 bp, Zea mays
  Clone ID: LIB3068-062-Q1-K1-C10
cggacgcgtgggcggacgcgtgggcgtgtcgcttgggcggacgcgtgggtctgaattgctcagaactgtatcattaatcaaaacctctggtggactgctcatttgcactctgccaatgtgcagtcattaagaatgtcctgccctagtgcagtggtgagggctgtctctctgaatcctcaggtcgcggttcgaatcagtctatctacatttatggggaaaagcttgcctctatttatctcttccatagacccccccccccccctgcgaacctcgggtactgggtctgttttattccttgttagtcgatactggcacctttgagtttctcgtgtggggtttttttagcctggtcaattgtatgagctgattagtgctgagtttagagctaaacaagtagaggtacattccacatggtagacatgttttatatt

SEQ ID NO: 56164 - DNA, 425 bp, Zea mays
  unsure at all n locations
  Clone ID: LIB3068-062-Q1-K1-C11
cccacgcgtccgagacaatgtcatctttcactagtccaagtataactgccatctcatggagaggatagaagctggaaatgccctgcacagagctttcagtgttttccttttcaactccaaatatgagttgctactgcagcaaaggtctgcaacaaaagtgacatttccacttgtctggacaaacacctgctgtagccatcctctctaccgcgagtcagagttgattgaggaaaattgtgcaggggtgagaaatgcagcccagcgcaaactatttgatgagctgggaatagtggctgacgaattacctgtcgaccagttcattccgcttgggnaaaaggggggatgctttacaaggctccttcagatggaaaatggggcgaacacgagttggattacctcttgttcatgggtcgtgacgtgaagct

SEQ ID NO: 56165 - DNA, 364 bp, Zea mays
  unsure at all n locations
  Clone ID: LIB3068-062-Q1-K1-A11
aatcactgaaagtggaattggaagctgtaaaacaggagcacaaccagctcaaagagaaagacacagaaactgaatccattgtcggagatttacatgtcaagcttcagaaatgtaaatctgtgctggaggctgctgtggctgctgaatcaaaagctacgtcagcttctgatgacctgatgctggcccttcagcaactgtccgcggagtcaaacaatgcattgcaagaagctgagataatgcagaagagtgcggcggagctaagaggnnnaaaggggaagccaaaaaggctcgggctgaactagcagaagccgaacaaaagttgcagttgacgttaaaggaagcangagaggctaaagcagctgaa

SEQ ID NO: 56166 - DNA, 126 bp, Zea mays
  Clone ID: LIB3068-062-Q1-K1-C2
acaaagcataacaccaacttaaaaaaaattttaaacaaacaaaaagacaaacaccataacgtatcaatttaacatttcccaagactcctaaaaactaacaaaccaatataacaactaaaattaaaa

SEQ ID NO: 56167 - DNA, 125 bp, Zea mays
  Clone ID: LIB3068-062-Q1-K1-C3
cccacgcgctactccaactatgaaatctgtttgcaccccacagacattaagacgccctaggagtgcattataaaatgtcttgtgactcataaaaactcacatgttacttcttcctttaatatcaa

SEQ ID NO: 56168 - DNA, 185 bp, Zea mays
  Clone ID: LIB3068-062-Q1-K1-C4
gaataccggctcgacccaccgtccgtcgggtcaatccgagtacgcgccgtctacctcgaagcccgcgagtgggccgacggcggatttaagaggccagcaggcgcctacaatctatcacctcacgagcatctctagcattccaccaggctcccactgcttcgtgcccgcatcccctgagcccaacc

SEQ ID NO: 56169 - DNA, 477 bp, Zea mays
  Clone ID: LIB3068-062-Q1-K1-C5
cgggcgagcgctgaacctgaacctggtgggttatccggacctggtggcgagagaccccgtgggggccttcaagacggccatctggttctggatgacgccgcagtcgcccaagccctcgtgccacgccgtgatgaccggcgactggaggccctccgccaccgaccgcgccgcggggaggctccccggatacggcctgaccacgaacatcatcaacggtggtctagagtgcggcgaggaccgctccaccgacggcgccaaagccgccaaggaccgggtcggctactacaagaggtactgcggtatgctcggagtggggtacggggacaacatggcatgcgggagccagaagccttacggaggatgatgacactagtagctgatctatggttgctgcaatgcaagccttcacgtgtgtttgcctctctacctaaagaataaatcaagctagcagcaaacctaccttcggcgtgtgtctac

SEQ ID NO: 56170 - DNA, 202 bp, Zea mays
  Clone ID: LIB3068-018-Q1-K1-F9
tcttcctaaaaaaaaaaaaaaaaaaaaaaaaataaaattaaaaaaaaaaaaaaaaaaaaaaaaggaaaagataaaaaaaaaaaaaaaaaaaaaaaaaaaaaaaaaaaaaaaaaaaaaaaaaaaaattaaaaaaataaaaaaaaaaaaaaaatatatataaaaaaaaaacaataaaattagacaattttttaataatatacaa

SEQ ID NO: 56171 - DNA, 343 bp, Zea mays
  Clone ID: LIB3068-018-Q1-K1-G2
acgcccacgctagcgaaactacgtacttgacaatgtctttctctccgatcatctcctacaggccggcccgttcagaccataagaggggcagatccccgatcgcgacccacgcaataagcaacttcacctttaaaattctcttattcgattttcgtgcgcaggctcccacttatcctactcctctgacttaatttcacactcttgcactacagtcaacctcaacagcgtcttctttatcctctgattccgtcaaatccatctccttggctctcgcctcgatggattgtatacatgcacactgacaatcttcttaatgctttcatacgcgtaactcattaaatca

SEQ ID NO: 56172 - DNA, 443 bp, Zea mays
  Clone ID: LIB3068-018-Q1-K1-G5
gttcacgagatgggttgcatgtttttgatgatttccgtgaagcttacgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgaataggaggtggtgtgttccctcacattaaggagccagattatcttagggacggtcaatatcgcgttgatgctcaagctactccaactatgctgaattgcctcatgtacaaacctttgtac

SEQ ID NO: 56173 - DNA, 409 bp, Zea mays
  Clone ID: LIB3068-018-Q1-K1-G6
cccacgcgtccgaaaaaaaaaaaaaaaaaaatataaaaaaaaaaccaacacataaataggcacatttaacaactcatgcatggcaaagtcaaatctcaaatatacatatacctaccaagcaatctactggccgctccatattcaactactctactctgtaacacccttgcctttccttacttaatcccatttcaacccatccgcctttcgccagccaacagcaataactaaaatacccattcctttccccatttcaaacattttcgcagcctttatagcacatgctactcaccctatcgctaatcttcatgcgcggctctcctttccactaacttcagcttctccattacactatgtaacgccctctgaccctctcctttaccttcattacttccctttttccccacct

SEQ ID NO: 56174 - DNA, 251 bp, Zea mays
  Clone ID: LIB3068-018-Q1-K1-G8
acgcccacgcgtccgcccacgcgtccgcccacgcgtccgaaaaaaaaaaaaaaaaaaaaaaaaaagaaaaaaaaaaaaaaaaggaaaaaatataaaaaataaaaaaataaaaaaaacatacatactaaaaaaataaaaaataatttactttcacttaaatggaattaaattgccgttctttttacatccataattaatggttaaatcctggagtttccaaacttaattgccttgcaatacatttcattttt

SEQ ID NO: 56175 - DNA, 437 bp, Zea mays
  Clone ID: LIB3068-018-Q1-K1-H10
ccaactcactctttctacgcccttccctcttctccttcctctccaagaaaaagtgagcgtggagagcaaaaatctccgccgccgcgcacctacgcccacggaacacgccgtcatatgagtggagagagaaccccgcgcctcctcctccgtgagctccgtacaaggaggctagagcggcggcagcatcggaggggtcggtgaggagggcgatggtgctcccgctggtgaagctcggctcgctcgcgttccggacgctgagcaagcccatcgcggtccgcctcaagtacaacgccggcatccaccccaagttccgcggtctcatcatcggcatcgcgcaggcaaaccatcgtttcacgacaaatatgcagaggcgactttacggacgtgcgactgacattcacattcggcccctgaatgaggagaaagctattcaagct

SEQ ID NO: 56176 - DNA, 439 bp, Zea mays
  Clone ID: LIB3068-018-Q1-K1-H11
tcgccaactcactctctgtacgccatctcctttgctccatcctctacatgaaaatgggggcgaggagagcaaaaatctgcgtcgccgcgcacctacgctcacggaacacgccgtcatatgagtggagagagaaccccgcgcctgctccttcatgagctccgtacatggaggctagagcgtcggcagtatcctaggggtcagtgaggatggcgatggtgctacagatggtgaagctcggctcgctcgcgttcctgacgctgagcatgcccatcaccgcacgtctcaagtacaactccggcatacaccccaagttccgcagtctcatcatcgacatctggcatgcaaaccatcgtattacgacaaatatgcagaggggactttacggacgtgcgaatgacattcacattcggtccctgaatgacgagaaagctattcaagc

SEQ ID NO: 56177 - DNA, 420 bp, Zea mays
  unsure at all n locations
  Clone ID: LIB3068-018-Q1-K1-H2
cccacgcgtccgcccacgcgtccgcccacgcgtccgggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctnccaccgnctcgaggatatcgacgcgtgctccgncgagtgcgaggtccacatcgcgcangagtggctcgacaagct

SEQ ID NO: 56178 - DNA, 453 bp, Zea mays
  unsure at all n locations
  Clone ID: LIB3068-018-Q1-K1-H3
ctgatcacgagtctctcagcgagtgctggagagcccactatgtccgccgccggcggcgacctgccggagactgtggaggtgacgctgcgcgccgtcggcccgtcccgtccaaccaccctccgcctccctccgcttctctcggtcgccgagctgcgcggctgcatcgcgcgcgaacgccgtctagcaggcacggaagaagttcgactccgcttgatcctgcgggggaagacgctcccgcaccaagacgacagccatgtcactctccgcgatggggatactcttatagtcgccgtggcacctaagcctcctgttaatcatcttcttgatgatgacgttgaggacgaagaagaggatgaactgaagttcagaataccacanacgacaaccttgtggaagaggaaatnttntatgtttcttcgagacaaaatgagattgcctgatatccatttgatg

SEQ ID NO: 56179 - DNA, 455 bp, Zea mays
  Clone ID: LIB3068-018-Q1-K1-H5
cccacgcgtccgcccacgcgtccggtcacgtcaccgttcgaggagctgcacggggcgactctgttccacgagagcatggggagcctcgacgcagatttccacgacatggcgagcgaggccttggacgcccacgacaacttcggcatctagatagctatgcgggagttcagggacttgttcgaggggatccagaccatgacctactgctgcggtaacttcggtgatgacaagggtgccagggccattgtcaaagccttctcacacataaaatgcactgtgctggcccctcccaagatcattgccaccaaaccggtcgatggagcgaagactaactatgtcgaaggtgacatgttcagtttcattccacctgctcaaactgtcgtgctaaagctagtgctgcaccacctgacctatgaggagtgcgtcaagctcctggcttaatgccggaaggcgat

SEQ ID NO: 56180 - DNA, 77 bp, Zea mays
  Clone ID: LIB3068-018-Q1-K1-H7
cccacgcgtccgcccacgcgtccgcccacgcgtccgcccacgcgtccgcccacgcgtccggtggttctagatcgcga

SEQ ID NO: 56181 - DNA, 398 bp, Zea mays
  Clone ID: LIB3068-018-Q1-K1-H9
tcttcctaaaaaaaaaaaaaaaaaaaaaaaaataaaattaaaaaaaaaaaaaaaaaaaaaaaaggaaaagaaaaaataaaataaaaaaaaaaaaaaaaataaataaaaaaataataaaaatataaaaaaaactaaccttctttacacattctttctaccttattacctctatatatcttcacctttaatttaaaaaaattgtccctatttttacaatttttttatctcataaattccttttctttcaaaaattttttttttttctttttatcctaattttttcctttttctttacatcttttttgatcataaattaatattccttcctatcatttcttcaacctctttttttaatttatttttctcttatcttttcatttttcttttttttttttttt

SEQ ID NO: 56182 - DNA, 210 bp, Zea mays
  Clone ID: LIB3068-019-Q1-K1-A10
tctagatcttctcatcataccgataccggcctcaacgccctctctttcccagcctcacggccagttcctgtttcagtcgatcgcagttagcatggccgctacacagagctgtcaggctgctgcttgcttccctgccgtcgtggctgtcgacgaggagcacggccaccacagccaccagctgaagggaggagcgcatgatgaggctgagaa

SEQ ID NO: 56183 - DNA, 194 bp, Zea mays
  Clone ID: LIB3068-018-Q1-K1-F5
ggagccctgcctctctggtctctgccatatgggtttgtacggttccattcatgtcactactgttccaccacctagctcgtgctcgctctcaaggctatatccagcggtcttcgtattctacctccgactctgtatttcaaataccattttataaataatgcagtctacagtgtaaaacagtgatttacacgacc

SEQ ID NO: 56184 - DNA, 230 bp, Zea mays
  unsure at all n locations
  Clone ID: LIB3068-019-Q1-K1-A12
gtcgagccgcgcgtncggcgccgaccacccgtccaacgacttcttccggtcggtccccaactgcctgacatacaagaggctggatgacttcgtcgcgcagagtgaangaagccatggcacgcgacccgcagcccctgaccccggagcagcggtacatcctgtcgtgggatgcctgcacccagctggtcatggagcactccgagctcgacaaggtcctgaatggcgacagc

SEQ ID NO: 56185 - DNA, 332 bp, Zea mays
  Clone ID: LIB3068-019-Q1-K1-A2
cttaattgaccgtgtagacattacgaactggattcgcaacatagagcagcacgcatctgataaggtcaacaagatcttggtgggcaacaaggtcgatatggatgcgaagcgggtggtctccacagctcaaggtcagaagctcgcagatgaatacgggatcaagtttttcgagacgagtgcgaaaacgaaccgaaatgtggagcaggtattcttcgccatggcaagggacgtgaagcaaaggctcaccgagaccgttgccgctgcggctgatcccccgaccattcagattagcaggccagaccccgaccaggctgacgcaaccttctcgcggc

SEQ ID NO: 56186 - DNA, 129 bp, Zea mays
  Clone ID: LIB3068-019-Q1-K1-A3
cccacgcgtccgcggacgcattgacggccgcgtactacgcatataacttcactcaccgggtcgtgcttacataaccgcgagggacaacaagatccatattcaagctacacagaacgtctccacagctca

SEQ ID NO: 56187 - DNA, 385 bp, Zea mays
  Clone ID: LIB3068-019-Q1-K1-A6
cccacgcgtccgcccacgcgtccgcccacgcgtccgcacagctcaccgcagctcaggaggcagctcaggcaaaccctggtcatggcctcctccaagatgctgcgcgccgtcgtcgtcgtcgcggacgtcgccgtgtcctccttcgccggcgccgctcctcgccgtcgaggcccccgcgccgagccctgcctccggcgccgcggccctcccctcgtcgctcttggccgccgacctctgcccggccgtcgcgctcctcctcggcaacctgcgccactgatgacgcctgcctgtctcctagaccgactagagccgccgtgtgctgtcgcgtgatgttattgtcctctgtatgtgtgtgtgtgtgttcctgacctgtgcgtgccttgta

SEQ ID NO: 56188 - DNA, 308 bp, Zea mays
  Clone ID: LIB3068-019-Q1-K1-A7
cccacgcgtccgcccacgcgtgcgcccacgcgtccgcacaggcgtccgcacatgggtagggggctcaggctatgcctaggccatgtccttgtccaagatgctgcacgtcgcctgccatggaggggtagtctcacggcctgaattcgcggaggcgccgtcgacggcaaggccgccacatctagcccgatcgcctgcgcactactgctgccgtagacgttcttggccgctgccatctgtgcgggcgccccgctactcctcggtaacctgagccagtgatgacgcatgcctgtcttctagaccgacgagag

SEQ ID NO: 56189 - DNA, 190 bp, Zea mays; identical to SEQ ID NO: 54914
  Clone ID: LIB3068-018-Q1-K1-D1

SEQ ID NO: 56190 - DNA, 377 bp, Zea mays
  Clone ID: LIB3068-018-Q1-K1-D10
cccactcgtccgcccacgcgtccgtcgcattccacccgcccccttttcgcgtgaagtcgcgtgcgccgcggatcctgccgtcacgaatggaggcgtggccggacgatttccgctgccccatcacgctggaggtcatgactgacccggtcatcctcccctccggccacaccttcgagcgccgcatcatccagagctggctcgacggggggcacctcacctgccccgtcaccaacctcccgctgccgccctccccgccgctcatccccaaccacgcgctgcgccgcctcatagccgtcgtctcgccttccgcggcggcgtctctcgtccctgctgagggaggggctcacgcgaggcaagaagcggtgtcggcggctgct

SEQ ID NO: 56191 - DNA, 215 bp, Zea mays
  Clone ID: LIB3068-018-Q1-K1-D11
cccactcttcctcccacgcgtccttcaattcataatctcacaaaatgaccgtcagcgaaagcctatcagcatctctggctttaatcaatcattcgttcaccctgttctctatcgtactaactcttctcaatacattcaataatcatactatacatgatctatctcttacattatcacacatgatcaacatcatacatctctacaaactccttttg

SEQ ID NO: 56192 - DNA, 171 bp, Zea mays
  Clone ID: LIB3068-018-Q1-K1-D12
cacggacccttggggcgctaactccctaaccttaatctttttctttctctatcaaataccccttttgctatctattattcttacttacaagcgttcattcataaatcatcacactttatcttcattccacttacttttcaaccaatctcgattaccaattctgtgaatcaa

SEQ ID NO: 56193 - DNA, 425 bp, Zea mays
  Clone ID: LIB3068-018-Q1-K1-D2
ggagagggagggtttcctcaaagagaacctgaacccaaacccaagcagagaacactagcgtggcctcaccagggcgggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacaacgagctcgtggccgcgctgcccggcgacgactgccgctacgccgtcttcgacttcgacttcgtcactgttgacaactgccagaagagcaagatcttcttcatcgcctggtcaccggcggcgtcgaggatcagggccaagatcctgtacgcgacatcg

SEQ ID NO: 56194 - DNA, 143 bp, Zea mays
  Clone ID: LIB3068-018-Q1-K1-D3
cccacgcgtgcgtccactcatactggaccttgtccctcaccatagcatatatcactcacggagccttaacattcaggatgttgaacaacaacatcatctccattgcctacatcattggtacaggcatgattaccgtaaaggat

SEQ ID NO: 56195 - DNA, 164 bp, Zea mays
  Clone ID: LIB3068-018-Q1-K1-D4
cccacgcgtgcgtccacccatatcggaccttctcgctcacccactcataccaaacttacggggcctgaccatttctcacgtccatcccatcttccatctacacttcatgcaacattattacacttgcgatcaacgtctaccacttataccacacctctttcatc

SEQ ID NO: 56196 - DNA, 311 bp, Zea mays
  Clone ID: LIB3068-018-Q1-K1-D6
acgcccacgcgttcgacggcgcccttttttttttttttttttttttttttttttttttttggttgttttttttttttggttgagttttttttttttttttttttttttttttattttttttttttttttattttttttttttttttttattttttttttatttatatatttttttttattttataaaaaatgttgatgtacattaaataataaaaatttaacaccactctatttaaaaaataatatattttttataaagatacaaaaaaataatttacttgctattttataaaaattgttaataataaaaa

SEQ ID NO: 56197 - DNA, 420 bp, Zea mays
  Clone ID: LIB3068-018-Q1-K1-E1
cctaaaggtgctgttcccgggcctgctggccaacgtggccagcggcggctagaagctccaggagcggctggtggccgaggtccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccacgtgaggaagggcgagatgctgatcggctaccatccgtgcgccaccaaggacccacgcgtgttcggcgacaccgtcggtgacttcgagcccgaccgctttctcggcaggagggcaccaagctgctgcagtacgtgtactggtccaacggccgtgagaccgagaacccc

SEQ ID NO: 56198 - DNA, 327 bp, Zea mays
  Clone ID: LIB3068-018-Q1-K1-E10
tcgcccacgcgtccgcccacgcgtccgtccactcgttcggtagatcgaagcagcagcgtgtcaggagacaccgagtgccatgagagatgcaacgccgtggacggggcggagagcttaagtacgcagcgcgtgggccaaccaaagcctcagaggtgcactcaaactcatctgcaagcccggggggagaagcaaaatgggacctcgcgaacctgaaaagatcctgaagacaccgggcatcaactgatcatcttgtttgtagatcgtagtaatgtgccttgctactgcacctcaaccaaaattttaagagctcaattgctagttacagtg

SEQ ID NO: 56199 - DNA, 370 bp, Zea mays
  Clone ID: LIB3068-018-Q1-K1-E12
tcacactaggatggatctcacatgcagtcataatctgctatactaccttcgagtagggacaatatcaatgcctggatagaccagaaatcataacacgctactaaccaagcagtaacaacaagaaccattagcaagcaagcattatgacttaaatggactaacacataaccaagtcacacatcatgctcacatcctctttactgataacaaatcaccactaccaatcgggtgcatcaactacaaccttccacgcacgtacaatcactatcgcgttacaaacaatcagtatcctaaacctaacctttcgaaccactttctaaacccaattcacacagcttatcgacgcttaaacaatcaaacacttcgacaa

SEQ ID NO: 56200 - DNA, 255 bp, Zea mays
  Clone ID: LIB3068-018-Q1-K1-E2
cccaagcgtgcgaaaactcgtactagaccttaactctgatatcttcagataaaacttatggggccttataaatctaaaggtagatccattatatgatctaaactgattatctgataattttagttgagatgatagtatagtaaatgtaccatactctggttttactataaatatacttcaatacttacatacatttaaattttcaaaacgactataacgaactacaccatccatagtgacaactcatactactac

SEQ ID NO: 56201 - DNA, 453 bp, Zea mays
  Clone ID: LIB3068-018-Q1-K1-E6
ggagatatcacgggagctttatgagttttgcctggaccagagctatgcagatcgtaagctgatcgcaaagtggagaaagccaggatacgagcgcctttgctgcctccggtgcatacagacacgtgaccacaactttgcaacgacttgtgtctgccgagtccccaagcatctgagggaggagcaagtgatagaatgtgtccattgcggctgcaggggttgtgccagcggtgactaatcttgtcagttgtcatcatgttgttgggctcacgactcatcatcaccatcctaaccacattaaggcttttcggttagctctcaatccatgtggattgagtaggattggatgagtttgaatcccaaacaagtcaaactttttaagaatttttttcaatctcatccaatccatgtgtattgggaataaccgaacaaggccttagatgtctcgtgagcatg

SEQ ID NO: 56202 - DNA, 435 bp, Zea mays
  Clone ID: LIB3068-018-Q1-K1-F1
gaccacaacacgaagaagcgtactcgtcgccggaaggaaaggcgcggagcaagatgtcgtgggaggcgtacgtcgacgagcacgtgatgtgcgagatcgaaggacagcatctcagcgccgtcgccatcgtcggtcacgacggcagcgtttgggcgcagtccgagagcttccccgagttaaagcctgacgaggttgctggtatcataaaggactttgatgaacctggtactcttgcaccaactggtcttttcgttggaggtacaaagtacatggtgatccaaggtgaacctggagttgtcatccgaggaaagaagggcactgcgggcattactatcaagaaaaccggcatgtccttgattattggtgtctacgacgagccaatgacttcaaggcaatgcaacgatgtggtggagaggctcggcgattacctgatcg

SEQ ID NO: 56203 - DNA, 443 bp, Zea mays
  Clone ID: LIB3068-018-Q1-K1-F10
atcctgttcaaggtcgacgacctcttcatccgctccttcaagcgctacgccgacctgccggacccgagctccaggcccatgacgctgcacgccacgctgtgggacggcagctactgggccaccgagaagggcagggtcggcatcgactggtccgacgcgcccttcgtcgtctcctaccgcagctactacgccagcgcctgcgtcagcggcggcgcgtcccgggcagccggcagcggcgggtggatgaacaggcagcttgacagcgccgagtggggcaccgtcaggtgggcggagcgcaacttcatgcgctacaactactgccaggatgggtggaggttcccgcaaggcctccccgccgagtgcgcccgccactgatatgcgtccgccggttaattcttcgtcgatccagcttggcgtcgtttgttctttgttttgttgggtat

SEQ ID NO: 56204 - DNA, 416 bp, Zea mays
  Clone ID: LIB3068-018-Q1-K1-F11
atcctgctcaaggtcgacgaccttttaatacgctacttcaagcgctacgcctacgtgccggaccggagctacaggcccatgacgctggacgccacgctgtgggacggaaggtactgcgcacaccgagaagggcatggtaggcatcatactggtccgacgcgcccttcgtcgtctcctaccgcagctactacgccagcgcctgcgttagcggcggagcgtgccgtgcagccggcagcggcggctggatgaacaggcagcttgacagtgccgagtggggcaccgtcaggtgggcggagcgcaacttcatgcgctacaactactgccaggatgggtggaggttaccgcaagggctgcccgcccagtgagcacgacactgatatgcgttagtcggctaactagttcgagatccagattgt

SEQ ID NO: 56205 - DNA, 202 bp, Zea mays
  Clone ID: LIB3068-018-Q1-K1-C8
ggcattgtaagtggcagagtggccttgctgccacgatccactgagatccagccccgcgtcggacggattcgtctgcaaaggattcagcacgccgcccgttgggaagggagcttcgaggcggcccgccgcggtgcgtccgccgggcgggctgagccaatggcacgggcccttggggcgcgaacgccctaactctagatcgcga

SEQ ID NO: 56206 - DNA, 318 bp, Zea mays
  Clone ID: LIB3068-018-Q1-K1-F12
aacataaaaaaggtaagaaaacctattcaataaaaaaataaagcactacaaacaacggggacggaccctaatctccagtggccatgaccctagatcgccatacatgtgcgactgacatctactagatccaccatacaagtgaatcgctctgcatcatactggtccgacccgctctattctcgtctactaccgcatatactacgccagcgcctgcattatccgcggcgctttccaagcagtcggcatctgcccgcggatgaacaagcaacttgacagttccaagtgtggcaccgtccgatggaactgttctcaacttta

SEQ ID NO: 56207 - DNA, 334 bp, Zea mays
  Clone ID: LIB3068-018-Q1-K1-F2
cccacgcgtccggaacgactcactgcacgatccatcaatccgatcgatctgtcttgttcgtggagaggccaaacgtgtgcgatgggtaattatataagacgtgctcttcttcagatcatggtgaattgaaagactgccaaattaaggccacttgtgttgctttgattgtacggagagatcatgctgacgtgtacgtacgtgtaccgagatccgtttcaaatgcatgctttgattgtacagagagtggctcgtttggcatatagctccgctacatgattctctaatagggtaattccgtgtgattctctaacaaaagtgaatctgctatttgatg

SEQ ID NO: 56208 - DNA, 458 bp, Zea mays
  Clone ID: LIB3068-018-Q1-K1-F4
ggcggatcgggagcgggagagaccactcccaaatcgcgtcgcgtcgcgtcgagagcgagagcggaagatgtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggtcaccgtcgccaagtgctacatgctgtccgccaggaagctgaccatcatatg

SEQ ID NO: 56209 - DNA, 329 bp, Zea mays
  Clone ID: LIB3068-018-Q1-K1-A1
atcatcttctccgatccatcaacaatcgccgagagcgatcgagagataaataaagatgaagaaagtggcatcattgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgaaggcaggaaggggatggacctggtggtgtgcaaggagtcctgcgacctctcacagcgctccaacctggtgctgtacggccggatccagtgcaagggcaagtgcaccgagcagaagggca

SEQ ID NO: 56210 - DNA, 282 bp, Zea mays
  Clone ID: LIB3068-018-Q1-K1-A11
aattcgaccgtctacccactctcccactcccactcttccccctattctatatctcttcccaaacttctatatcatccaaagtcactttctcatacttaactcctcataaatcttctatattattacctaaatccaactcactctacctcaactttcaccctacccacttcaaaatccacaactcttcctaactaattcgcccaataccatatactctcttctaccgctatccttataaatcattactcctaacctatccccctttcaaacaaccatacaccc

SEQ ID NO: 56211 - DNA, 193 bp, Zea mays
  Clone ID: LIB3068-018-Q1-K1-A12
acggactcactcaagccctacctccatctatgactacgatccctctagacgataaaacgttccggtctcacgcatgcctcgtgctaatattcctatactttctgctacattctcaacacataaattcctacaacagccccgtctctcgacactaccatactgatcaccaactatctagcacttatgacccata

SEQ ID NO: 56212 - DNA, 453 bp, Zea mays
  unsure at all n locations
  Clone ID: LIB3068-018-Q1-K1-A2
ggttaaaccatgggtgaagacaagccttgcccctgcatcaggagttgtcacgaagtacttgcttgagagtggtcttcaagaatacctcaaccagcaaggattccatatcgttggctatggctgtaccacttgcattggaaactctggtgatctcgatgaatccgtatcaactgccattacacaaaatgatgttggtgctgctgctgctatgtcaggtaaccgtaacttctagggtcgtgtgcaccctttaactagggctaactatcttgcttcaccacctcttgctgtcgcttatgcacttgctggaactgctgatattgattgtgagaaagagcccattggatttggaaaggatggcaatgaactctacttcatggatatatggccctcgacagatgacattgcgcaagttgaccaatccagtgtgctgnctgacatgttcaatggcaccta

SEQ ID NO: 56213 - DNA, 252 bp, Zea mays
  unsure at all n locations
  Clone ID: LIB3068-018-Q1-K1-A3
ccaagcccgacggagacggcgacggcgcggcgagcaggcggcgggcgggctgaagcgactggtgggcgagaccaaggacgcgcacggcgtgaagcaggtgtacgtgtggcacgccatggccgggtactggggcggcgtgacgtcgacngccgggacggccattgaacgctacgagccggcgctggcctaccccgtgcaatccccgggcgtgacgggcaaccagccggacatcggcatggactcgctgtccgt

SEQ ID NO: 56214 - DNA, 454 bp, Zea mays
  Clone ID: LIB3068-018-Q1-K1-A5
cccacgcgtccgcggacgcgtgggctgacgcgtgggcgcgtagccaaggtcaccggggggggggccaacaagctgtgcgggatctaagttgtgcgcacctccatcgcgcgcgtgctgaccgtcatctcgcagaagcagaagtcggcgctgcgtgagagcgtacaagaagaagaagctgctcccgctcgacctgcgtcccaagaagacccgcgccatccgcacgcgcctcaccaagcaccagctctccttgaagaccgatagggaaaagaagcgtgagaagtatttccccatgatgaagtacgttatcaaggcctatatcagtgaaagaacatttatcctgtcaagttttgctcaaaagctacttgaatttgatacaaacctatctccatccaagtactatgtagatgatcaactgcatgattaacaacgagtacttttggctaaaaaataaaaa

SEQ ID NO: 56215 - DNA, 456 bp, Zea mays
  unsure at all n locations
  Clone ID: LIB3068-018-Q1-K1-A8
ccggagaattcctcccttgccccgccgtcgcatcctcttcgaagttcgaatcgaatcgcgccgcgatcacccacctcatggcggacaaggagcctgtcgtggagcggccagaggcgggtgaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccggcaaggtccgcctagtcatgcgccaggctaaaacgcttaagatctgcgcgaaccacctcgtggccttcaccacgaagatgcangagcatgncggcagcgacaagtcgtgtg

SEQ ID NO: 56216 - DNA, 384 bp, Zea mays
  Clone ID: LIB3068-018-Q1-K1-B12
gccgctcttgagtcctgccccaattatgacgatgatccccttatcctacttcaggggcctatctgccgaccacctgctgctcatcttctactctttcctgctgacaactcatgtcataaatatcaacacgaggaccgcctgactagctaacaaactgatgattaacgagcaagcttgaagagccagaatcagcgaggaggcgcggtacgtgccggtgcgcaagttgctgtaccagtccatgactcctgctacagctatgagctctacgacagcagaggcactgactgaagctgcatcgtacgagccgtacgaggtgagccacgcgtgcctgtgctgctcgccgtcgtcgtcgtcgatcaacggcagcagcagctgcgtatacac

SEQ ID NO: 56217 - DNA, 453 bp, Zea mays
  unsure at all n locations
  Clone ID: LIB3068-018-Q1-K1-B3
agttgcgtgatgtcaaggtgcaaaacatcgagacaggcaaggttcattctgtactccatatagaatatcctgattggcccgaccatggagtggcaactaatacagatgctgtacgggaaatctggaaacgactgcatcacattccaacggaacatcctatagttatccattgcagtgcaggaatcggaaggactggtacttacatcacaatccatactacaattgagcgaattcttcttggagataaaagctcttacgatcttgccaaaactgtaaagaattttagatcccaacgacctgngatggtccaaacagaggaacaatacaagttctgctacagggcaattgctgacgagctgaaagacctgctaaattcagatcattgaggtgggtcacatgagacggacagcaacgctgntagcatttattacgttnttttagacatttctatgt

SEQ ID NO: 56218 - DNA, 313 bp, Zea mays
  Clone ID: LIB3068-018-Q1-K1-B4
accacgcttacgacaacgcgcacaacatcgattcatacatatctcattctatactccatagagcctgatctctttgaccggacgatcaagattcaacttatgccgatgctatcctggataactcacaactacagcttcacattacaaccaaacatactatagtcatccattatacttcacgaattgtaaacactcaaacttacatcacaatcaatactaaaatcaacccaattattaaagataatacaagctctgactatctctccaaaactgtacagaattttcaactccaactacctaacatagaacaaac

SEQ ID NO: 56219 - DNA, 173 bp, Zea mays
  Clone ID: LIB3068-018-Q1-K1-B5
ctaagccctcatacactcaagctgtttacgtttagatccattttccctttcaaatgcgaatggtgtgtctcgtactctcggtgtgaagaaaagacgcgtgccttttcttctcgctgcaagttttcccttaccaaggttttgtgcatggaatggactgtatattattaatcata

SEQ ID NO: 56220 - DNA, 377 bp, Zea mays
  Clone ID: LIB3068-018-Q1-K1-B6
cccacgcgtccgtccacgcgtccgcccacgcgtcctctcacgcgtccgcacagcttggagcacctgcaagacattgagaaccagccagccaaccaaccaaccggcggagccaaagccaagaaggaaggcaacttgtccgtccagtcaggatgtgcaactgcaacgtcaagtccgcgggcgtggcccagatcgacggccgtccggtgctgcagccggcggacaaccgcgtggcggcatcagagcctgacgcctaccaaccgctgaataagtcccttcagaagtcactctccatgccggcctactacgacagcaatgcctccgcaggcgctcgacctgcgccagacgagaacactacccgtacagcggctaattcgtct

SEQ ID NO: 56221 - DNA, 313 bp, Zea mays
  Clone ID: LIB3068-018-Q1-K1-B8
aaaaaaaaaaaaaaataaaaaaaaaaaataattaacataaaaaaaaaacatacaaaaagggagtgaaaaaaataaagggacgagaaaaaaaaaaaaaaataacaatataattacaatcatatctaatccttctatttcttttccttttatccattattatttttctttatccttatttctacccttttttttattttccttctctttaaattctctttcttttttctttctccatctctttctccttctaatccttctcctttcaaattatttttctttttcttttttgtatttcttctcatcttttcttttt

SEQ ID NO: 56222 - DNA, 101 bp, Zea mays
  Clone ID: LIB3068-018-Q1-K1-C12
acaaatatccaaatccccaactctacagtcctttttccctccagcctgccactaaccttttcctactcaatcatcccaactctacttataaattacaacac

SEQ ID NO: 56223 - DNA, 458 bp, Zea mays
  Clone ID: LIB3068-018-Q1-K1-C3
cctgacaagaagtctgataacaagatgccaatgactcctagacgaaaatcaccagtggaccagaaggtgccacctaaagatgatagccagaaagctgctaggaagagcaccccaagtgctccctcagatgacgctgacaaagcagctaagaagcatattcctactgtaaagagaacatctggggtcttaggaaactcgaatgttataaatctagtgaagattcctcccaaccgcaaaaaactaacagatattagcacttcatggacatcactccctccatcacttgccaaactaggaaaggagcttcttaagtacagggaatcggcacaaatagctgctgctgaagccatgcaagaagcttccgctgcagagagcttgctcagatgtttgagctcgtacgcggaggtgagctccacggcggatgagcacaacccgcagccagccgtagagaagttctt

SEQ ID NO: 56224 - DNA, 318 bp, Zea mays
  Clone ID: LIB3068-017-Q1-K1-H9
atttgcatatatatatgttttaaagttatattattctctgctagatgaaatatttgtgtggaacaaattcatatgatattttggttgtgatgtgtaatattctatgacgatatgaatgcatatgatgtgttcgttgcaaaaaaaaaaaaaaaaaaaaaaaaaaaaaaaaaaaaaaaaaaaaaaaaaaaaaaaaaaaaaaaataaaataaacaaacaaactaaaaaagggctgtcgttttaaagcttcctagtttaattcactgtcattcgatatacaacttcttgaatgggtaaacctatgtcaaatccgcatgtcaa

SEQ ID NO: 56225 - DNA, 461 bp, Zea mays
  Clone ID: LIB3068-018-Q1-K1-C4
cccacgcgtccgcccacgcgtccgatgaagtgcttaagatatctgttcctcgaaattatggagctggaaaacttgaagtgtatgaccatgatatgttctcagccgatgatatcatgggtgaagcagagatagatctccagccaatgatcacagccgccatggcctttggagatacttcacgtcttggtgacatgcaaattgggaggtggttcatgaccaaagacaacgccctgatgaaagatagcacggtgaatgttgtggcaggtaaggtaaaacaggaggtgcacttaaagctacagaacgtagaatcaggtgagttggagttggagctagaatgggttccgatcctctagactaatgataactcccctgatctttgtctaaaaatctatactcaagatgcatcgatgtttccaagctgtccacttgatggtcttggacatttttgctggatggtttga

SEQ ID NO: 56226 - DNA, 99 bp, Zea mays
  Clone ID: LIB3068-018-Q1-K1-C5
tcgcttattccaaggtcatctctttcctcttactgcccttgtactattaatagaagactcgggtgtggcaattatatgggagtgggccaaaatttattc

SEQ ID NO: 56227 - DNA, 398 bp, Zea mays
  Clone ID: LIB3068-018-Q1-K1-C6
cctcgctcaggggagcggaggagacgcctggcctcgtccacctcacgcacatgacggacctgcagtcggtctaccacctgcggatcggcttcgcctccgtggcgtccagaccgtctgccaccagcgccatgtggtggtacatgtgggtgctgtggcccgtggcgtggctgtccatggcgctcgcgtgggcctacgggtcctccgcgttcgtcgtcgagaggatcaaactcgggaagctgaggatgcaaacgtgggcagtgccaagatacaacttccagtacggcctgagctgggagagagaatcgatcaacggcctcatcgaaagggcgatactagatgctgatgcgagaggtgtcaaggtgctcagcctaggactgctaaaccaggcgaaacagctg

SEQ ID NO: 56228 - DNA, 289 bp, Zea mays
  Clone ID: LIB3068-018-Q1-K1-C7
caacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaataaaaggtctcgtctgtactattgtattgtaccatggatcatatcgtacatgttgtgtcaatgcaaagaggcacgtttgagttaccatt

SEQ ID NO: 56229 - DNA, 302 bp, Zea mays
  Clone ID: LIB3068-019-Q1-K1-H5
gcggcataccggcctggttcggagacctgaccagcctacggtcgctggtccgcgggcaggaccagctgaccggcaggatgcccgacgatctgctgcagggacagttccgggcggtagcactgtcgtccaaacagctgacggtcccaaccccgctcgactacgctctcgacgagatcaactctgtagacctctcccacagctagctgacgggcgaccgctcctaccagttcgacgtcgggcggaccagtactcatggacgacctgtcgtgtaactacctggactttgacctgatccatctggt

SEQ ID NO: 56230 - DNA, 457 bp, Zea mays
  Clone ID: LIB3068-019-Q1-K1-H6
cccacgcgtccgcggacgcgtggagccgttgaaaccagtggacgagtcacaaggctactgcacgagacagcaactgcgtgaacttgccatgttgaattcgccactccgagaggagagtccacgttcaggcggtgctcctacaagttccttcagtaagactgtctccggtaggcctaataaaacaggggacacagaattgtagatgacactgtttatcactggttgaagagagaagtttgaaatacgggatctactggagatagcctaactgcggcatgaaaagagtgaaacaatgacacccattcctccatcatgatccttcggcaaccccacttagtccatgccttcacatcctattttccatgagcaaagctttcatgatggtgttggtagtgtgtgacatccttttaagtactagcaagtgaattttgaacctccattccatgtggcattaacc

SEQ ID NO: 56231 - DNA, 330 bp, Zea mays
  Clone ID: LIB3068-019-Q1-K1-H8
gcacgccgcccgttgcgcagggagcaccgaggcaggccggctcctctcgtcggcggtggggcctaagccaatgtcaccggccctcggggctcgaacgccctaacgcggatcagatcactctgccagcagacgcgcccggtgctagcttgcattctgacttagacgcgtgcagtcataatccggctcacgatatcttaacgccactggcttttcaaccaagcgcgataaccaactgtgtgaatcaacggctcctctcgtactaagctgaattactatgtgcaagcggtcatcacatgggacctaccaacctgtctgacgacaagtgtaaac

SEQ ID NO: 56232 - DNA, 53 bp, Zea mays
  Clone ID: LIB3068-019-Q1-K1-H9
aaaaaaacaaaatacccaaaaataaaaaagggttactataaccggaaaaacaa

SEQ ID NO: 56233 - DNA, 360 bp, Zea mays
  Clone ID: LIB3068-020-Q1-K1-A1
agggcatctaatcatgcaggtagcaacatgtcttctgacaaccagtctcatcaagcctccgggtcagttggtgctgcaggttctcatgatggtggtaatgtccaaggacaagatccggaacgatctacccctgaaggtggcacaaataccaagcatgatcaaggtcaacaaagttctacaggtgctgaaggcttacaagttcccgcttagacctaatagcggacattggtgggttaacttctggaaaaagtgcatttgatgctgcaaaagacattatggaagctcttatgatcaaacatacttatttagccaatgagcttgagcttttaactggctaaattggatcacggtttggtactt

SEQ ID NO: 56234 - DNA, 369 bp, Zea mays
  Clone ID: LIB3068-020-Q1-K1-A10
cccacgcgtccgcccacgcgtccggtcattcgtccgacctcgcgttcgtgcacactactagggactcatataatctggcgcatgctaacatcatatgcatggctagtcatactgaaaatgatcatgaggacgagatcaatcccgctcatgagctcttgcttgatcactccatgaaagagaaagacactgaccgaacagactactacggtctataccttgaaaaccagtgccgatttgctctgcaagtcatcgaagctgtcggctatgagatggacgccaacatatacaggattaagctatatgcattggcataatattcaaaggctggacactatgatccaaaagaattggcgctctacatgaggaatg

SEQ ID NO: 56235 - DNA, 445 bp, Zea mays
  Clone ID: LIB3068-020-Q1-K1-A11
cccacgcgtccgtccacgcgttcggtaatttcccccaccttttgctcctgccaaatactaaggggtcaaataccctgccaaatactaacatcatatccatggctgtgcaaattgtacgttttgatggggttgagatccatggggctcatggctacctgcttgagcaatttatgaaagataaagcgaatgaccgaacagacgaatatggtggatcccttgagaaccgctgccgatttgctttggaagttgttgaagctgttgttaatgacataggggcggacagagttggaattaggctatcgccattcgcagaatattcagagtctggagactctaatccaaaagaattggtgctttacatgatgaatgccctcaataagtatggtattctttactgtcacatgggggaaccaagaatgaagactcgtggagaaaaaactgaatg

SEQ ID NO: 56236 - DNA, 196 bp, Zea mays
  Clone ID: LIB3068-020-Q1-K1-A12
cccacgcgtccgcccacgcgtccgaaaaaaaatatcaccttataataaataccaaaatctaagggagcaaatacactaaacacatacataacatcatatccactgatatacataattgcaagttttgaatactgtttagatccatggatctcatgtctctcctacttgagctctttatgaaaaataaatcctctga

SEQ ID NO: 56237 - DNA, 454 bp, Zea mays
  unsure at all n locations
  Clone ID: LIB3068-020-Q1-K1-A2
cttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatcttctgtgttggaatcatttgttatcgtggtctgtactttgagctctatgattncatcaagccaagttgtcttactggcaacctt

SEQ ID NO: 56238 - DNA, 376 bp, Zea mays
  Clone ID: LIB3068-020-Q1-K1-A3
cccacgcgtccgcggacgcgtgggttttttttttgagaaaaagtctggacatataggtaaaagcacaaggagggcaaacagaaacaccggcggctgtcaaaaagccaggcgttcactccgatgagcctatgaccagccgaagacatagtcgaggatgtagacgatgatgagcgagagcgggtagagcatgtaggcgacgaggcaggtccagagcgggaacgtggtccggaagctggtgaagagggccatgacgacgcagaccagcaggatgatgagcaccttcgacgagaagtcccacgtcaggttcctgaagtagatgagcgccatgaacactccgaggcacagcgtgttgttcatcgtcacgccgacgtacacc

SEQ ID NO: 56239 - DNA, 236 bp, Zea mays
  Clone ID: LIB3068-020-Q1-K1-A4
tcgcccacgcgtccgcccacgcgtccgaaaaaattaaaaaaaaaaataataaatataaatgagagggaaaaataaaaaaaataaaaaaacactataaaaatacaagacattactgtatctattactatctatattaatatgctcatccttttaaatatttaattttttttaccgttattttttaatatttaccttttcttttatgtcactatattttaacttattaatcatttttt

SEQ ID NO: 56240 - DNA, 394 bp, Zea mays
  Clone ID: LIB3068-020-Q1-K1-A5
agggcatctaatcatgcaggtagtaacatgacttctgacaaccagtctcatcaagcctcccaatcagttggtgctgcaggttctcatgatggtggtaatgtccaaggacaagatccggaacgatctacccctgaaggtggcacaaataccagccatgatcaaggtcaacagagttctacaggtgctgagggctcacaagttccgcttagacgtaatagcggacatgggtgggtaacttctgcagcaagtgcatttgatgctgcaaaagacataatggaagctcttagaagcaaacatactaatctagccaatgagcttgagcttttactgtcagaaattggatcacggtttgttactctgcctgaggaaagacttctagctgtggttaatgctc

SEQ ID NO: 56241 - DNA, 258 bp, Zea mays
  Clone ID: LIB3068-020-Q1-K1-A8
atgagatctaagcattcatgttagtgtccacctgagcatacttgatccaatggtacgacggaacaggaacgctgtgaccgagctctgtatgctacatatacgacatggccatggtcggaagcgctgttgtgtctgcgacctacacagaatttcggctggaaaaagcgcccgagatggacatatgacccaatctgagccctttcaggtgatgaaatctgcatacagtgggaatccatttgtcgtgggtactacactaga

SEQ ID NO: 56242 - DNA, 409 bp, Zea mays
  Clone ID: LIB3068-020-Q1-K1-A9
cccacgcgtccgtccacgcgttcggtaatttcccccaccttttgctcctgccaaatactaatgtttcaaataccctgccaaatactaacatcatatccatggctgtgcaaattgtaggttttgatggggttgagatccatggggctcatggctacctgcttgagcaatttatgaaagataaagtgaatgaccgaacagacgaatatggtggatcccttgagaaccgctgccgatttgctttggaagttgttgaagctgttgttaatgagataggggcggacagagttggaattaggctatcgccattcgcagaatattcagagtctggagactctaatccaaaagaattggggctttacatgatgaatgccctcaataagtatggtattctttactgtcacatggtgga

SEQ ID NO: 56243 - DNA, 439 bp, Zea mays
  Clone ID: LIB3068-020-Q1-K1-B10
cccacgcgtccgcacttgagtaggtaagaaattctggaacctctttcacttgcagcctatgcgtgatcagaagggtgatgttcaatacttcattggggttcaattggatggaactgagcgtgttcgagaggctgctgcaaaagatggtgccatactggtttgtttctaccttaatggcgactagcatatatgtgctattgtgcttgctatcacaagtacctagaaaaatgagaataaaatgccagataactttgtcatggctgctatattataaatgcaagccatccatagtgtagtgattgcaatgtttattaacatgtagtaccatctagtattctagtgtttattaacgatttatatctcttaagccctggtgattaacattggcttaatttgtgttttagtttgcataaggtgatttttgcaactaattttgcgt

SEQ ID NO: 56244 - DNA, 459 bp, Zea mays
  Clone ID: LIB3068-020-Q1-K1-B3
ccggctctccgccttcctcttccagtccccgcgcgcgagatcgccgccccgtgtgggcccgagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaacaactggcgagaagagtttctaattcaggctagcccatcagatcctgataatttcccttttgttctggtgggtaacaaagttgatgtagat

SEQ ID NO: 56245 - DNA, 326 bp, Zea mays
  Clone ID: LIB3068-019-Q1-K1-H4
cggacgcgtgggtaattctttcactgctgaaaagaaatggaggaattctaaggatacaggccctgctgatttatatgcaaagtttatgagcgcgctgtacaacttgcttgatggttcctctgacaacaccaaatttgaggatgactgccgagctattattgggactcaatcatatgtcctctttactttagataaactgatttataaagttgtgaagcagcttcaagctatagcaacagatgaaatggacaataagcttctgcaactatatttatatgaaaaatcaagatctcctgggaggttctttgacctagtttatcattgaa

SEQ ID NO: 56246 - DNA, 322 bp, Zea mays
  Clone ID: LIB3068-020-Q1-K1-B4
ccgactcttcggctgactcttgcaataaactcacgcgagatcgccgccccgtgtgggggcgagatcccgatggccgtagcgccgtcgtaccctgctcaaggacatcataactcgcgatagcgaggtagagaagacttacttgatgaaccaatatgtgaacaagaagttcagcattcaagacatggctacaatcgacacgtatttcctcaccaacgaagtgcaattcgaggacaggctcttcactctgcaaatatgggacactgctggccagtaaaggttccagagtctcggctcagcattctaccgacgagtacattgttga

SEQ ID NO: 56247 - DNA, 225 bp, Zea mays
  Clone ID: LIB3068-019-Q1-K1-E10
ccggaattaaatggtcgacccaagcggcccctatcgagctgaccatcagcaaatgaacgatcacggttgcagctcgatcatcgccaagcagcacgtgggcatatgctctagccttaggtagtagctagacactcggacgagtaatcatcagtctattgatcgtgacaaattgacactgccgaggttcagacacacaccgtcgtggcgaccgactgaagcccagtg

SEQ ID NO: 56248 - DNA, 213 bp, Zea mays
  Clone ID: LIB3068-019-Q1-K1-E11
gcgagggccgtcctttatttctatttttggatagccaagtggagagattacattatgaggtgggctctagatggacgctgggcagaacccaaactgcctttattcaacaatggtaggtaatgcagtttaacagtgcaggcacatgaggatccgatgtaattacgtcatctgcaagctccatccagatcacacgcactcggatcgcagttccaa

SEQ ID NO: 56249 - DNA, 303 bp, Zea mays
  Clone ID: LIB3068-019-Q1-K1-E2
cggacgcgtgggtgaaattgcattctgagtgttactccattttttgtgttactctacgggattgtactctgtggatccttgggcctaatgctgttcgaattgcgctgcattctggaatgtaaatacaacgaaacgtattcgtgtaaaatgaaattccaatagaataagaccggagtcttcatgtcccgttatggacggcctgctttaataaaaatactccgtctggcagctttaccatgactcactataaaaacgcctacgatcctgaagtaatcagaaaaacgaatttcctttttgggaaaa

SEQ ID NO: 56250 - DNA, 380 bp, Zea mays
  Clone ID: LIB3068-019-Q1-K1-E3
cccacgcgtgcgctaaagtggacgctgcgtgtcactacatgcgccgtgtgatactacgaggacgtactctgcggctacgaggaccgaatgctctactactagagctccatgaatgcctgctacatcatcataaactaatcgggcgagttcagctcccagtagaactagggctgaggatccatgttcggtcttgccgggggtgtcatcaaaaagatactccgaatggcatctgcatgattgctcactattgagccgcctactatatgcacctatctgatcatgagtgtcgagtctgtcaaaatgtatgtcgcctgggggaaaagaaatttaagttatatgaaatgaatatgctgttgatgtgtcaaaaaaaaatttacttt

SEQ ID NO: 56251 - DNA, 238 bp, Zea mays
  Clone ID: LIB3068-019-Q1-K1-E4
catcgatctgcaagtctcgctacgtagcagtgcaataaaaaaaagcagccgcaatggcgggcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctggaccttgggcccac

SEQ ID NO: 56252 - DNA, 415 bp, Zea mays
  Clone ID: LIB3068-019-Q1-K1-E7
gtcgaagcgaggtaggggaggttcggctgggaacaagttccgcatgtcactggggctacgggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcaaatgccatc

SEQ ID NO: 56253 - DNA, 364 bp, Zea mays
  Clone ID: LIB3068-019-Q1-K1-E8
cccacgcgtccgcccacgcgtccgagacagctagatagcctctgcatgcctacgtacaggatggccaaggccgagctgctcctcgccctcgtggcttcgctcgtcgtgctgccattctcctccctcgccgtgtaccaggacttctgcatcgccgacctatccgtcgccgccacgccgggcggctacccgtgcaaccccccgaaggacgtgaccgccgacgacttccactatggcggcctcgccacccccggcacggcgctgaaacccttcaagatctccctgggctcggccgtcgtcaccacgttccccggcctgaacgggctgggcatctctgccgcgcggatggtgatggtcccgggcggct

SEQ ID NO: 56254 - DNA, 204 bp, Zea mays
  Clone ID: LIB3068-019-Q1-K1-E9
cgcgttcttcgcctctcaccccacgggagggacgggaggcgagggcgcggcgagccggcgggcgcaatcggatttggggaggcaaaaggaaaattccggagagcagttcctttccggctccccatttcctccggatagatttgggtttgtcctgcgtcgattagtccggcgcccgaacccgcaccaatccattcgccgagggat

SEQ ID NO: 56255 - DNA, 247 bp, Zea mays
  Clone ID: LIB3068-019-Q1-K1-F10
ggtcctgaatattacatggtcggcccgcgcgtccgcggacgcgttggcggactcgtgggggcaaggttcgtggtttcacatttgacatcagctggggtgcgttggagtctctggagcttgactctgttgggctttctattgttccttctagcttggtatgcacgtactgtttatgtgtcgaagacgtgctggatatagtcttctatacagtcgtggtgcatgaagacgccgtctcacgggttcaacg

SEQ ID NO: 56256 - DNA, 390 bp, Zea mays
  Clone ID: LIB3068-019-Q1-K1-F12
cggacgcgtgggggagccccggcgaagccaccacgcacgcagcgatgtcggcgagcagcacgcgggtagacgctttgggggagccgatcccgacgtcgtcggtgctgatggcagcgtcgaagcacatcgcagtccggtgccgcccggagaacgtctgcttcctcaactgcaagaagaaggaccctaatcctgagaagtgcctcgagaagggtcgccaggacacaagctgcgttcttagcctgttgaaagaacttcatcaaaagtgtcccaaggaaatggatgaatatgctggttgcatgtattactacaccaacgatttcgacttctgccgtaaggagcagcaagctattgaggaatcctggcccattttcgagtagatcttgagagctt

SEQ ID NO: 56257 - DNA, 186 bp, Zea mays
  Clone ID: LIB3068-019-Q1-K1-F4
aaaaaaaatacaaaaaaaaaaaaaatagataaaaaacataaaaaaaaatccacatcactgggagggtgcccataggctgtagcgcgcatacgaactactacaatcattctatatagtctcctaaataaactacacagtgccatactttacaacaccctgactgggaaaaacctatacggacccaaa

SEQ ID NO: 56258 - DNA, 381 bp, Zea mays
  Clone ID: LIB3068-019-Q1-K1-F6
ggcgccggcgtgcttgtgatctcaacccaagtcgtgcctccgctccggtcaccggtgggtccacgcatccatgtcgaggaggaagaccagggagcccaaggaggagaacgtcacccttggacccactgtccgtgaaggagagtatgtctttggtgtcactcacatctttgcatccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaaacttcgtgcccaccgatgcaacaggac

SEQ ID NO: 56259 - DNA, 228 bp, Zea mays
  Clone ID: LIB3068-019-Q1-K1-F9
tcgacccgcgcgtccgcgaagctcaatcaattcactcaaacctcttcctcaaatcttcgattagattctcgttgggaaggggacttgaaccgaacctgaccatgtcgctgatccgccatagcaacgtgttcgatcccttctccttcgacctctgggacccctttgagggctttccctgcggctccggcagcagcagcagtctcttcccctcgttcccgcggaccagct

SEQ ID NO: 56260 - DNA, 295 bp, Zea mays
  Clone ID: LIB3068-019-Q1-K1-G10
acggtgatgtcaggaggcaatcaaatgatttcgcagggcgtaatgaaccatttgtatgatgtgatgtgtgaatttagtttctgccttccccctgattatgcgttgatgataagagctcttggttctctagaagggactgcaaaagcactggatcctgagtttaaagttattgatagtgcatatccttttgtaattgggagactccttgcataccccagccctgatatgaggaaaatattgcgggagcttcttatatgtgacgatggatccatcagatggaatcgactggaaaggc

SEQ ID NO: 56261 - DNA, 83 bp, Zea mays
  Clone ID: LIB3068-019-Q1-K1-G11
gggcgttcgcccacgcgtccgaaaaaaaaaaaaaaaaatgataaattaaaagagaaaaaaagaaaaaaggggagggtgtcaat

SEQ ID NO: 56262 - DNA, 76 bp, Zea mays
  Clone ID: LIB3068-019-Q1-K1-G12
cttcagttccgtcccgttcgtgacgacctgcgatccctggagggggagggtgaagtgtagggggaggcttgtcatg

SEQ ID NO: 56263 - DNA, 390 bp, Zea mays
  Clone ID: LIB3068-019-Q1-K1-G2
cccacgcgtccggcgagacgtacaggagccagggtggcgacgggaccgtgcactggtagtacgacaggcaagaggacctggaggcgtctgcgagggaggagctgctgcgggaggagctgctcgaggagattgagcagagggttgggggcctcagggagctggaggaagcgagcaaggaggagcaactcacaaagtgatcacgcgggcgaatgggatggatacgggctactcatcagctctctatctgagcttcgttagcaaataagttcagacttcttaatttactgccctgctcaagtctgtatatggccaaaacccaaaacgattgatcaactgcgctactgcaatgcaataacatgatacgtatagtttttttttttaagggaaaca

SEQ ID NO: 56264 - DNA, 243 bp, Zea mays
  unsure at all n locations
  Clone ID: LIB3068-019-Q1-K1-D9
cgcgccgtctgtatggggagatttcttcgtcacctatgccactcccgtctcacaggcatcagagcagcggatgagtgagagagcggagctgctcaaggcgcaagtacgtcaggcgttcgatgctgccagcatggatgttgcaagtctgatcacgtacgtcgacaccctcgaacgcctcggcttagacaaccacttncgcgacctcatcggagctgccctggaacgaattggaagctgaggagc

SEQ ID NO: 56265 - DNA, 100 bp, Zea mays
  Clone ID: LIB3068-019-Q1-K1-G3
cccacgcgtccgataaaaaaaacaatagtcttaatccaaaaatgcacacaaaaacaacaaggtaaatattcattgagtagaaaggacccatgcttaccta

SEQ ID NO: 56266 - DNA, 157 bp, Zea mays
  Clone ID: LIB3068-019-Q1-K1-G5
tcggacgcgtgggctgacacgtgggtccatattgtaattacggcacgtattcagtggcgacttttatcatgggagagcaggatatagttgcataaaaaaaaaaattatttaaatttaaaatattacaataaataattataactattataaaatataa

SEQ ID NO: 56267 - DNA, 271 bp, Zea mays
  Clone ID: LIB3068-019-Q1-K1-G8
attactacgggatcttacacacattcgtagtgctagggatgacctcaaaagaaaggtgttgggcttccggtcacccgctttatctgacatacatgagatccaagtttcttcgtctccattaagcaccaagaaggttgtgtactgcacttaaaggatctattgatggtactctgtttatggttgttcaggcaatgtggactcgggacttttggtttagcttctgataccttatgactgattggaaacaaagatgtatatcctctgtccaaaa

SEQ ID NO: 56268 - DNA, 111 bp, Zea mays
  Clone ID: LIB3068-019-Q1-K1-G9
tcccactcgtcctcccactcgtccggtcatttgtgtaaaaaaaaaaaaaaaaaaaaaaaaaaaaaagaaaataaaaaaaaaaaaaaaaaaaaaaaaaaaaaaaaataatat

SEQ ID NO: 56269 - DNA, 362 bp, Zea mays
  Clone ID: LIB3068-019-Q1-K1-H10
caccaaacgatctttcaaattggtgtagtggaaataacggaattggaacttgtttgatcgagtggcggatactcaatcaaactcataattgtctcaatggattcttttccttcttttttttttttttctgaatattcagttaagaccattcaaaggctccttttcgccatgcataaactaaaccaacaactaggataagcacaaaaatgaaagcttctataaaaacggatacacccaatacgtcgaaactcattgcccaagggtagagaaagactgttttcacatcaaaaacaacttatactatctcatacatgtaatagcgtattcagaattgtaaccaatccctctctatgggttctata

SEQ ID NO: 56270 - DNA, 328 bp, Zea mays
  Clone ID: LIB3068-019-Q1-K1-H2
ggcgcagagaatccccaagcaaacaaacagggtagagggagaggagaggagaggagaggagagggtgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcatgatggtgacttgtacctcttcgaatcacgagcaatctgcaagtacgctgctcgcaaaaacaagccatagct

SEQ ID NO: 56271 - DNA, 316 bp, Zea mays
  Clone ID: LIB3068-019-Q1-K1-H3
cccacgcgtccgcggacgcgtgggcggacgcgtggagaaatcctagactgaagttatgggcccggtcggtgatggaccgcttccttgtctgtaccatgttcgctggaagctagaggccgtacgccttctcgtccccgtcggcggttccgggccctttctcccgctgctccagctccgcttccaccacggtcgcgacagatagcactgggaggagctcgttctcccgtgcgccgactaagagccgaaagccaccgtttctgtccgccttggacgacacaaagtccgtacttcgcgatccgatatcacgcttcgacct

SEQ ID NO: 56272 - DNA, 347 bp, Zea mays
  Clone ID: LIB3068-019-Q1-K1-A9
gcggcagcttcgacccgctcggcctcgccgacgaccccgaggccttcgccgagctcaaggtcgaggagctcaagaacggccggctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgatggaggcgccgccggtgacctttaagtgtccggatgcatgtgagcgcacgctggttttcggcttgtaccatgatgtaaactattgttcaatcgacaaggaataattgcgttcattgtcat

SEQ ID NO: 56273 - DNA, 384 bp, Zea mays
  Clone ID: LIB3068-019-Q1-K1-B1
ctcgtctcggcgccctctgcatgcccgtccaagaagaccaccgtcgccaggttccggcgcggcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagctttcgtgccctctggtgtcgtcgacggaccccgtggactttaagccggaaagcaaggtgacgcgcattcggcagccggtgcatcttctgagcccggag

SEQ ID NO: 56274 - DNA, 158 bp, Zea mays
  Clone ID: LIB3068-019-Q1-K1-B2
ctttgttttcctaggggcgccacggattatcctgttcgcagctgaattttttcttgttggttttgctgttttcgctatctgtattgtagtcactgtgcaaaaaaaatcgttttgattgattggctgcaaaaagtgaagtgcgctattgcgctgtgact

SEQ ID NO: 56275 - DNA, 437 bp, Zea mays
  Clone ID: LIB3068-019-Q1-K1-B5
gcaaggcagtgaacgtgccgtcgtctctcttcggcgaggcccgcgtgacgatgcgcaaggcggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcggcatc

SEQ ID NO: 56276 - DNA, 362 bp, Zea mays
  Clone ID: LIB3068-019-Q1-K1-B6
caaatttggaggcgatccatgtcctggaatccaaaaatctcttctagttgtggcgaactgcaggtgacactagacagtcacacaagtatacatcatagaaaagaagttggacgagtataaaaaataaaatgatgagttacaaaatcaacgagcaatagagtggagggaaagtataagtcaaaacatatagtaattgttattaggtaggcaattgatcacttgaggcttagttggtagaccccatgtaccgattgttttgacctggcatagatatatatgtgttatctgtatatcggtttcacatgaatgggaactcattgctttggtggttatggtgatttagatatatgtgatatcaaaaa

SEQ ID NO: 56277 - DNA, 227 bp, Zea mays
  Clone ID: LIB3068-019-Q1-K1-B8
ggcactcagcggttgcacctagcttgccgtaatcacccgcacgcacatcatcacggagggcttctatctgagcgccggcccatatctcttgtagatgacgcaaaatcaatcttctgttactcctactcttctccttctttctatcggggatactcatttcctgctatgcatgcacttctctatctctcactataatatataccatatataactttatgactcgcata

SEQ ID NO: 56278 - DNA, 370 bp, Zea mays
  Clone ID: LIB3068-019-Q1-K1-B9
agtggttggtgtattgattttttttggaaagggagtgtgtgcgagttgtctatttcaagagtggattggatctatccggctgcactttagaatatttttagtattttttttgataaataagaaaaggtgcacgatctcgacgaattacttctgaataacttcagaaatcatatggaagaaccatagcatttcgcgattcattggtaaatttactttgattctctatagaccaataatgtgagaccattaacactgttaaagctaaactgcttgaagtccggtcaaaaaggggtactctttctacaacttcattagtattagtctcgaaatgctttaaatgggaaatagctagtgtagaattatctgatat

SEQ ID NO: 56279 - DNA, 233 bp, Zea mays
  Clone ID: LIB3068-019-Q1-K1-C1
tcgcagacgcgtgggcggactcgtgagcggattcgtttacgaacctggactgactataggtaggggaggtactaggagcatgtgagtccggtatttatttgggcctttaaacgtaagcccttgactcatgcatgcatacaaattgatctatacttatcgttatctgatggaaggagtgccattttgtcgagttaatagatagtatcatttacccatttgaattctcctttgaa

SEQ ID NO: 56280 - DNA, 113 bp, Zea mays
  Clone ID: LIB3068-019-Q1-K1-C10
cgacccgcgcgtccgctcgaactcaacccccgcccccttcacctgaatatcatgtccttcgtcctttccttatctggctgcttttttccactcgcctgcttctcctcaccttc

SEQ ID NO: 56281 - DNA, 149 bp, Zea mays
  Clone ID: LIB3068-019-Q1-K1-C2
acgctttgttttcctaggggcgccacggagtatcctgttctcagctgaattttttcttgtaggttggtgtattcggtagttgtgttgtagtcactgtgctaaacaaatatttatgattgattggctgcaaaaagtgaagtgcgctattg

SEQ ID NO: 56282 - DNA, 447 bp, Zea mays
  Clone ID: LIB3068-019-Q1-K1-C5
cccacgcgtccggccacgtgcgcgccgtcgtccaagctgcccgccggcgccggcgccgggggcgtcgcggggctcgcgccctcctccagcagccagcagtcgctcccggcgcaggtggcgcgcacgcagaaggtcgccgacaaggtcgcgctgtgcctgcccagcgacggcaggtccacgtcgggcgacagcggtcggcgtggccatcttcggcggcggcccgctgttcttcgtcccgccggaccgcggcgacttcaccacgatgctggccggcacggggccgctccacgccggagccggagccggtgcccccgggtactacgtctcctccaccggcatcgccgtggagcatgcccgcgtgggccgacccgccggggcgctcggcgtggcgctgagcttcacggtcccgtacaccgcgcttccggcccgactggtacgctccgttcg

SEQ ID NO: 56283 - DNA, 429 bp, Zea mays
  Clone ID: LIB3068-019-Q1-K1-C6
ccgacctttttttttttttttgtatcaacaactgcatgacttgcattatcagccgcaaggggggctcgctgagttaacacagtgcattaacacattaacaagggctaagctgaccaagtgaacacaacgactgttcttttgacctctaccaacaactgcatgccatgccacacggtctacacatcgaacaaaacccgttcccctaacagcaaacactggtctagtacactgtacacctctgctctcaccacagcaaagggcaagggctgattcaccacagaagcagcacatcttcccttacccatatggatgttaccactcacaagtttgtaccttctctgcctttttggttcagcctgcttaggctcaaaaattggtgaaattggcatatgcatttgaaaagtctctttgaaccattttcttttgaaa

SEQ ID NO: 56284 - DNA, 398 bp, Zea mays
  Clone ID: LIB3068-019-Q1-K1-C8
attaggaggtgccaccacaacgctagggttcacgatggagtgggctatgtcagagctaaggaagaaatcagagacgatgagaaagacacaagaggacattcgttgcgtgctaggtgggtcacgacgaggtgtcatcacgaacactgacctcgttggcctcacctacctaccaatggttatcaaggaggttcttcggctgcatcctccaaaccctatggtggtcccacgtgagtcgagagaggattgccaagttatgggctaccacattcccaaaggcaccaaggtgctcgtgaacgcatttgcgatctccagggattcaaggtactgtaacaaccctgaagattttagcccacaaaggtttcagaataacaatgtggactacaaaaggaccgattttg

SEQ ID NO: 56285 - DNA, 299 bp, Zea mays
  Clone ID: LIB3068-019-Q1-K1-C9
cctgtttctcaagctccttggctctagcttcagcttcctcacatctttcttcagcaagtgggagcttttctagaacactttcattctcctcttgtagcatatcaagctcatcgtgaagtgtagatgcctctcttttcagtcctgattctcttgagctatgaagcgctgcatcaaatcttttcggtcgagtgcgatccgctggaggctccacagccaccggtggaataggggacggtgttcgcagcgacttgttggttttgattggcgtgaccactgttgtggtgggtcgtgatgcaaca

SEQ ID NO: 56286 - DNA, 104 bp, Zea mays
  Clone ID: LIB3068-019-Q1-K1-D1
taaataaaaaaacacacacaaaaatacaaaatataaaaactaaaaataaaaaaaactacaaaggaaactgacaaataaaaaagaacatatcaaacaaccctata

SEQ ID NO: 56287 - DNA, 342 bp, Zea mays
  Clone ID: LIB3068-019-Q1-K1-D10
cccacgcgtccgcccacgcgtccgcccacgcgttcgattgctgttgaccgattagttggggtggaagatctcagaagtgaagacgattttccgacaagagcgttggaaaatattctcaagacgaaagggataattgatgagaagaagaaagatgacgacgatgacgatgaagaaagcgaggctaagaataggagggttaggtcttcaactgctcaagactctgacttagactgaacctgagatgaagatcgaggactcaccgtttttgcactttggattttgtttgtttgtttgttctgtagtgtgctgaactgtactgaaattgatttgtgtaaccatgta

SEQ ID NO: 56288 - DNA, 290 bp, Zea mays
  Clone ID: LIB3068-019-Q1-K1-D11
cccacgcgtccgtccacgcgtccggagagtttgcgtcggggtatcatgttctccaactgggtggatctgtaattagcactttagcagcaatagtaccatatgttagccgacaaatgctagcggcggggtttgacctgaagcaaaatatgcgttgtctgtaggagagggcattgccagatagcctctgtaaccttgtactctagttcctagactaaattaatttgttatcatgtgtacatcagggtaagcgtgatgctgtcttaagagatccaagtgataccaatttaaaa

SEQ ID NO: 56289 - DNA, 107 bp, Zea mays
  Clone ID: LIB3068-019-Q1-K1-A8
cggacgcgtgggcgcaaggtaaccgagacgatgaaaaacagacttgtgtaataagtaaatgaacctataaaataccagtttaactgtttaaggagatttgcctcatt

SEQ ID NO: 56290 - DNA, 249 bp, Zea mays
  Clone ID: LIB3068-019-Q1-K1-D12
ccggtccatatattacatgggtcgacccgggcgtccgcccacgcgtacgatcatttgcagttcgaatgaataaattgttgcttactagaatgaatacgggcggaattggccattattctgtagtatcactgctcaccaatgggatataaaaaattaagtcagagtggtgatgaccaccctatcggcattatatgaagaagagactgattcaatggtctctgctgagaaaattcccgaaccccatcaata

SEQ ID NO: 56291 - DNA, 385 bp, Zea mays
  Clone ID: LIB3068-019-Q1-K1-D5
cccacgcgtccgcccacgcgtccgcccacgcgtccgcccacgcgtccgcccacgcgtccgcccacgcgtccgcccacgcgtccgcccacgcgtccgcccacgcgttcgcggacgcgtgggcggacgcgtgggcgcgctcgaaagcttgcgcggtggcgtgctcatggtcgcgcgcatagtggtatgccaaaagaggatgctgggaaagtctgcacagtggagactgttatgtcattctgtatacgtatcatttgggcgacttgaaagaagaatactatcttagctactgaattgggaaggatagcttggtggactatcaagtgtcggcatcttaaatgactaatacaatggggaattcattggaaggacgggctgttgtgggtcg

SEQ ID NO: 56292 - DNA, 404 bp, Zea mays
  Clone ID: LIB3068-019-Q1-K1-D6
cggacgcgtgggctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacatagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaa

SEQ ID NO: 56293 - DNA, 361 bp, Zea mays
  Clone ID: LIB3068-019-Q1-K1-D7
gcgacgcgttggccgtccactccaaggccacctacgactagcagtgcgcggacgggacgggcaacacggggctgatggtgatcgacttctcggcgtcctggtgcgggccctgcctcttcatcgagccggccttcaaggagctggcctgccgcttcaccgatgccatgttcatcaaggtcgacgttcactagctctcggaggtcgcatggacatggaaggtagaggcgatgccaacgttcgtgctggtcaaggatgggaaggaggtaggccgcgtgattggggctaagaaggacgagcttgagaggaagatcaggatgttcggcacgtcatttttctcgtcctaacttatcagtgcatacac

SEQ ID NO: 56294 - DNA, 318 bp, Zea mays
  Clone ID: LIB3068-061-Q1-K1-F9
cccactcgtcctcccacgcatactctcactctacccattaatctaacccttctccataaaccatctcgggggcatatattatacactccgaaggcacaaaactcatacttagtgacctaaataccaaaaccatgtccttaacactacaaaatcacacactttacaatctaactcctatccctactaatcatattccatcacatatcctgcaccacatatttactaataacagatagctacacacaattcttacacatattcagatactcatacttattatccatccttactcgaattgcactacatttctctaaccct

SEQ ID NO: 56295 - DNA, 447 bp, Zea mays
  Clone ID: LIB3068-061-Q1-K1-G1
cccacgcgtccggcagcctgagcacccgattagactccgtgcgaccgaagccagagccgggggaaccgaacggaagcgagacccccggcggctagcgagatggacggcggcgccggcgaggaggggaagcaggagcggcacctggtgctggcccacaagctcttccttctatcccacccctccgttgatgacctctccaaggtcgccctccgcgccgaagtcctcgacaccgtgaaatccgatgatatggcgacgctgtttgagtcgctggtcgccgcgggtgtgctggagggggacgccgcgctgctggccgagatgcgtgggaggattgacgaggagatccgcaagctagatgagaaaattgctgatgcggaggagaacttgggtgagagcgaagtccgtgaagcacatcttgccaaatctttgtactttataagggtcggtgag

SEQ ID NO: 56296 - DNA, 249 bp, Zea mays
  Clone ID: LIB3068-061-Q1-K1-G11
acccattggcaatatactttggggggtttatacctaatgctgttaggagtacaacctctcatagacagtatactgtcctacggattttcaaggtccgaccatggcacaccggacacctcgcaatctacgtcgctcttccggccgctggaccctacctccagctgaaccgattccatggacgactgtccgttaagcataaaagataactcttcccgaggccccctccagcagtctacatactttctaaca

SEQ ID NO: 56297 - DNA, 468 bp, Zea mays
  Clone ID: LIB3068-061-Q1-K1-G3
ccggccgaccgacgcgtccggtctgattactattagcgattggttgtcttagatagggtgtcgggtgtccaatgttttggttggttttttttacaggagagagagctggccaaggctgccgggaaactggccgactgccagaagacgatagcttcactgagcagccagctgaaatcgttggccgatttcgacgagttcctccctgaaaccgagactagtggcgccgactcagccgacgcctgggacggcgacctgaagctgctccaccctgcaagctatcccacgcagattggctgtttggcagtcacatgagtcacgatcctcgttggcaggtgggcggagaaactgtttttgttcgggttccaccgcatgattgctgtggtgagattgccatgatcttccaccacatgccatatagagttaagtttataatagtctataggtgagaaaatgttcatatgaaagctg

SEQ ID NO: 56298 - DNA, 435 bp, Zea mays
  Clone ID: LIB3068-061-Q1-K1-G6
cacagagacatcagagagcggtccttcatgtgagtctgagctgaagaggaggaggagggggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcatggcgcgcacgcggtgcggctgggcaacgaggcgtcgatccggcagcgcctggccgtggcgcgcggcgcctactacgccatcacgttcagcgc

SEQ ID NO: 56299 - DNA, 87 bp, Zea mays
  Clone ID: LIB3068-061-Q1-K1-G7
acccacgcgtccgaaaagacacaaaaaaaattcaaacaaattaataaaaacaaaaaaaaaaaaaaaaaaaagggagaaatattaaaa

SEQ ID NO: 56300 - DNA, 247 bp, Zea mays
  Clone ID: LIB3068-061-Q1-K1-G8
ctgggagccaatgcaggcttcgagtacatcatccaactttaaatgttcaagtgcttatcacaaacatgaaaggctgtgatagagaaatgttgcttcactgaccaaacatcatattcatgataaatgatctatgtgtcaagattaggagggaactgtgctatggagatcacgacttatgactctaaccaataatgatgatgagctagaaaggtaaaatatcatgcacaatgactgatgtctggacccg

SEQ ID NO: 56301 - DNA, 383 bp, Zea mays
  Clone ID: LIB3068-061-Q1-K1-G9
tcggcattccctcacgctaggattatgcttcactaacctgctagtgcttattatcggtcaagggcaccataatttttactagaagtggaagagttacacaaagttcgcgaaatgatcacaagggtttatgcactaagaacaggcaagcctttttgggttgtatccgaagacatggaaagggatgtttttatgtcagcagactaagccaaagcttatggacttgtcgatattgtaggggatgaaatgattgacgagcactgcgatactgatccagtgtggtttctagaaatgtttaaggattggtagtgggttgatttcttggtaatttatcttaaacctaaattccggttttatgctatagaaaatagaaatactttatgatt

SEQ ID NO: 56302 - DNA, 392 bp, Zea mays
  Clone ID: LIB3068-061-Q1-K1-H10
gacccactcgtccgaatgatcgtcaggagattgatcaactgcttgcactgcctgagaagccacaggtggggagacttgttataaagaggaggaggcacacgaacaggccgtaccaagagaatctgctcaacatggctgaagctcggcgggagatcgtcaccgccctcaagatccaccgggccagcagcaggaggcatcagcaacccaagtaccagcgtcatcaggagccgccgctgcgtcaaccaccgtttgcacagctccagcaacagcaagaatagccgaagcacgtgcaagaggcgtatctggatccaagatgaagccaaccgaagggtgacgaagaagcatctctggcacataccactatgaaatacgccatcttcactaacaacccg

SEQ ID NO: 56303 - DNA, 229 bp, Zea mays
  Clone ID: LIB3068-061-Q1-K1-H12
cggctggccacgggctgcggtcgctttctaacgacctgggggcgctccaattccgcaagaagggctacatcccgctcaccacctacctccgcacctacaagatcggcgactacgtcgacgtcaaggtgaacggcgccgatcacaaggggatgccatacaagcactaccacagtcgcacccgtcgagtatggaacgtcaccaagcgcgccagataccacaacataaacaa

SEQ ID NO: 56304 - DNA, 422 bp, Zea mays
  Clone ID: LIB3068-061-Q1-K1-H2
gaatatcccggccgaactcgtccgcttatgaatcctgaactctttcttcgggttgtaattaagcctcctaagggtgttctacgctacggtcctacaggaactgggaagaccctattggcaagggctatcgcaagtaacatcgatgccaactttttgaagattgtttcaagtgctattatcgacaaatacattggagaaagtgctcgtttgattagagaaatgtttggctatgcacgtgaccaccaaccatgcatcatcttcatggatgaaattgatgctattggtggtcgaagatttagtgagggaactagtgctgatcgtgagattcagcggacgttgatggagctccttaaccaattagatggatttgatgagctaggaaaggtaaaaatgatcatggccacaaatcgacctgatgttct

SEQ ID NO: 56305 - DNA, 207 bp, Zea mays
  Clone ID: LIB3068-061-Q1-K1-H3
cccacgcgtccgaaaaatataaaaaaaaataatatatatccaaataaaaaaaaaaaaaaaaggaggaatttattaaaaaaaaaagggaaaacaaaaaaaaggacgacctttctgatgcatccttgcttccgaatgcttgcatcctaattcatatcctttcttttgtccaaacttaattcaattgactgcccttttacttccaacttc

SEQ ID NO: 56306 - DNA, 429 bp, Zea mays
  unsure at all n locations
  Clone ID: LIB3068-061-Q1-K1-H4
ccacgcgtccgcccacgcgtccgagacaagtggtttccaatgcttagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgncggcgccttcgcactctacgagaagcacgaggcgaagaaggaccccgagcacgcgcacaggcacaagatcacggangaggtcgctgccgcggcagccgtcggcgccggcggctacgtattccacgagcaccacgagaagaagaa

SEQ ID NO: 56307 - DNA, 445 bp, Zea mays
  unsure at all n locations
  Clone ID: LIB3068-061-Q1-K1-H7
cccacgcgtccgcggactcgtgggcgaaattttatgcagaaccctcagctgcaggagggggaattccagaactttccgacttcttacctacgctgtgctgctcatcgtgttgcacaacattatggcttagagactatagtggcagatagtttagtagaaggctcagttagcaggatcgttgcaagaaaaacaccagagagcaggtgtcctgcaatttcattagcagaagttcctagcaaacaagcaagaaatgatcatgaagcagcagagaagcttaagtttgtcatttatcaaaggcccaaagcattccaaaatggaagcactgatttgggaaacaagaatggtgcaccaaaaactgttgaagagagaatagaggaatataataaagcacgagcacgcatcttcaatggttcntgttctgcagattctgatgctgcaagtgttt

SEQ ID NO: 56308 - DNA, 87 bp, Zea mays
  Clone ID: LIB3068-061-Q1-K1-H8
cccacgcgtccgaaatttaaaaaaaattaaaaaaaaacaaaaaaaaaaaaaaaaaaaggggaaaatttaaaaaataaatggggcctc

SEQ ID NO: 56309 - DNA, 253 bp, Zea mays
  Clone ID: LIB3068-061-Q1-K1-F8
cccacgcgtccggtcgaaaaaaaaaataataaaaaaaaaaaaaaaaaaaaaaaaaaaaagaaaaaaataaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaattaaaacaaattaataaaaaaaaaaacatataaaaatacaaaacaaaataattaataaaaaaataaacccataacaatataaaattaa

SEQ ID NO: 56310 - DNA, 313 bp, Zea mays
  Clone ID: LIB3068-061-Q1-K1-H9
catgatcgtcaggagatggatcagctgcttgccctggctgtgaagccacaggtgaagaggcaggttaggaggaggaggacgcacacgagcaggccgtaccaagagaatctgctcaacatggcggaggcgcggcgggagatcgtcaccgccctcaagatccaccgggccagcagcaggaggcagcagcaacccaagtaccagcgtcatcaggagccgccgctgcgtcaaccaccgtttgcgcagctccagcaacagcaagaagagccgaagcacgtgcaagaggcgtttctggatccaagtcgaagccaaccgg

SEQ ID NO: 56311 - DNA, 211 bp, Zea mays
  Clone ID: LIB3068-062-Q1-K1-A10
ttaaaaggaccgccatttgaccaccgcacaccacccgacatgcatcacacacccttccagtgatcccatcctcccgcacaaccgataccctcaacagcgtcccgttaaacagaaaatataactattcccgatgcctccgccggcgtctccatacatactaaacacgcccactgccaatacctcccatctctggaaatcctaaccatattcc

SEQ ID NO: 56312 - DNA, 262 bp, Zea mays
  Clone ID: LIB3068-061-Q1-K1-C6
gattgatcctcccatatcgatcgtcgtttttccccgtttgctacgcgtgcgtgtgagagggatatctagcgccggccggcctgcacgcccgccgtgttgtgcgtacgtacgtacgtatacatgtatgtatgtatatgcgcgcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 56313 - DNA, 427 bp, Zea mays
  unsure at all n locations
  Clone ID: LIB3068-061-Q1-K1-C9
ctaagaaggcaggaattgttggcaaatatttaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgtcgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatntggtttatgctctaggatctcaaagttgtgtngttg

SEQ ID NO: 56314 - DNA, 293 bp, Zea mays
  Clone ID: LIB3068-061-Q1-K1-D10
acccactcgtccgcccactcgtccggctgtttatccaattgtttcttgcactccctccaacaagctagggagggtttgttcataccacggcgagctcgtttcattatccatggatgatgagaagcaccaccaccaccacctgatacaccacaagaaggacgaggagcacgccgcagccgcaggatacagatagtccgccgagtacacagacgccacagtgactgaggtcagctccacaggcgataacgattactacgagtacaataaggaagagaagcagcacaagcacaagc

SEQ ID NO: 56315 - DNA, 253 bp, Zea mays
  Clone ID: LIB3068-061-Q1-K1-D12
ccacgcgtccgcactggcctcgggaagttaacccaagggtttaaaaccccgccacgaacgagaaagaagcagctgtttcaaaccacggggggcccgaaaaaccatcaccgacccatcacacgcaccaacaccaccacctgaaacaccacaaaagagaccacaagcacgccgcacgcccaagacaccataagaccgccgagcacacacacgacacaatcactaaaccgagccccacagacgacaaccagtacga

SEQ ID NO: 56316 - DNA, 296 bp, Zea mays
  Clone ID: LIB3068-061-Q1-K1-D3
ccacgcgtccgcccacgcgtccgaaaaatcatacaaaaattttttatacaaaacaaaactaaaaaaaaaacgaagatttaaaaaaaaaaacaggaaaaccaaaaaaaccaaaaaaaaaaaaaaaaacggccaacctctctataatacccaagtttacataccctgccatccacttgcaatagcttccaacaccgccacccaaactaaattcatggcccgcttttatccaactctattcctgaaaaaacccaaccattacccaacttataccaattgcccaaacttccactttaaca

SEQ ID NO: 56317 - DNA, 469 bp, Zea mays
  Clone ID: LIB3068-061-Q1-K1-D4
cgggccgaccgacgcgtccgcccacgcgtccgcccacgcgtccggcctgtgctcgcctcagctcctttcttccccgcccgttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaatacagttatggaggaccagatactgctgtacagaacatggagaa

SEQ ID NO: 56318 - DNA, 439 bp, Zea mays
  Clone ID: LIB3068-061-Q1-K1-D7
gttctcgccactattattctgcacagcatttcatcaagccttctagaaccatctcgccggcgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgccgccttcctcttcgccgccgtccgccactgagccgatggggcctcgtgcctgcaggctacctagcagtacttccgccgctgctgccgccgccgcctagatctatttattggagtgctatccagtagtactagtagtagtgagatttcttcggtgctgtcgtgtcgtcgtcgcattttggtcggatct

SEQ ID NO: 56319 - DNA, 138 bp, Zea mays
  Clone ID: LIB3068-061-Q1-K1-D8
actcgtccgcccacgcgtcctgtcaataaaaaaaattatataaaaaaaaaaaaaaaaaaaaaataaaaagaaaatttaaaaaaaaaaaaagaaacaaaaaaaaaaaaaaaaaaaaataaaaaaaataaaatataaaat

SEQ ID NO: 56320 - DNA, 282 bp, Zea mays
  Clone ID: LIB3068-061-Q1-K1-E10
acccactcgtcctctcactcttaccataaatcactcctttcttttgcgcatactatctaaatactaatgtagccttctaataactcattccctcctaaattcacctcaaaatagcttcaacccacaccaatcctatctcgtaaacccaataattacatgcatcatcgtcccatctccctcaacctattatcaaacatcaaatacccattactacgccatcttcttccactagccattccacctaatctttatctccaaataccccatttttccaaccaaaac

SEQ ID NO: 56321 - DNA, 269 bp, Zea mays
  Clone ID: LIB3068-061-Q1-K1-E11
ctcacgcgtaccataaatcagtcgattgttctgactatagtatctacagactaagggaggcttctataatatgattccgggctaagattacctcaagatatcttgagcccacacaaattctatcctgttaagccaatgatcagaaccatatgtctctcatcgcactccacatattatcacaccttaaatatgtattaccacacatctgcttcgatgagcactgccacgtaatctatatcttcaaaccggacatttttggcaagcacaac

SEQ ID NO: 56322 - DNA, 185 bp, Zea mays
  Clone ID: LIB3068-061-Q1-K1-E12
caaacaaacccaacaaaaacagaccagcgaaacaagtaaaccaaaaaccaacatcacagaccctcctaaccataaaaagacaacacataaaaaatataacccaatcaccacacatcttaactcactagccaatcaccggaaacttcagcctcaaaacccacattttaacaacaaaactaataaaa

SEQ ID NO: 56323 - DNA, 418 bp, Zea mays
  Clone ID: LIB3068-061-Q1-K1-E2
acgcgttcgaccacgcgttcttccactcgttcggactttcttttactcactccatcttccccccggtgactttttcatagatgcatcgggcccatccaacctgataggaaaagctagctagcatttaccatctctaggccggcggctgtagtctgcctgcagctgatgttagctacaaacattgggagctagccatgtggagggatcccctggagctaaaacagatcgagaacaagatcaaccgccagagcaccttagtcaaacgcctcaacggcctgctcaagaatgcttacgaacacttcgagctctgcaacacctaagtctcactcaacattctcttcaaccgccgaaagctctacaagttctgcatccgacaaaacattaccaaaacacttgataggactaaaaaaacattatt

SEQ ID NO: 56324 - DNA, 195 bp, Zea mays
  Clone ID: LIB3068-061-Q1-K1-E3
cgtccgacccacgcatacgcccacgcgtccgaacactcaaacaaaaaattatataaaaaaaaaaaaaaaaaaaaaaaaaagaaggattaaaaaaaaaaaaaggccgaaaaaaaaaaaataaaaaaaaaaaataaaaaacaaaaaaataaaaaaactaaaatattattataaataaatataaaattaaaaaataaa

SEQ ID NO: 56325 - DNA, 167 bp, Zea mays
  Clone ID: LIB3068-061-Q1-K1-E4
ccacgcgttctaaaaataaaaaaaaaattattttaaaaaaaaaaaaaaaaaaaaaaaaaaagaaattttataaaaaaaaaaaggcaatcaaaaaaaaaaaaaaaaataaaaaaaaaaaaaaaaaaaaaaataaaaaaataaatcctattaaaaaataatcaaaacaa

SEQ ID NO: 56326 - DNA, 234 bp, Zea mays
  Clone ID: LIB3068-061-Q1-K1-F10
acccactcgtccgctgtgtctgggcttttgtatggtcaggcttttcagagttgtcatggacttatgggggtgttagtatattggttgcgctgaatctataataaaaacgaggtaaactaggacaatgatgatgtggccgtgtgtatttaatgtattctgttcacaattaaaaaaaaaaaaataaaataaaaacaaataaaataaaaaaaaacaaaaatacagtatagataaaaa

SEQ ID NO: 56327 - DNA, 294 bp, Zea mays
  Clone ID: LIB3068-061-Q1-K1-F2
acgcgtccgcgcacgcgcgcctcaataacaaaacccattggtacaaccccaccaccgacaacacgctccgcaccttaaaagacaccagcggcgcccacaacacccggcaccaacaacaagagagcactgcacaaagcaacaacatcgcaaagcgacacattcagcacccgataagcaccacatgacccccgacacacccaaaggcccggaggacccgaagaaaaaagacctacagacactttggggcaaccgccactgatagccctaggcgaacaaccgcgactactacaacaa

SEQ ID NO: 56328 - DNA, 321 bp, Zea mays
  Clone ID: LIB3068-061-Q1-K1-C3
ccactcgtccgcccacgcgttcgaaaattcatactctgaatgctattcatttccatactgaaaagttcccgttggttttataagaatggcagttcttagatgtcgattttgatgaaaattgatcattcaacgtcactgtaagagttgactgccatggtttgtgacaaggttgccatggtttgctgcaccgtcagcctactatttggaggttcatttgcgatcgcaacatatacagacgcacgatcatttttcttccattctggagtaatagtccaagcctgaactgtgacattccgtcatgcttatacgtgaaattgtacc

SEQ ID NO: 56329 - DNA, 350 bp, Zea mays
  Clone ID: LIB3068-061-Q1-K1-F4
cggacgcgtgggaaaaaaacaccaaaacatttaattacaaaacaaaacaacaacaaaaaaggaggattttaaaaaacaaaaagacgcccaaaaaaacaaccaactatcaaacccaaaaacagaactccagatcaatcgccataacggcacccacctactcaccattccagacttattcacttctgcctaagccaaagctaccatcgatatcgcttactcaaacgacttcactcaccactgcagcctaccgccactaaatgccgatgcttacatagacaactatcgtatatctgagactcatccattgcttgctcaaaccattttcgaatcatgaataaacatgattttta

SEQ ID NO: 56330 - DNA, 369 bp, Zea mays
  Clone ID: LIB3068-061-Q1-K1-F6
acccactcgtccgtggagccccccgcttgttccgccatttatcatcgcccgaacaaagctacatccggcagacatttttaaaaaggcggggggcccaacaaaagatccccaacaatcaatcccaagaaccatctccagatcaatcacctcaataccacccaccttctcaccatctccaaacttcttcacttcttcccatgccaatgccttcaacgacatatctcaatctaaacactttactcaccatagcatcatttctcactctaatcttctattcttactttaacaacaatcttacatctaatacttatccttttctttctcaattccattaaattatcataaatcatcaacaatataacacacatt

SEQ ID NO: 56331 - DNA, 405 bp, Zea mays
  Clone ID: LIB3068-061-Q1-K1-A11
atccggagcagccgcagtcccaccgtccttttcgccggtcgccctccatctcctgggcggtgcctctcgtttctctgttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcacgttgctgctggggttaccagccaaaccaattactaccacagggctgatggtcagaacactggcaacttccttacggaccgttcttcaaccaaggtccacgctgctcctggcggtggctcttccctgggctacctgttcggtggcaactgatgcccgtgctggtgc

SEQ ID NO: 56332 - DNA, 314 bp, Zea mays
  Clone ID: LIB3068-061-Q1-K1-A12
cactcgtccgatctgcatcaggctccctcgacccacgattttaaacccaaccatgcactatattggggggtgtcttcatgaacaggcacgggacatcctgatgcttgagctcgctaggctcaactgtggccaagggagagcgcttcacctcatggagctcaatgacctgtcactaccatcaatggcgctatacaacactgctacacctgctgacacaccataccctgcaagagactgatgcactcaagcaccttgctgttctgcataccagccaaaccaatcacgtccacaatgctgatggtcagaacactggc

SEQ ID NO: 56333 - DNA, 135 bp, Zea mays
  Clone ID: LIB3068-061-Q1-K1-A2
aaaaaaaaaaaaaaaacgagaaaatttttcaaaaaaaaaagggcgccaaaaaaacacttcaccacatcatcacccatccacaactacatcagcttacacactatagtaccacatatttttacataaaactcactt

SEQ ID NO: 56334 - DNA, 384 bp, Zea mays
  Clone ID: LIB3068-061-Q1-K1-A3
cccacgcgtccgggacctcccaagacctgtcatctccagtgaatgcgacgccgggaaccgccggctttgcgtcctctctggtcgtgcgcttcgcccgtctccacagttggtgcagaaacagtgcaacagtgtttacggggtgaactgctggagttggcgttagatagtcgatggtctactgccgccgtgctctctcactaccagtgtcccaccaccgccatgcatgttttgcggcaattgccggctactatactcctccgtctccaatcatcaggcaccagcttgcgacgcaacttggattctctcctcttctctactctcgttgcaacaaggcagtccagtgaatgagacggatggccccaactgtgcctgtagctgatgcat

SEQ ID NO: 56335 - DNA, 256 bp, Zea mays
  Clone ID: LIB3068-061-Q1-K1-A4
cggccgaccacgcgtccgcccacgcgtccgcggactcatgcgcggacgctagatccgacacgtggacagacaccagagcggggctttaaaaaaagatggcgggccaacaaaacagctacaccatcacaccctgcctctcctactcccacagcacggggaacggcccctccgcgtcctgcttcagcaacatcaggaacctcaagagcgccaacagcaccaccgccaacaagcacgccgacagcaactgcctcaagaa

SEQ ID NO: 56336 - DNA, 437 bp, Zea mays
  Clone ID: LIB3068-061-Q1-K1-A6
tgtcgatccaattgtcacttgctctcccatcaacaagctaattaaggccggtccatgcgggttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaatgacccggagcacgcgcaccgtcacaagatcgaggaagatgtcccggctgccgctgccgtcggctccggcggcttcgcctttcacgagcaccacgagaaga

SEQ ID NO: 56337 - DNA, 426 bp, Zea mays
  unsure at all n locations
  Clone ID: LIB3068-061-Q1-K1-A7
atccgttgtttccgcgcctgttggtccgtttcgcacgccggatttttgcatcgagcgcggagatctacaacaaaaacatggagctacgacgcgactcccaaggtacaatcggtaattatgttcaaacaatttttaagtcgttctgcgctccttctattacgagcaacgttttatattctgtgcttgcataatgaatcgaagaaatcctgacaccaatcgaactgaagatcctgaaacgcacgttaataccgttgacgtccgcttcacccagctcgattttcagtcttgtaatactaatcgctccatgagtctgaagtgtgcaaaaatttaggtcgcagctacacaaatttacatgctggttctgttcaacccgtgaatctnctattttggaaaggtcacagcgtttttatttcattctatattata

SEQ ID NO: 56338 - DNA, 348 bp, Zea mays
  unsure at all n locations
  Clone ID: LIB3068-061-Q1-K1-A8
tcgtctcgtcggacgccccgtggggtnnctcatgtctctgcttcgtcgtctctnnngtggagctacctannggtgacncggtgcgcggactcgttccnttnacgccactgtggccgtcganntccagccctcnnngtcggcttttctnnntcgcaccntncgtcactncgtgcgggtcangnncacctcaccaggggttcatttaaatgggnncagagaccggggtgttctaaccccnnctcttnntggaaggggtatgnnaagcatgggtgaaggggcagagaacgnnngagtcattcttcnnaccaagccnnncttccttggggatgtcttgcaagcccaaatctt

SEQ ID NO: 56339 - DNA, 411 bp, Zea mays
  Clone ID: LIB3068-061-Q1-K1-A9
gaacagtgcgtgctaatggtgagcttatttaaaaggatgcagtgttgctcctaaggaggaaccagacggtaagagttgttggatcagaggcactgccgaagtctggaaggatttctcgctatgatgtgaagatcaaacacaaagcatgggaagagcaagaggagccagggaaagcccaagacaaagcatagaaaatccaagttaatgcaagcgggattcaagaaatttccaaggaaatattaggcaagacagataaattgttggaagcactggagccaaaccttgacaaagaagagaagattcaagaaaaggaagagcaacacctcgaagaagtggataatgttcaagagaatgaaggcaaagtccaatgcccggcagagaaaatccaagttaatgcaagtgggattcaag

SEQ ID NO: 56340 - DNA, 249 bp, Zea mays
  Clone ID: LIB3068-061-Q1-K1-B10
cccactcgtccggccgttctagccaatcttctaacctgacaatgtcttccgcccggggcggcttttctaggccggggctgggagccaatacgaggtgctgtgccccgcttccaacacagtcaataagtaaaacaacgtcacaaggagtggtaattcacaagcgcccacaggctcccacatatcctacacctatcaagtcatttcacaaagactgactagagtcaaactcaacaggtactactttaaacg

SEQ ID NO: 56341 - DNA, 123 bp, Zea mays
  Clone ID: LIB3068-061-Q1-K1-B11
cccactcgtccggcactccgaccgtttcttatggagcttcgaggccgcccgtcgcgtcgcgtttttcaaacaggctgaggcaatggcacgggcccttcgtggcgcgaacgccctaacatgtct

SEQ ID NO: 56342 - DNA, 185 bp, Zea mays
  Clone ID: LIB3068-061-Q1-K1-B12
tgcgggcaggatgtgccaaaattgacccaatgggatgtttggaggctgttgctgtatcacagagtaaggtgtatgagtatatctaaaaaacccctgcttgcaaccagacaaggcaatccatctatgaatttgtgaagagaagtgagggttaaaggcttgcagaggctgataagtcaaatgtcatc

SEQ ID NO: 56343 - DNA, 176 bp, Zea mays
  Clone ID: LIB3068-061-Q1-K1-B3
cccactcgtccgaaagaaaaaaaaaaaaataaaaaaaaaaatttataaaaaaaaaaaaaaaaaaaaaacaaaggagggattccaaaacaaacagacgcatacatacaacaaaaataacatcaaacatattacaaccataaatacaattcaacttccatcaatctacaacctaatac

SEQ ID NO: 56344 - DNA, 447 bp, Zea mays
  Clone ID: LIB3068-061-Q1-K1-B6
cccacgcgtccgagcgaacgaagcgacttttaccctgaatagggggatatcggagttcggggtgatggccgcggacacggagcctctcgagatcctgctccacctccccttgttagccgaggataagaacgtcccatatgtatttgttccatcgaaacaagctcttggccgtgcttgtggtgtgacaagacccgtcattgcttgctcagtgaccagcaatgagggtagccagctgaaacaacagatacagggtctcaaggactcgattgagaagcttctcatctgatttacctaagatctttcagtgtgatgggccttggcgacacatttttcagaggcttggactggtgatggtgtcttgtttacattacgctttccaaactatatctgaacactgctaagtcaatcatatttgaattgtgcttcactttatatctgtgattgtca

SEQ ID NO: 56345 - DNA, 431 bp, Zea mays
  Clone ID: LIB3068-061-Q1-K1-B8
gaagagaagaatgttctggacctctacattctcctcctgagatactcgagcttgttgcgggagaccatacccaaacatcgcgattataatgcatttaaggctagagaaaaggaattcctgaagaaaggcccacacaactctgagaaaattcttggtattgtcaatgagctagagtcccttaagccagttgtgcagcaacaaattgccaccggtaatagcaggggtgcagatgaacctaatggtgtatatggaacctatgctgcaagtagtgagttggagcaccataccccaagcccatatgtgtcgaagtccttgtctggaagccctactagactactgcagaaaccattacctggttcaaagcatcaagcagctatgtcgcacaatgttcaaccttatagacatgctattgaaccatctaccaacatgct

SEQ ID NO: 56346 - DNA, 432 bp, Zea mays
  unsure at all n locations
  Clone ID: LIB3068-060-Q1-K1-H8
cgcgtccggcgatatgcaccttctcctcgcccctttctctctctctaaaagaactgaaaagatagggggggaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcngtggcggtgattgaggtagtcgcgtcgaattggcacgcg

SEQ ID NO: 56347 - DNA, 365 bp, Zea mays
  Clone ID: LIB3068-061-Q1-K1-B9
cccacgcgtccgcatgacctactgctgctttaacttcggtgatgactagggtgcggggggcattgtcaaagccttcgcacacataaaatgcactgtgctggcccctgccaagatcattgccaccaaaccggacgatggagcgaagattaactatgtcgaaggtcacatgttcagtttcattccacctgctcaaactgtcgtgctaaagcttgtgctgcaacacctgaccgatgaggactgcgtcaagctcctggctcaatgcctgaaggcgattccttcacggaaggacggctggtaaagtataatcggggatattatgattgaccactctgggcttatgctggatacctaacctctgatggaca

SEQ ID NO: 56348 - DNA, 218 bp, Zea mays
  Clone ID: LIB3068-061-Q1-K1-C2
ccacgcgtccgaccaggcgcacacaacttcccccgagccatcgttatccactcccccatgatcccatcaccgaagtttataaacaaccggggccaccacaaacaaactgaactggacaccaacatcctatcggttaaccccaactgcactctcaacacccgcaattacactgaagtcaacccctacctgaccaacataatctacgccagttaacctca

SEQ ID NO: 56349 - DNA, 172 bp, Zea mays
  Clone ID: LIB3068-052-Q1-K1-G2
cgggtcgacctcacgcgttcgaaaaaaacataacaacaaacaaaaataaatttaaaaaaaaatttttaaaaaacaaaaaatggtgaaatataaggagatttatcatatgacacatacatcatatattaacaacttataccaatctacacaaactttgatgcttcaactattt

SEQ ID NO: 56350 - DNA, 463 bp, Zea mays
  Clone ID: LIB3068-052-Q1-K1-G3
aacctccaaacacctacctctctacgaactacctgccgccggaaaaccctagagcgctcgagcatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgccttctttgaacctgagctgtataatttgtaacgcttgaactggggactgatttgagaactgagacactgcagcaatatgttgatggatcctaagtggcgaatctaatgcatgcgtggtatgcc

SEQ ID NO: 56351 - DNA, 368 bp, Zea mays
  Clone ID: LIB3068-052-Q1-K1-G4
taccggtcgaccacgcgtccgagcgcttcaacacctacctctctaccaacttcctgccaccgtttaactctacacctctcggccatctatcggaactaatcttagcctatctgctacctctgttaacatatctgacctcacaacacacctttagcccttacatgttattcactaccgataatgccactaacgcatcctctacaagaacctgacacgctacgattccccaatatcaaactccctaatcagtgaactcacggtaaaacacttaagactctactatcattactatgctcattatcattctacacatgtcatgtcatttcaataaaaatgtactaacttaacagctcaataatatcttctct

SEQ ID NO: 56352 - DNA, 443 bp, Zea mays
  unsure at all n locations
  Clone ID: LIB3068-052-Q1-K1-G5
atcagattctgatgttcattgggcaatgctacaaccttgagacactatgggtacttgacgcggtgcgcgacgaagggctcgacgccgtgggaatttcctgcaagaagctccagtctcttcgtgtgctcccgttgaatgcacatgaggacgccgacgagttggtgtcagaggttagccttactgccatctcacggggctgccctgctctccgttcgatattatacttttgccagaccatgaccaacgctgctgttgtcgacatgtcgcggaactgcccggagctgaaggtattccggttatgtataatgggacggcaccagccggaccatgcgactggngagcctatggatgaaggattcggtgccatcgttcagaactgcagcaagcttaccaggctatccacgtccgggcaacttactgaccgggcatttgagtacattggc

SEQ ID NO: 56353 - DNA, 321 bp, Zea mays
  Clone ID: LIB3068-052-Q1-K1-G6
atcaatcagaatcaaacgtgctgttacccttttgcttcacaccacatttgtgtcctcggggagctcatcttatgacacctgctttatcttttaacagatgtgccagcctaaccaaactgcccaccttacaatgtcttccgcacggatcggcccagcaaggccagaccttggatccaaaatgagggacggcgccctgcttccgacccacggaatctgtaatataacgttgaaactagaggtgttctacttgcgcccggatgctaccacttatcctacacctgtcatgtcatttcacaaacttggactagaggacagctcaac

SEQ ID NO: 56354 - DNA, 334 bp, Zea mays
  Clone ID: LIB3068-052-Q1-K1-G8
accaatttctatcacacattctattactcttctcctccaccccacattgggacacttgcgacatttatcaacagatacgccctgcccacccaaactcacatatctcacactatcttccctccacatcttcccatacatatccgcatctataaacccataggatgacacacttccaaacttccatcctacacaatacctcattttccatccacatactgcgtattcctacttccctaccaactagaccacgactgctactcctctcaacttatctaatcctgcaagactatactttatcccaacagcttcctatgattcctctaattacatccac

SEQ ID NO: 56355 - DNA, 452 bp, Zea mays
  Clone ID: LIB3068-052-Q1-K1-G9
gggacaaggatcttgccaagaagatttggtgcttcggacctgagaccaccggcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgctgatgctatccacaggggtggtggccaggtcattccaactgccaggagggtcatttatgcttctcagctcacagccaagccaaggctgctggaaccagtttacctggtggagatccaggccccagaaaatgcactgggtggcatatacggtgttctgaaccagaagagaggacatgtattcgaggagatgcaaaggcctggtaccccgctctacaacatcaaggctttccttcctgtcatc

SEQ ID NO: 56356 - DNA, 83 bp, Zea mays
  Clone ID: LIB3068-052-Q1-K1-H11
cccacgcgttcgcggacgcgtgggaaaaaatgaaaaacgaacggatcagaaaaaaagagcgggcgcttgtcagccgctatgct

SEQ ID NO: 56357 - DNA, 476 bp, Zea mays
  Clone ID: LIB3068-052-Q1-K1-H2
tgctgatgtagcctcccatatccagcatgagattcagtatggaggtgacaatgcatcagcgtctccaaggtgacaataccctagccaaagcactgcaccgacaatgcacattcccaacacaagcaaccagcaaccatcgccaagcttatttgctccaggaaaccctgggttgacacagtccaagaattccatggtcttttcaagcgcattatccagccccatccggcggagcctgcaaccttaccacctagagcaagacggggatgcagggtactttgcgaacggtgcaagccgcgacgtgaaccccacggcttcgaatgattcgtccatggacatgcactcggacagcccagctcatgactcttactgagcagctcccaccaaccaaccgcatgagcagcacttcaagtggaagaagtctgctgtcacagccttccgaggcctagtagtaatattccaattaacacccttcatag

SEQ ID NO: 56358 - DNA, 390 bp, Zea mays
  Clone ID: LIB3068-052-Q1-K1-H3
tgcacacgtacgctcacacatccagcctctcattcaatatggaggtgacaatgcatcagcgtgtccaaggggacaataccctagccaaagcactgcaccgacaatgcacattcccaacacaagcaaccagcaaccatcgccaagcttatttgctccaggaaaccctgggttgacacagtccaagaattccatggtcttttcaagcgcattatccagccccatccggcggagcctgcaaccttaccacctagagcaagactgcgatgcaaggtactttgcgaacggtgcaagccgcgacgtgaaccccacggcttctaatgattcgtccatggacatgcactcagacagcccagctcatgactcttactgagcagctcccaccaaccaacc

SEQ ID NO: 56359 - DNA, 300 bp, Zea mays
  Clone ID: LIB3068-052-Q1-K1-H4
cgaccgactcgtccgtccagcatccagcaaattcaaagctgctatagaatcacaatgacacacatgtctgaaaactgatcacaactactgattaactaatgcaccgacaatgcacatttaacaacgacattgccaccacttaccttaatgcgaactaatgcactacagtgctacccagcccagacacagctcattagggtcatgctcctggtaagcacagtatactttcccagcactggtagccatgcacgatacgacctagatccagacagctaactaagtctaattgctaacttggct

SEQ ID NO: 56360 - DNA, 398 bp, Zea mays
  unsure at all n locations
  Clone ID: LIB3068-052-Q1-K1-H6
cccacgcgtccgacaaactcaaagctgctaagaatcagctcagacgcatccccgaagactaatcacaactactgattaactaagggtgtgtttggaacctttaacaggtttgtccagccttaccttaatgtgaattaaggcacgaggtgcttgccagcccaggcaagctaatttggttcttcctcctggtcagcaaggaaaacttttcctgcactggtagtgaggcaggagaagtccaggatccaaacagctaactaagtctaatttcttgcttggctaggcaaaagattgtttgccgaatcttccaaacatgctctaaggcagtaatgcttatctctggcaagaacttcctttntttttgaaacgaaccaggcaggagagctgccgattatattaat

SEQ ID NO: 56361 - DNA, 320 bp, Zea mays
  Clone ID: LIB3068-052-Q1-K1-H7
cccacgcgtccgacaaacttaaagttgatatgaatcatctgatactcatggccctaatactgagtgacatctactgaataactaaacatatgttccgaacctataacaactttgtacatgactaccttaatctgaattatcggaccagttactccccaccttagacacgctaattaggttcttgctcctgttcagaaccgaaaactattcctgatctcgtatagagtcatgataagtcaattatccacacaggttactaattatactttacttgctaagctatgctaaaaattgacagctcgaatcttgcatacatgctc

SEQ ID NO: 56362 - DNA, 195 bp, Zea mays
  Clone ID: LIB3068-052-Q1-K1-H9
ctcacgcatacgcccacgcacaccctagctgcttcacaactcgcggtctaaagactgaccagtcaccattagcaagtgcatctaccatggcgtcactaatatactatctcctgactaaccaaactccaactcttcgtagagtacagatacacgcacctattcaacgtcatgaaccactgcaataccacgctaaga

SEQ ID NO: 56363 - DNA, 302 bp, Zea mays
  Clone ID: LIB3068-053-Q1-K1-A10
aaaaaaaaaaaaaaaaaaaaaaaaaaaaaattaaaaaaaaaaaaaaagaaaaaaaaaaaaaagaaaaaaaaaaaaaaaaaaaaaaaaaaaaaaaaaaaaaaaaaaaaaaaaaaaaaaaaaaaaaaaaaaaaaaaattctgctatctttttaaaaaccccaatttaattaccccctctttcctaacaaaaaattttctttaaactacccaaaatttaattaaattcatcctgtttaaacaactacttccttaaaaaaacctttttttaccaaaattaaatcctttcaatttatttcccctttt

SEQ ID NO: 56364 - DNA, 429 bp, Zea mays
  Clone ID: LIB3068-053-Q1-K1-A11
cttgctgaagctgaactgctgatccgtcttccaagctgtggtgtcggcccctgagttctgatccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcaggcactatatgtaatgctatgtgtttgacaggtct

SEQ ID NO: 56365 - DNA, 429 bp, Zea mays
  Clone ID: LIB3068-053-Q1-K1-A12
cttgctgaagctgaactgctgatccgtctttcaagctgtggtgtcatgccctgagttctagtccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcatgcactatatgtaatgctatgtgtttgacaggtct

SEQ ID NO: 56366 - DNA, 431 bp, Zea mays
  Clone ID: LIB3068-052-Q1-K1-G12
ccaacacggatcatgccaaccacaatccgtactccaaaccggccaccacagacccaaacagggtccatgatcgagtgcgatgcatcccgcatcatgaagacatcaacgagccccgttgctcctggctccagtgctcatcaccggcacctgcactgactgaagcacaacacgcccggcatctgcttactaggccgtaacaccagcgcttcattctaccactatacacaccggcggaacgccaggtcattccaactggcagaaccgccatttatgcctcgtatctcacagccaacccaacgctgctacaaccatgaaacctcggagcgatccaacccccacaaaatgcactgcgtggcatatacgctgaacagaaccagatgagaggacatgcattcgaagagatgcacaggcacggaaccccgctatacaac

SEQ ID NO: 56367 - DNA, 168 bp, Zea mays
  Clone ID: LIB3068-052-Q1-K1-D2
cccacgcgtccgcccacgcgtccgcggactcttgggcagtgaacgagtacttggatactcgagtttatgatgtttgttcggtttatatcttccttgtaataagtcaaaaataatgttttttttgtttcgaatggagcattaaaagaaggggactgatggacacctatc

SEQ ID NO: 56368 - DNA, 357 bp, Zea mays
  Clone ID: LIB3068-052-Q1-K1-D3
cccacgcgtccgatatcttcaatgcaaaacctgtgtcgaacagttatgtagtcttggctggattaatcaaagggacaccgtaatttcttggagccaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaagggtggccctttaaaaaagttcaaaattaacaaaccttaaattcaaagaaaaaagttttttaaaatggaaccaaaattaaaataaatggacctcatttaaaaaacttataaattggaaa

SEQ ID NO: 56369 - DNA, 441 bp, Zea mays
  unsure at all n locations
  Clone ID: LIB3068-052-Q1-K1-D4
cggacgcgtgggcgagcacgcaccagcatccttggcagcgatctgcttgcttctcccagcgagcgcgcgcggccaagctaggggatccatcagatatccacgccggccatggccgccgccgcctccaccacgtcgaggaccaactcgcgggtgaactactcgaacgagatccacgacctctccaccgtgcagagcggctccgccgtccccaccttgttctacccggacaagtccatcgccgacatcttcccgccgcaccttgggaagaaggtgatctcggaggtggtggcgacgttccttctggtgttcgtcacctgcggggcggcgtccatctacggcgaagacaacaggcgcatctcgcagctggggcagtcggtggccggcgggctcatcgtcaccgtcatgatctacgccaccggccacatctncggcgcgcacatg

SEQ ID NO: 56370 - DNA, 270 bp, Zea mays
  Clone ID: LIB3068-052-Q1-K1-D6
cccacgcgtccgcagactcttaggctgagtccattatagaaatgtttatgccaaaaaaagaaaaaaaaacaaaataaaaaaaaaaataaacaaataacactcaccctttctactcgaacactctaacatccatctacatgcacatctatcacactcacataaagctacctaaaatcattacttagaccctttcattactaatccgttactcggaaaacccttgcctctcccaaatcaatcaacctcaatgacatattgctttaatcaact

SEQ ID NO: 56371 - DNA, 265 bp, Zea mays
  Clone ID: LIB3068-052-Q1-K1-D7
aaaaaaaataaaaaaaaataaaaaaaaaaataaaaaaaaaaaaaaaaaaggaaaaaaaaaagaaaaaataaaaaaaaaaaaaaaaaaataaaaaaataaaaataaaaaataaaataaaaaaaatgctatcctattttaaagattttaaaattaccattaccttaaattcctaactataattattacatattcgccttaaatcaaattcatttataatttttttacattctactaacttgaaaaactatcctattactaaattata

SEQ ID NO: 56372 - DNA, 322 bp, Zea mays
  Clone ID: LIB3068-052-Q1-K1-E12
cccacgcgtccggccctagccgccgcccgccgacttcatcggtgccgtcgtctagacctcgtcacgcactggagggggtaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatgggtcgttccacggaaggtgtgtgatctgtggaagagtccgcatctcagacgcttactactgcaaagagtgcaccc

SEQ ID NO: 56373 - DNA, 411 bp, Zea mays
  unsure at all n locations
  Clone ID: LIB3068-052-Q1-K1-E3
gtgtttcgctcccttctcgccctccgacggctggttggcagccggcgccggcgccgccaaacgctaggtggtgaggccttcgccagtgtcttcgacggcgacgagcacgtaccagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcaacgtcggggctaccctgacacccatctgcttgaggaacctaggggctaccctggtgttcgtgtggtcgaccataggggctatcctggcagtcgtggngttgatgaacgcanggcctatcctgagctccatcaaggctcac

SEQ ID NO: 56374 - DNA, 335 bp, Zea mays
  Clone ID: LIB3068-052-Q1-K1-E5
tccacgcgtctccccctattctccgcccgtctactccatcgctcccctggcgcaaacctcgtaaccctctgccaatgtctacgaccgacatcaacacctacccatcatacttatctcatcatgtcccctaaccagactatcatctcataaccccaccttagcgtaccatgtaatccctatagtttagtatcccactcgtacttccgcacatctactctattccgatcctacgacctactctaacattcttcgttccaagcaacgtctgtgatcccctgacacactattatctcaaacacttactacttaccctagtgcacccatcatcaaacata

SEQ ID NO: 56375 - DNA, 422 bp, Zea mays
  unsure at all n locations
  Clone ID: LIB3068-052-Q1-K1-E6
tcgtgcgcgacttttcccttgcgctatcatnnngttccattggctcagaggcgtgttcacgcgttggagaccctgggtnngcggtgtatgagtaccgactcgggccgtgtgaccggagattcgagtgccttccggagttttcaatgggcctgccggggtgcgcactcggacactcgcgcgatgntgcggtgctttcttccggcctgctggacgcctactcttccggctttgaatccgattccaggnnngttggcgggctcgttatatgcagaaagagataacctctatcccgagggcccccgcgcgtgcgtctttcggactttcctaactgtcgctcgtcttgccagccaacgtcaccggcttcgggagaatcttaacgccgatttccctttcggggtgactgcgcgttgagtcgcgctatc

SEQ ID NO: 56376 - DNA, 191 bp, Zea mays
  Clone ID: LIB3068-052-Q1-K1-E7
cggacactttcgtccactctttcgcccacttttccagacccactcctccggccacacgttgtgccactcttactgcgactcctgcgtgccgacacttccaaggtgcatcttgccatgtgcatgatcttcaactccaccaacgtcacacaagtgttctctcttatcaacagctaaatctacctcatgtactc

SEQ ID NO: 56377 - DNA, 189 bp, Zea mays
  Clone ID: LIB3068-052-Q1-K1-E8
cccacgcgtccgaaaaataaataaacatattaaaactaaaagaaaaatgagaaaaaatcctgggacaatctaaaatagtaccacacaacaaacccaatccactgcatcattattgcaaagcgccagcagtccttcaccataatacaattttactcggctaataacggcacacttggtgtattactacat

SEQ ID NO: 56378 - DNA, 449 bp, Zea mays
  Clone ID: LIB3068-052-Q1-K1-F1
ggttgcggcacacccttcggaagcaagccagtttgctctagggctgactgatggtggtgtgtttgtgttggggcctttggaatcggagagaaaatggggaaatcctccaccagtagagaatgggtctgctagcaacttgtccacaccgcctcctaatggagcttcaagttctgaccaaccagaaagatgattaagaagttggaactggtagatttttcgtggcacgagtctaaccaagaaggtatccttcaaagttaatgaaacaaattggaacttctttatttaaattccttggcatgatatgtatagaacatttatttataacgtattgatgcaatttaggagtttgacaataagctgccatgatttactcagaaatatgatcaatataatcatgtgaacatagaatatagtgtatgtttttgccaacagattaatttctcttttac

SEQ ID NO: 56379 - DNA, 328 bp, Zea mays
  Clone ID: LIB3068-052-Q1-K1-F12
accacgcgtccgaaaaaaaaaaaaaaaaatttaaaaaaaaaaaaaaaaaaaaaaaaaaaaaggaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaagagttagaagctataaagaactaaatctaaacaccacaacttcgcaacactaaatctttaaaaaatgcccacaaaaataaaatcaaaatcaaaggtttataaaatactaggatgaataaaaatcggggagcacccaacaaaaatggaaaactaaaaaataccattaaaa

SEQ ID NO: 56380 - DNA, 262 bp, Zea mays
  Clone ID: LIB3068-052-Q1-K1-F2
ccgtgtggttcgttcttccaggcctggcactactccacatttggttctggaggaaagagtggcaaggtgcgatggtcatctggatggtagcacggcccaacccgagccactgctcgtgatggcaaaccgccagcggtccttggccggcgtacagttttactcggctaaaaccggcccccttggtgtattaccagattaccaacaaccttcgacgcagccccagaattcacatcccaaccgtgtgtaaaggttgtctgatccc

SEQ ID NO: 56381 - DNA, 212 bp, Zea mays
  Clone ID: LIB3068-052-Q1-K1-F4
gttcgacgcacgcgtcctaccgtacgcacctagcttctaatcataaattcgttccacacctacctacgtccctcgtccgagctttaacatcttgcgcgcaccccacaaaacttaactactagccatgatcacagatctatatgctctcatcaaatatggcttaataattcacttaaaacatcttaccctctaataaaattaccagtatattt

SEQ ID NO: 56382 - DNA, 451 bp, Zea mays
  unsure at all n locations
  Clone ID: LIB3068-052-Q1-K1-F5
cccacgcgtccggtcggttcacttctccaggtaaggaaagggttcgtactcatggcgccggcgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaaggacgaagagagaggagatggcgggcgtgctcangaagatgaggtcggcttgtacgcacactgacaagangaaatagagagcatttaagttcatggagcctgcagagaatatgttcagtgtctgattttcatacatgtag

SEQ ID NO: 56383 - DNA, 441 bp, Zea mays
  Clone ID: LIB3068-052-Q1-K1-D12
ccaacgactactaacacgaaaccgagtgagtattcgttaagctatattgatcatttgatgggtctcattcgaccgtggaaacctctatcttatactacatccaccaaacaatatactgaacacggatctgcatatgactaagggcacgacaatggcgcaccggacaccgtgcgatgtgcggtgctcttccggccgctggaccctacctacggctgaaccgattccatagatggccgaccgttaagcacacatgataactcttcctgaggcccctatcggcgtatccagacttactaacgtggccgtctgtctccacgtcccggctcgggaaatcttaacccgactccctttaatgtgactcgcgtgatcgcgctatctgccaggtttcctcaatcccttaagatcggcttacatatgtgcaagtgccattcacatggaacc

SEQ ID NO: 56384 - DNA, 444 bp, Zea mays
  unsure at all n locations
  Clone ID: LIB3068-052-Q1-K1-F8
agcgtacgcgcctagcgaccagcacagattcgttccacgcctacctcgggccctcgcccgtgctctcagatctcgcgcgcgccccgcaaagggtaactttgagccatgggcacagttgtggatgctccagcagttgtggctgaagaggtcactgaaaacatgttgggtggtaagaaagttacagttgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgacctataaagctgtgcaggagggcaatgataanaatgaaaatgacaattcctgatcgaacggatttcaaggaatg

SEQ ID NO: 56385 - DNA, 454 bp, Zea mays
  Clone ID: LIB3068-052-Q1-K1-G10
cgaagagaaaagagaagaacctctatccggaagcgaaaaggaccagaagaaaccagaggcgactccaggttcgtgggcgatgctgcgcgcgggaggtaggcagctccttgccccggggctccggcggctcggtctgggcaccggcgccgccggtgaggtgggcccggccgccgcggcggcggtgatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatc

SEQ ID NO: 56386 - DNA, 423 bp, Zea mays
  Clone ID: LIB3068-052-Q1-K1-B2
cggacgcgtgggccgcgaccgggagagagtcagagagagacgcccgcctccagatcgtccggcggcgatggcggcgtcggtctttccagcgctgctgctggccgtagcggcggtgcttctcctaccggtggcagaggccgtgtggctcgagctcccgccgtctgggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgcttcaacgggccagtttgcattcaccacttcagaagctggaaactaccttgcatgtgtctggatagacagcgtggacaaaggatcaggaacatctctaaatcttgattg

SEQ ID NO: 56387 - DNA, 390 bp, Zea mays
  Clone ID: LIB3068-052-Q1-K1-B3
accaatccttcccccttacactggatagagttagagctagacttccaactccagatcgctcgtaccctatgggggcatacgactttccagctctacttctgctcatatcagcactccttctcctaccggtaacagatgccccgtcgctcgaactctcgccatctgacaccaacttcctctccgatcagatccatcccaacgtcctattgcatcccgactacgctatcatctacgattcccaccccacctatcatcccaccttacgccttcaagtaatacatctaccatattgccacatactgtgcactcatattataaatacacttcatcagtcctgttagcattcaccacttcagaagctctaaactaccttgcatgtttctggatata

SEQ ID NO: 56388 - DNA, 412 bp, Zea mays
  unsure at all n locations
  Clone ID: LIB3068-052-Q1-K1-B4
cccacgcgtccgcccacgcgtccgcgatttcattcaagaataaacttaacatgcgttaatgatgaaactggagtggttgacccgaagaagttcagcgttctgggtaactggcagcgtgattactcaatggaatacatcctaacccatctcaagaaagagatgacatcgccacagaaccgcaagctagttcagcctccggaagggacattcttctaaagatggcagcaactcatgtccatccatggtgactcggaaacagctttcgcacctggttcctatantttatatatttagtctgatctcccagttatctgtaaaccaccgagatcgagtgcaagcagacttggttgatttacaatttgcccggtgggtgctaatgatatgggatgaaacggttgccggtttggctgct

SEQ ID NO: 56389 - DNA, 449 bp, Zea mays
  Clone ID: LIB3068-052-Q1-K1-B5
gggaaacttggctatggaaagagtgcaactggaaatagcatccttggaggggaagcatgggtatcagaatattcacattctggtgttactaatacttgtcagctgggaagcactaccctgatggactgccggaccatcaatgttattgatacaccagggttatttgatatgagcattgcatcagacgatgctggtaaagagattgttaaatgtatgaacatggctaaagatgggatacatgcagttctaatggtttttagtggcacatctcggttttctcgagaggatgcaagtacaattgagactattaaggtcttttttggagaaaagattgttgaccacatggttttagtttttacttatggtgatctagttggtgaatctaagttgaagaacatgctcaatgatgcgccagagtatttgcagaatgttgatgagctatgccaaaa

SEQ ID NO: 56390 - DNA, 421 bp, Zea mays
  Clone ID: LIB3068-052-Q1-K1-B8
gtcaaggccaagatccaggacaaggagggcatgcctccagaccagcagcggctcatttgggccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcatcggctcatttttgccggcaagcagctcgaagacgggcgcacgctggccgactacaacattcagaaggagagcaccctccacttggtgctgcgtctcaagggtggcatgcagatcttcgtgaagacacttactggcaagacgatca

SEQ ID NO: 56391 - DNA, 428 bp, Zea mays
  Clone ID: LIB3068-052-Q1-K1-C1
cgttcgaagcattcgagcggacaagaatgaaggccttcttcagctaccttttgacaaagccctcctcgctgatccatcgttccgcccacttgttgacaaatacgcagcggacgaggacgctttctttgctgactacgccgaagcccacctgaagctttcagaattgggatttgctgaggcgtaacgaaccagaagagtgtggtggctgtcgccggccggccttgtgtttttgttgtctgcttttctcttgaacgaagatgtgatgaactcagctgaagatgtagtgtgtatgttgtcatggtttatttttctattttatttatctatctataatatctatcggagaaaaaaaaattaataaaatctttttttaactttttttatattctgtattataatagtaatttctttttttttattaaatataa

SEQ ID NO: 56392 - DNA, 452 bp, Zea mays
  Clone ID: LIB3068-052-Q1-K1-C11
gtagtcatatggctgctgttgtgaaggctaaacctaaaactgaaccaccgcctgacagagcggaaccaaatagggaagcagttgggccagcacagttgactgttaccttgttatctaatgctgaagaaagtgcagacaatgtggttgtggatatcgaaagaccacataacaggcagattaatgggatcccagcatctaacgcagtgcctaggtcatcagaggatattgaggatggtgaggtcgttggaatcatcacacttgaggatgtatttgaagaactcctacaggaggaaattgtggatgagactgatgaatatgttgatgtccataaaaggatccgagtagctgctgctgctgctgcatcatcggttgcaagggctccatccgttaggagattaacgggccaaaaggctgcaaaccttcagggagcacagaatcgccaaggacagcag

SEQ ID NO: 56393 - DNA, 434 bp, Zea mays
  Clone ID: LIB3068-052-Q1-K1-C12
gtagtcatatggctgctgctgtgaatgctttacctaaaactgaaccaccgcctgacagaggggaaccaaataggggagcagttgggccagcacagttgactgttaccttgttatctaatgctgaagaaagtgcagacaatgtggttgtggatatcgaaagaccacataacaggcagattaatgggatcccagcatctaacgcagtgcctaggtcatcagaggatattgaggatggtgaggtcgttggaatcatcacacttgaggatgtatttgaagaactcctacaggaggaaattgtggatgagactgatgaatatgttgatgtccataaaaggatccgagtagctgctgctgctgctgcatcatcggttgcaagggctccatccgttaggagattaacgggccaaaaggctgcaaaccttcaaggagcacag

SEQ ID NO: 56394 - DNA, 392 bp, Zea mays
  Clone ID: LIB3068-052-Q1-K1-C2
gtcgtcaccagcagggtgtcccggccctctctagtttctaccccggcccccaacattggcgtgatgctgctgcgcatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgtgggagagaagatggtaatggagtgcgtgtgtatgtatgtgtatgcccagggcgcgcgcgcgcggctctgggcgagtcacagtagagatgcaatatcatgtatccagtatcttttctacaacac

SEQ ID NO: 56395 - DNA, 423 bp, Zea mays
  Clone ID: LIB3068-052-Q1-K1-C3
gaaaggttttcatgatatggcagaggcaataaataacgattgtcaaaaatccttcctttttctttcatttgaaaagtgcataaaaattatattgccaattccattttaattatattcttttttcttaatgttaataaaaaaaagaagaaaattctggttttttctttccaaaattcgatataggctgaaagacaatcagatcttttttctcttcagcgggcagttccatatagaatttgttagaataaaacaagcgggttaaaaaaaaaaactctttttttttatttatccacaaagcaaaaaaggttcttatcaaacccacaataaaatgggaaagaaagataaagtaagtagacctgaccccttgaataatgcctctatctgctattctgatatataaattcgatgtggatgaaattggtg

SEQ ID NO: 56396 - DNA, 333 bp, Zea mays
  Clone ID: LIB3068-052-Q1-K1-C4
gcccgggcggcttctgggtgctctccggcccgcccgtcaactacgagaaccgctggcacggctggaacacgaccgcgcaggcgcagaaggccgacctggacaggctcaagaagatgctggccagcatgtgcttcaagctctacagcatgaagggggacatcgccgtgtggcagaagtccgccgacgcctgctacgacaagctcaccccggtcaccacgcccgccaagtgcgacgacagcgtcgaccccgacgccgtctggtacgtgcccatgcgctcctgcgtcacggctcccagccccaagtacaggaagctggggctcaacgccacgccca

SEQ ID NO: 56397 - DNA, 320 bp, Zea mays
  unsure at all n locations
  Clone ID: LIB3068-052-Q1-K1-C5
tcccactcgtccacccactcttccacnaatttgtaaaatacctccttatcgtacgatttcgcaaattcataaacattatcattccaattccatatcaaacatattctctcctctcaacattaataacaaatataacaaaattctcattctatctttccaaaactctatatatcctgaaacacaatcacatcttttttatcttcacccctcatttccatatatacattgttacaatcaaacattctaataacaaaacacaactctatttatttatttatccactactcaaaaaattttcttattaaaccaactataaaatc

SEQ ID NO: 56398 - DNA, 223 bp, Zea mays
  Clone ID: LIB3068-052-Q1-K1-C6
cccacgcgttcggacgagttcaagaaggaggagaagcagcacaagcacgggcagcacctgggcgaggcccgcaccattgccgactgcgccttagcactctacgagaagcaccaagctaaaaacgaccctgaacactcgcaccgacacaagatcgaagaagaagtcccagcggctgctgccctcggcttcagcggctttgcctttcacgagcaccactagaaga

SEQ ID NO: 56399 - DNA, 457 bp, Zea mays
  Clone ID: LIB3068-052-Q1-K1-C9
cccacgcgtccgggcggcgccggcgtgcttgtgatctcaacccaagtcgtgcctccgctccggtcacccgtcggtccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcgtgccaccggaggcaacaagaccaagaccccaggacctggtgcccagtctgccctcaaggcgcttgctcgttccgggatgaaa

SEQ ID NO: 56400 - DNA, 182 bp, Zea mays
  Clone ID: LIB3068-052-Q1-K1-D1
aaaaaaaaaaaaaaaaaaaaaaaaaaaaaattaaaaaaaaattaaaaataacaagacctctggttacatccggggtcatgctacctcgtatcctattctataatatcacctaatttcactccaaaattcatccacttacacctccttttacaactaaaaccctgacattacccaacttattc

SEQ ID NO: 56401 - DNA, 262 bp, Zea mays
  Clone ID: LIB3068-052-Q1-K1-D10
gggtcgaccgcgacgcgtccgcccacgcgtccgtagatagtgaactgacaatccacatgacaggtgttaagtatgaacttggccctgctgattccgcaggtgctaaccaggagttgatcattgatggcaagcatggcgaagaacctgatcctgatgatactcgtcaagatgttttaaaatctggcaatgggacagatatgataacagaacagagtggaaattccatggttctgaaagctgaacctgatcctgacgatcatgt

SEQ ID NO: 56402 - DNA, 148 bp, Zea mays
  Clone ID: LIB3068-052-Q1-K1-B12
ctgtattgcaggatgttgcgctaatactgtggtcgatttgcgatgtttgttctgtatcggatgatgtttccttagtaagctgcttgaatagatcatgctcaatgtaccattatttacactggagactagacaaaaacaatcgtttgat

SEQ ID NO: 56403 - DNA, 232 bp, Zea mays
  Clone ID: LIB3068-014-Q1-K1-C4
cggacgcgtgggtagtatgtgagtcatattagactgaattagcgattttatgcgccagttgttgcctcgactaatgggtcctgttccattttgtaatcacctatgcatgtttactgtatcaatttggtagattactattgttccatgttgtcttccacaacatactggactggttcagcggctagtttcctattcaaccatttcgtaatgaacgaggtattggtatttaggt

SEQ ID NO: 56404 - DNA, 387 bp, Zea mays
  Clone ID: LIB3068-014-Q1-K1-C5
cggacgcgtgggcggacgcgtgggcgcgagcaaaaggcggcaggaatggcagccaaaacaggcggcggaggaggaggaggagacgtccggtgccgtcccaacggaggaggaggagtcgtatccgaaaagagatgaggccgacggcaaaccgtctgcagaggcagagacgacgacgagcaaggccgtgtgcaacacggacggccccgtgtccgagacgtgcgacctggacggcgacgtccgcacgaacggcagcgccctatcggtgacgttcgtcccggcgagcccgtcggagcggcgggagtggaaggtccggccgtactcgcgccggaccatggtgggcgtcgacagggtcaccgtgacgcggctggggtccccggatgacccggc

SEQ ID NO: 56405 - DNA, 437 bp, Zea mays
  unsure at all n locations
  Clone ID: LIB3068-014-Q1-K1-C6
cagaccatggacccctgcaactcctccgtcggcaccatcgcctacatgagccccgagcggatcaacaccgacctcaacgacggcagctacgacggctacgccggcgacatctggagcttcggcctcagcatcctcgagttctacttgggcaggttccccttcggggagaacctcggcaggcagggcgactgggccgcgctcatgtgcgccatctgctacaacgacccgcccgagccaccgaccaccggctcgcgcgagttcagggggttcatcgcctgctgcctgcagaagaacccggccaagcgcctcacggccgcgcagctgctgcagcaccccttcgtcgccggcccgcacccgcagcccctcgctgctcctnccccgtcataaccacaccaccatttcggcgggttgggagttgggaccaaagtacggatctc

SEQ ID NO: 56406 - DNA, 404 bp, Zea mays
  Clone ID: LIB3068-014-Q1-K1-C7
gccctgcacactccccgcccagccgcaccagcaccagctcagctcagctcagcagtcatggctcgcccctgcagcagcagcagcagcgccgctgcccgcctcctcctcctgctcgccgccgtcgcagcggcgctccaggccgcgggcgccgcgccgccggtggccagcggcttcatccgcaaatcctgccgcgcgacgcagtacccgtcggtgtgcgagcagagcctcgcggcgtacggaggctccccgccgccgcggagcccgcgggagctggcgcacgccgcgctggcggtgagcgcggaccgcgctcgggcagcgtccgcgtacgtcggccgcctgtgcggctcccggtccggatccggcgacggcagcccccgccgcggcgccggcgcgaagaaggggtc

SEQ ID NO: 56407 - DNA, 388 bp, Zea mays
  Clone ID: LIB3068-014-Q1-K1-C8
gccatgcacactcccagcccagccgtaccagcaccagctcagctcagctcagcagggatgggtcgcccctgcagcagcagcagcagcgccgatgcccgcctcctactactgctcgccgccgtcgcaacgacgctacaggccgcgggcgccgcgccgacggtggccaacggctacatccgcaaatcctgccgcgcgacgcagtacccgtcggagtacgagcagagcctcgcggcatacggaggctacccgccgccgcgatagcccgcacgagctggcgcacgccgcgctggcagcgagcgcagaccgagctcgggcagcgtccgcgtacgacggacgcctgtgcggattccggtccggatccggcgacgggagcccccgccgaggcgcc

SEQ ID NO: 56408 - DNA, 405 bp, Zea mays
  Clone ID: LIB3068-014-Q1-K1-D1
cccacgcgtccggcgttgccaagccgtcggcgtccaacgatatcctgtctctgaacctcagctacgcgtgctcccaggtgagctgcggcgtgatccagaagggcgggccgtgctactacccggacaacctggtgtcgcgcgccgccgtcgccatgaacctctactatgccgccaatggcaggcacccttggaactgctacttcaacaactcggcgctcgtggtgcagtccgatcccagctatggatcctgcacctactactgatgtctgtctgatgctctgctgtgctgtgttgtgtctagagatgacaatggggatatccctagttgcgtcctagtagaagtgtctcttgttccatccagttgatatgcatgataacatttggagatgcgtgcatgtgattttt

SEQ ID NO: 56409 - DNA, 339 bp, Zea mays
  Clone ID: LIB3068-014-Q1-K1-D2
cccacgcgtccggcgttgccaagccgtcgtgtttacaacgatatcctgtctctgaacctcaggtacgggtgctcccaggtgagcggcggcgtgatccacaatggcgggccgtgctactacccggacaacctggtgtcgcgcgccgtcgtcgccatgaacctctactatgccgccaatggcaggcacccttggaactgctacttcaacaactcggcgctcgtggtgcagtccgatcccagctatggatcctgcacctactactgatgtctgtctgatgctctgctgtgctgtgttgtgtctagagatgacaatggggatatccctagctgcgttctatta

SEQ ID NO: 56410 - DNA, 401 bp, Zea mays
  Clone ID: LIB3068-014-Q1-K1-D3
cccacgcgtacgctgtaattgaggcaccacgccaatcagatttactgattgagttgatcaggaagctgcagcctcaggtggttgttactggcatggctcaatttgaggctatcaccagtgctgcttttgagaacctactaaacgtaacataagatgttggctcccggctgttcctggatatttctgagcatctggagttgtctagcctgccaagctctaatggtgtattgaaatatcttgctggaaagacattaccgtcacatgcagctatactgtgtggtttagtaaagaatcaggtgtactctgatctggacgttgcttttgccatttccgaagatgcagctgtatataaagcattatcacaaactattgagctattggaaggccacacttctctgatc

SEQ ID NO: 56411 - DNA, 427 bp, Zea mays
  Clone ID: LIB3068-014-Q1-K1-D4
cccacgcgtccgctgtaattgaggcaccattccaatcagatttactgattgagttgatcaggaaagtgcagcctcaggtggtggctactggcatggctcaattcgaggctatcaccagtgctgcttttgagaacctactaaacgtaacataagatgttggctcccagctgttcctggatatttctgagcatctcgagttgtctatcctgccaagctctaatggtgtatcgaaatatcttgctggaaagacattaccgtcacatgcagctatactgtgtggtttagtaaacaatcatgtgtactctgatctggacgttgctttagccatttccgaatatgcagctttatatcaagcattatcacaaactattgagctatcgtaaggccacaacttcttgatcatccagcactattatcgttgcctttt

SEQ ID NO: 56412 - DNA, 388 bp, Zea mays
  Clone ID: LIB3068-014-Q1-K1-D5
aaaaaaaaaaaaaaaaaaaaaaaaaaaaaattaaaaaaaaaaaaaaaaaaaaaaaaaaaaaggaaaaaaaaaaaaaaaaaaaaaaaaaaaaaaaataaaaaaaaaaaataaaaaaaaaaaaaaaaaaaaaaaaaaaaatgggcgtcctttttaaaggttccatttttacttccccttgatttcaatttaaattttttttttttgtgtcccttaaatcaattaccttgtccccctttttcaaacttttaaattggaaaacccctttttttccctacttaaatcccttttaaaaaattcccctttttcccattttgattattaccaaaaagtcccccaccattcgcctttccaaaaatttgccccacctaatttttaaattgtacccccc

SEQ ID NO: 56413 - DNA, 453 bp, Zea mays
  Clone ID: LIB3068-014-Q1-K1-D6
cactcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgtctgcaactgcctcaagaacgccgccaggggcgtcagcggcctcaacgccggcaacgccgtcagcatccccttcaagtgcggcgtcagcatcccctacaccatcagcaccttcaccgactgctccagggtgaactaaaacctagaccacgcgcgacg

SEQ ID NO: 56414 - DNA, 360 bp, Zea mays
  Clone ID: LIB3068-014-Q1-K1-D7
cccacgcgtgcgaccaacttcagctactgaacatcggcagcatgtgtttacagaaggtacggtgtctggtttgaggcagcattttgcatctgaaaagaaatgggcccttggtcttcagtctctagcacatccacgagaaataataagtgaagtgcttaaagcactgcaagaactgaatgtttactggaaaaagattggacactacaacatgaaatgcagatggagtcctggctgccttgagagtatgatgcataactgtgatggctatagtgcagagtctgctataattgaaactgatgatctcatagcgaaatcaacccgtatagtgaagtttgagattcagctttacaaaacgaggga

SEQ ID NO: 56415 - DNA, 450 bp, Zea mays
  Clone ID: LIB3068-014-Q1-K1-D8
cgcgtccctgtagaggacggtcggcagcgccgcgacggccgcgggatccagcccgcgcttgggggccgccgccgccgccgaggcggccgtggtcgtcggcagcactgccgccgcgcggcggcggttgcggcggcgcacgtggcagacgtagaggtggaggaagagggcgaggccgagcacggacacgaacgcggcgacctaggtggtgacgagccgcgcgttgtggcttatccccgtcgccgaccgggtgcgtgcgccgctgccgaaccacgcggaccccgggtcgctcgccttcatcgtcgtcgtcgacatggtctctgtcgtctcgtgtctgactgtcctagctccgacaggtctagctgctcggcgtgtcgcagcaggtactacgtacggtacgagccaagttgctcgggtgggtttggtggtgaatgagaagtgagaagcgacaac

SEQ ID NO: 56416 - DNA, 346 bp, Zea mays
  Clone ID: LIB3068-014-Q1-K1-D9
cccacgcgtccgatcactcgcacatgcaagcgctcgaaaaatgcgactggaaaacaggaggccgctgccgtgttaaacatagatgctcctaaacaagccttgacccaaatcgaggattgcgcgaaggatgagcgaagagacatcaagagccagctcgcagactaccctactactgataacgctcctgctgttgatgagctgaccacacctatcatggtgcaatacagacactcgtatattcatccagccccaagctacaagaaacgctacgaaaaaccatgatctttatatcaactcactgctcatgcttatcgggagtgcaacttacaagctgattcgaagaccg

SEQ ID NO: 56417 - DNA, 413 bp, Zea mays
  Clone ID: LIB3068-014-Q1-K1-C2
acgggaattaatctgctgtgtggaaaggagatttctccttaagaaactggccactctgaaggagtggtagcctgcagataagcttgctgcagcagatgttgatcgatcaatgcaattaagcatcacggatttggaaacattctgccttatcaataatgtccagtggccgttatctcttgtaatttcaaggaaggctttgacaaaataccaatttgatctttctcctattgttccactgcaagcatgttaatcgtcatctttattcaacatggccaatacaacatgcattccggtctgacatgattcttagtacaccaattctgtcgacattcaattctatagtctatacatgctccagttttgtaaattttctttctctattaactaacattttgaggttcttgaaccaaatt

SEQ ID NO: 56418 - DNA, 85 bp, Zea mays
  Clone ID: LIB3068-013-Q1-K1-H3
ggacgcgtgggcggacgggtgggcggacgcgtgggcggacgcgtgggctgctatcgaataataataaattggtgtcatgaagtgg

SEQ ID NO: 56419 - DNA, 418 bp, Zea mays
  Clone ID: LIB3068-013-Q1-K1-H6
cccacgcgtccgaatggattctagccactacaagggtgatcacacgtttgtcccagtcgctcggaagggatactggcagttcaacatgggtgatgtcctggttgatggaaagtccactgggttttgtgccggtggctgtgcagccatcgcagattctggaacttccttgcttgctggccccacagccataattactgaaatcaatgaaaagattggtgctgctggtgtagtcagccaagagtgcaagactgttgtttctcaatatggacagcagatcctagatcttttgctagctgagacacaaccagcgaagatctgttctcaggttggtctgtgcacttttgatggcacccatggtgtcagcgctggaattcggagcgtagtggatgatgaagctgggaaatcaaatggtggtctc

SEQ ID NO: 56420 - DNA, 100 bp, Zea mays
  Clone ID: LIB3068-013-Q1-K1-H7
cttacacatcgcaagcaaacgaacaaatataataaataataaaaacatataaaaagaagaaaacacaaagcatgatggaataacggcatgaacactataa

SEQ ID NO: 56421 - DNA, 410 bp, Zea mays
  Clone ID: LIB3068-013-Q1-K1-H9
acctggacgtatatcggaatagcccctactttctcacatgcttatgcaccctccaggtagaggctatcccatatcaggacagacaagaagaccgctacaataagagtcctcaacttcttgaatacaacccagtatacaagaaaactccactgcttgtccataatggaaaacccttatgtcagtccatgcttattgttgaatacattgatgacatttggtcacataattcattacttcctgctgatccctactagagaactctggcaaagttttaggttaaatatgctgatgatgacatgttttctgcaagtattgcattcttccttaacaataatgaataagagcgagaaaagagcatacagaagatatggcagcatctcaaggttgttgagaatcaacgatttggtgat

SEQ ID NO: 56422 - DNA, 230 bp, Zea mays
  Clone ID: LIB3068-014-Q1-K1-A1
aaaaaaaaaaaaaaaaaaaaaaaaaaaaaatttaaaaaaaaaaaaaaaaaaaaaaaaaaaaaagaaaaatatataaatacaaataactaaaacatactaaaaaataaataaaaaattataccttttattaatctaaaccttaattaaattaaaataaaccataaaattacactaaaaaatactcctctaacttttttacttccacaatttttttttcttccttctaattt

SEQ ID NO: 56423 - DNA, 461 bp, Zea mays
  Clone ID: LIB3068-014-Q1-K1-A10
ccctaatttaagccctacactgaaaaatggttttggtcctcatatgtgtgatgatgacaacgattgtggcaatgcagactatgttgatgatcttgatgacatttcccaagaagatacctgtggcaattatgatcctggcaatggaattgcagaagatagatctgaggtcaatggatctactcaaataaagcctccaaaatttcaaaagggtgtattacgtacaaactgtatagattgtttggatcgcacaaatgttgctcaatatgcctatggcctagctgctctaggataccagttacatgcacttggttctgtagaatctccagaagttcatttagactcccctttgtctcgacatttgatgcatttttatgaacggatgggtgacacacttgctttacagtatggtggttctgctgctcacaataagatattctcttgcaaaagagggcacttgaagt

SEQ ID NO: 56424 - DNA, 448 bp, Zea mays
  Clone ID: LIB3068-014-Q1-K1-A12
cccacgcgtccgcggacgcgtgggtgcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcatgtgcaccgacaccttcctcggcatgtgcggccccaagtgctagatcagagaggaagaacgcgcgcttgtgctagctgctatagcttcgatcttccggcgtcggccggtgca

SEQ ID NO: 56425 - DNA, 268 bp, Zea mays
  Clone ID: LIB3068-014-Q1-K1-A4
cctgtacgtcacgagctggtggaacctcggcttggaccacgttgacttcggcagcggcggcgctgagcgcgtcatcgggtgcatggagcgcaaggtggtgccgggctgcttcctgtgcgggaaaaaggacaaggccgagggcgtcgccgccatggcgctctgcgtcaagcaggagcacgctgaggctttccatgcggagctacgaagcctcaagtgacgcggagaccttacatgtttgtccgtgtttcaattttaataagagcacttt

SEQ ID NO: 56426 - DNA, 250 bp, Zea mays
  Clone ID: LIB3068-014-Q1-K1-A8
aacaaacataacaaaaataataaaatttaaatattcaaacaaaataaaaaaaatcaaggggcggatataatgacacacttagttatgcttatataaatacacctaccctatctatcttcacatctgacattattttacatgccccatatgttacattagattgtcacttaaaagcctttagacatcctactcaatcaatataaattcacgccattagctattcaaccaaacacctagatcaatttcatta

SEQ ID NO: 56427 - DNA, 187 bp, Zea mays
  Clone ID: LIB3068-014-Q1-K1-A9
gcgtccacgcgtccgaagggacagtcggcaaagcggatccgtaacttatggaaaaggatcggctctgacggttgggctcgggggtcccggacccgaacccgtcagctgctggcggaatgctcgagctgctcgcgcggcgagagcgggccgtcgagtgccggccgggggacggaccgggaacgggccc

SEQ ID NO: 56428 - DNA, 414 bp, Zea mays
  Clone ID: LIB3068-014-Q1-K1-B10
ctctctcgtctcccaacgacgcgattggcgattccatttctaccccgagacctccagccgtgcgcccgtgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacg

SEQ ID NO: 56429 - DNA, 462 bp, Zea mays
  unsure at all n locations
  Clone ID: LIB3068-014-Q1-K1-B5
gcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttcgttcttccgncgncggccggtgcatggttcacgtactgtgtgttgtgctactacgatacgtac

SEQ ID NO: 56430 - DNA, 368 bp, Zea mays
  Clone ID: LIB3068-014-Q1-K1-B6
gcttctacgagaggatatagagaggaagaacagctcgtccgagaccatgaagagcggcccgcacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggtcccaagtgctagatcagagaggaag

SEQ ID NO: 56431 - DNA, 362 bp, Zea mays
  Clone ID: LIB3068-013-Q1-K1-G7
agccgtcccgtgacatatacctaatatatttttcatcaatatgacgctcttcataggagggactcatatcaaaagcagacagacattcatgagattcaatgtcacaatgatcaacttcacatacatgaacagaaacatgaacacaagatggatcatttagccaaataaccactactacactaccataatttctaaaacagagcttcaaacaacacagaacacaatgatgcatccaaagctcaacacacaaactcaaccaatatttagattctcaataataaagccctacatatatccaaggaattcaccccaatcattatggctatcaacgatgcaaacattatggaaacacagtaacgaac

SEQ ID NO: 56432 - DNA, 256 bp, Zea mays
  Clone ID: LIB3068-014-Q1-K1-B8
cccacgcgtccgagaaataaaaaggaaaaacaaaataaaacaaaaccataaaaagcagaaaagaaaaaaaaactaatactgtaaataaaaaaccaatctaaacatgggcgtattaaacaatttaactaaagaaaatgcccatgaatgaaaacaaagacatcaacatcagacccgtcgcatctcaagtgctgcaccaactgcaacttctccatctcgtagctctacacctgcgacgacgtcaaaaaggactgccacc

SEQ ID NO: 56433 - DNA, 386 bp, Zea mays
  Clone ID: LIB3068-014-Q1-K1-C1
ggaattaatctgctgtgtggaaaggagttccctccttaagaaactggccactctgaaggagttggatcctgcagataagcttgctgcagcagatgttgatcgatcaatgcaattaagcatcacgggtttggaaacattctgccttagcaataaggtccagtggccgttatctcttgtaatttcaaggaaggctttgacaaaataccaattgatctttcgcctattgttccactgcaagcatgttagtcgccagctgtgtgcagcatggcaaatacaacaagcattccggtctgtcaagattctagggacaccaattctgcggtcatcaattctttgtcgtagcatgctcaagtttgtaaatagccttttgcattatctaacatttg

SEQ ID NO: 56434 - DNA, 369 bp, Zea mays
  Clone ID: LIB3068-014-Q1-K1-C10
gccacgcgtacgataacacattggtgtcagtctctggagcatttaagtggtctggatcaatggaagggttgagtcctagccagccggcaaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 56435 - DNA, 431 bp, Zea mays
  Clone ID: LIB3068-013-Q1-K1-F12
ctctataaaagaatttattatggcccaagtgacactttaaatgttgtcttccattgaatgtcacctatatatggaagtgctaatggtaatgggtgagaaatggagaagtatggagttggaaacttggtggcgaatgaaatctgtagtgaaagaagtgtttgtgctctagtcatttccaacgcaccattttttaccaattcgtgggcttaataaagagtgggaaaaatggctgattagcatcaatttattctatactgtaattatgataatattacttcatcacaatactgtagatttttttttatcgaacgcagaagagttgcgtatcattatactaaaaagaaaaaaggtctaaaacagaccgatacaaaccgccgaagcggtaaaagaacgaaaataaaagagggttacaagacatcagagagaacccg

SEQ ID NO: 56436 - DNA, 427 bp, Zea mays
  Clone ID: LIB3068-013-Q1-K1-F3
acgctcgagaataggcggcggtgcaggtcctcctccatctctgtcgtgggttcaacttgactgtgaatacgctgacgctacgagaagtcatcacggaaggggtctcgaagcaaggtgcaaagactcacctgccgtctctgatgggctttgctggctgggtatccatgctgctcttcctcctggtcgccggtgctgtagcaaatgaccagatcttcaccacttcaggtgtgccatttgggcggagttcgcgtgagccaagttaccgcgtcgaattccatcctgttgattcaccattccatccagagaatggtcaagaatcggtaccaatggctagtcatgatgggaaacgttataaatgctttctaccagttgaagaaactaaaaccatgaagtcaatgcttccgcaaaatgcaactaatggtataat

SEQ ID NO: 56437 - DNA, 293 bp, Zea mays
  Clone ID: LIB3068-013-Q1-K1-F4
actcgtccgacgctccataatatgcttcattccatatccttttccatctctgtctctgacatcaactgggactgttatatacactcactctgccagaaatcatcaccgaacttctctccaatcaacgtccaaatactcaccttccttctctaatccactatgctgactctatattcattcttcatcttcctcttgatcaccaacgctgtatcacatgaccagatctctaccacttcaactactccatcttaacgcattcctttaaaaccaacctatcatttcaaattccatac

SEQ ID NO: 56438 - DNA, 424 bp, Zea mays
  unsure at all n locations
  Clone ID: LIB3068-013-Q1-K1-F5
cctttctggagcagctagggttccgtcctcgatccgatccgccgagtgcacaccggctgtccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgacgccgcctcgaaggccggttccgacgacgtgggtgccgnctacgccaacagcaccgtcgcctccggtgaggacctcaagaactgtgatgcggacttcgtcaaggtcgaccaggccacgcttttc

SEQ ID NO: 56439 - DNA, 398 bp, Zea mays
  Clone ID: LIB3068-013-Q1-K1-F6
gcgccgttctggagcagctagggttccgtcctcgatccgatccgccgagtgcacacgaccgttccccactccgatcgggtcgatggccgccgacggcgagaagaacatgataaccctcaaaagctccgatggcgaggagttcgaggtggaagaggccgtggcgatggagtcgcagaccatccgccacatgatcgaggatgactgcgccgacaacggcatccctcttcctaacgttaactccaagatcctatccaaggtaatcgagtactgcaacaagcacgtacatgccgacgacgccgacgacgccgcctctaacgccggttccgacgacatgggtgccgcctccgtcaacagcaccgtcgtcttcggtgaggacctcaagaactgtgatgcggact

SEQ ID NO: 56440 - DNA, 287 bp, Zea mays
  Clone ID: LIB3068-013-Q1-K1-F7
cattggcaaacaagggtgaactgatgggcgtaaagaaagcatcgtggtagatgtgaacgagccagtagaaaaaaagcgctagctctgcactagtccaggaaaaataaggttgtttacatgcaatctttcagtgtgtgatccctgaaacaatctttgaagtttctgaccggcagaataattttatttaagtattttagttgaatcagtgtacttttttttggatattctgcactcatgaagttaaaggatcaaaacttgtttctgaatgcagaaatgttttctctgtt

SEQ ID NO: 56441 - DNA, 244 bp, Zea mays
  Clone ID: LIB3068-013-Q1-K1-F8
acccacgcatctcactcagcttataaaatatagatatcatttgtatcccatcctccacaatcacacgacggttactaactccaatctggtggatagtcatcactgaatacaagaaattcatcaccctatcactcaactatatcaaatcttccaagatcttactgtcctaatccatgatcaagcagcacttatagatcacattcattcccatatatacaatcctcttctagcgacttcctaacct

SEQ ID NO: 56442 - DNA, 420 bp, Zea mays
  Clone ID: LIB3068-013-Q1-K1-F9
cggacgcgtgggcaaagacaggttgcgtgagtatgagctcaatcttccaagttcaagacgagggacttgatgttggaagggtgtattttgtgatcctcgagatgtcccctgttacatatattgattcgagtgctgttcaagctcttaaagacttgcaccaagaatacaaagcacgccatattcagattgccatagctaacccgaaccggcaagtgtaccttctgttgtcaagatcgggcatcattgacttggtaggagctgggtggtgctttgtgcgagtgcatgacgccgtgcaagtgtgcctacagcacgtgcagaattcatcttcaaatgcgttgaagctacccgtgcaggcatcaggcgtgttgaccgattctgtttcgactcctaaaccagagcagcagcatcaaaagcagcacg

SEQ ID NO: 56443 - DNA, 432 bp, Zea mays
  unsure at all n locations
  Clone ID: LIB3068-013-Q1-K1-G1
cggacgcgtgggctagctctatagctcgagtattgcttgctctccacaagaaacaaaggagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccgcaccggctgctccttcaacggcaacagcgggagctgccagacgggcgactgcggcggcgcgctggcctgcacgctgtctgggcagccgncgctgacgctggccgagttcaccatcggcggcagccaggacttctacgacatct

SEQ ID NO: 56444 - DNA, 433 bp, Zea mays
  Clone ID: LIB3068-013-Q1-K1-G10
tcttcgcgagatcgccgccccgggtgggctctagatcccgatggcctcgcgccgccgcaccgtgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggt

SEQ ID NO: 56445 - DNA, 399 bp, Zea mays
  Clone ID: LIB3068-013-Q1-K1-G11
aaaaaaaaaaaaaaaataaaaaaaaaaaaataaaaaaaaaaaaaaaaaaaaaaaaaagaggggggaaaattcaaacaatctatggaataactcaaatttactaacacgtgcactcgatcttgattaaggcaccatagatctattgtaacataaactattgtcaataatgcaacatcataatgacctggatatcccgatcgaaacccccctttataccacttcaacaactgatttttttaacggatttaaaaatggcttgttaagattaaaccgaagaggatttcccaacaatttcgcaaactgactttacccttttgctcgccctttaagttcatctaaacccccggatgatctgtacttttccgcaattttacgcctcgaatttcaatataattcaca

SEQ ID NO: 56446 - DNA, 428 bp, Zea mays
  Clone ID: LIB3068-013-Q1-K1-G12
cccacgcgtccgaaaaaatggtgcgagaactcgaaagtgacccccatcttttctcatgcgtgctgtcgaaaggcaatttgaaggtcaaagaaatacaccactttactcaagatgatctaatgacagaagatgttttcattctggactgtcacacgagcatatttgtttgggttggtcagcaggtggatgttaaaggcaggttacaagctatggatgctggggagaaatttattgtgcttgattttcttatggaaaaccttgcccgtgaaacaccagttttcaccgttatggaggggaatgagcctccctttttcactagattcttcacctgggactccgcaaaatcactgatgcatggcaattcataccagaggaagctcgccattgtaaaaggtggaggtgctccagcattggataaaccgaaaaga

SEQ ID NO: 56447 - DNA, 424 bp, Zea mays
  Clone ID: LIB3068-013-Q1-K1-G2
agcgcacgcagcttctagaatctagaaggcaggagttggtcttcttggacaatgaagtgagtgttcaatgaggccatcattgaggagagggatcagggaatacaagagattcaacaccaaatcactgaagtaaatgaaatcttcaaagatcttgctgtgctagtccatgatcaaggagcaatgatagatgacattgattcccatatagagaatgctgttgtagcgacttcgcaggctaaaggtcagctttcaaaagctgccaagactcagaagtcgaactcttcgctgatatgcttgttattggttatcttcggcgtggtcctgctcatagtgataatagtacttgcagcataaaagcttggaaggcagctgaggttccgatgatcgagcttattgcgatgaattccttattattatttttttt

SEQ ID NO: 56448 - DNA, 433 bp, Zea mays
  Clone ID: LIB3068-013-Q1-K1-G3
cccacgcgtccggagacagaggccttatccattttggaacaagatgaggctctgcaaaggattgactcagatcaaaagcagaaagaagttgaggagattgaaagtcagaatgatgaacttcaggtagatgaacagaaacatgaagacaagagggatgatttagccaaagaaccactagtggagtaccagaatttcgaaaacagagcttcaaacaacacaaaagacaatgatgcattcaaggttgaacaaacagaggcagccaatagtgagattctcaagaataaagccctacatatatccaaggaatccaccccaagcattatggctatgaaggttgaaaacattaaggaaacaagtgaaggaactgaagaagatgatgctgccaaaaatgataacaaagatgaacaggagaatgcagaaaatgttgatatag

SEQ ID NO: 56449 - DNA, 338 bp, Zea mays
  Clone ID: LIB3068-013-Q1-K1-G4
attcccttctcgacccacacctcccatcgcacgtcccttgacaaaaccaccattctttcacctaatacaaaatccaattctatgttcggcttataaaccatgatgcgcatgtctcacactcaaatgaattcactcaaaggcaccaccactcatccagcctactgctcaattacactcatcactaccaaacttaccaaatccacacatatcaaccatagacaaactaatacatctatcttgattatatacctactgatccatttcctttcataattcacttatccatctactctcgataattaccataacaaacaagacctcatactcctaactatcta

SEQ ID NO: 56450 - DNA, 412 bp, Zea mays
  Clone ID: LIB3068-013-Q1-K1-G5
cggacgcgtgggctttagcgatggtcctgttcatggctggcgccgcgctgctcggcggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaacta

SEQ ID NO: 56451 - DNA, 353 bp, Zea mays
  Clone ID: LIB3068-013-Q1-K1-F10
attaccgcccgacccatcgtccgccttcccctaatctaaaacatttttttttattctgacctcaatatttcaaccccagacagctatctttcaatccaaacactgcccattataaaccataagactttccaaattccatatatctattcaaatgctaaccaaacttttcataactatctcctaaaatccatataacaccttatccacaatttcatacatctcaatatacttcaaccattccacattcctaccatatctgtcatcatatcactatctacttatctaacagtccatcatccctaatcataattcacttcatcaactcctacagaacatccagaattcatctactt

SEQ ID NO: 56452 - DNA, 100 bp, Zea mays
  Clone ID: LIB3068-001-Q1-K1-B9
tagagttaataattgtaggacattttattatgtattaccttaatagcatggttaacggacgtcatcaaaatgcgggcaaacctatgatagggcatagcta

SEQ ID NO: 56453 - DNA, 339 bp, Zea mays
  Clone ID: LIB3068-001-Q1-K1-C8
cccagggcaagctggtcgggtgatgggaggtagccagcctcctggctgtggcatggtgggtccaggcggctgcaggcatctcaacgtggaccactgggtgggtcagagccaggaaatggcccacctggctcttcacccccaaggttgtaccttttatgggagcagggttggggggcggagggctgctgcagatatgcaccagcctgggataccactatccaccagacctgttctgacgtcatgagtgtcaaacatgcctgccagccccgcatgagatgtcatgacaacactacgcacacccaataaagtgaatggatgacacacatcagatacaccaag

SEQ ID NO: 56454 - DNA, 368 bp, Zea mays
  Clone ID: LIB3068-001-Q1-K1-D8
aggattaacatgatttatttgattatcagtcttacaagttgctgaggttgggcaaagccaggagagtaacttcaggcgtttctatcaagtgacagcctgattagcagggccgttactgagcggagggcagtggagggcaccccaggaaccccagctcctacagcagtgttaaaacccctccttcagaggcactggatagggcgtggcccgtgacagccaggggccactccactggcttttggtgcccactgacccctttcagcagagacacaaaggcctccagaggcaccaaggaggcaggatgggctgggcaggtggaaagactggtactttctcaccgaggctctgtctctggcctcgatctcccc

SEQ ID NO: 56455 - DNA, 390 bp, Zea mays
  Clone ID: LIB3068-001-Q1-K1-E5
ttttattttttttttcttgataatttggatgtgatcttgtttttatcgcgcgtgacaaattacagtaattcaatcatgttattttaatgaattaaattaaaggtaaggtttaatggctgtttcctcctcgttaaaagtaattctgagctcacaggatcgatttaacattgtttagcctactggagcaaaattcctgatgcaggaaatgtgtcaggctctgccaaagtgatcggaatagaacctatgctaaccttcctataagcagttacctgtgggaattatgcaaaaaatcaatctcaactcaggttgaaagactcctttacgcatactgtattagttactaaagtatctgatatctacagatgtatattaaaataggatattcactct

SEQ ID NO: 56456 - DNA, 145 bp, Zea mays
  Clone ID: LIB3068-001-Q1-K1-F3
aaaaaaaaaaatctttttaaaaatggcgggtacctttaaaaaactacaacgaatacaccgtggataatgaaaaaaggaaccccaacaaaaccacacattgtattcaaaaaacaacgggggcccataaagcggaaaaaacatcacg

SEQ ID NO: 56457 - DNA, 315 bp, Zea mays
  Clone ID: LIB3068-001-Q1-K1-F9
catagccaccgtcaacatgctggggatacggaaggtgctgagcccctacgacctgacccacgggggtcggcactggggcaagttctacatgcctgagcgcgtgtagtgaggctcaggagcaggaatccgcgccttcgtgcccctgagccagtccttcgggtctttgggtacctctgatgtcataaccgacgagcagcatgtgaacagatgctctgaaaaactgtacgtcacctgtcggattcttttaagtacattatattaaagtttgagcgttagctcaaaatgaaaagactaatagacgaaataaacaataac

SEQ ID NO: 56458 - DNA, 361 bp, Zea mays
  Clone ID: LIB3068-001-Q1-K1-G2
tttgtttgctgcttttgaagactgtgttttggagaaagcaaccttgctgtgaaacagtgtggagatgtaaattttataaggctgactcttactaatcactatttcccctgtggtttgttatcagtacaattctctgttgcttaatctagagctatgcacaccaaattgctgagatatttagtagctgataaagaaacctttaaaaaaaataatgtaaatgaatgaaatatagataaactatgagataaatatcattacggcatgtaatattaaattcctcctgtctcctctgtcagtttgtgatgtgattgacattttgtagctaggttaaaattattaaaaattatagaccccaaaataa

SEQ ID NO: 56459 - DNA, 304 bp, Zea mays
  Clone ID: LIB3068-001-Q1-K1-H5
gcagatatcattaaaagtgtattacgggatttcaatactcaagaacagtgcatactttccttgagacccgtggtcacagctctcattgttgggtgtggccacgaatggaggtcactcagtcacaaccccccttaggatgaaaatgaggaatagtcaacgtaacgcccaaacgtggctctttaatccccttctaattctgaatatttcgcgtgggtttactataatgtctattaatacatatccttaatgatgataggattagacaaaaaaagtgaaaattttcgtatctaaatcttcaaatcgc

SEQ ID NO: 56460 - DNA, 153 bp, Zea mays
  Clone ID: LIB3068-002-Q1-K1-A8
cccacgcgtccgaaaaaaaaaaaaaaaaaaattaaaaaaaaaaaaaaaaaaaaaagaaaaaaagagaaaattaaaaaaataaaaatatcacaaacttatatacactaacatacaaaattttatctcttctatattttcacctaaatttaatta

SEQ ID NO: 56461 - DNA, 257 bp, Zea mays
  Clone ID: LIB3068-002-Q1-K1-A9
tctgactctttggaaaaaaaaaaaaaaatttaaaaaaaaaaaaaaaaaaaaaaaaaaaaaagaaaaaaaaaaaaacaaaaaatcataaaaaaatccaaaaattacatacacatacatacaacaatataaactcttctataatatcacctaaattaaatttactttccatctttttacaacttaatttcttttaaaaccttttctttacccaacttaatccctttgcaatacatccccttttcttcattttccttaat

SEQ ID NO: 56462 - DNA, 102 bp, Zea mays
  Clone ID: LIB3068-002-Q1-K1-B11
cccacgcgtccgaaaaaaaaaaaaaaatttaaaaaaaaaaaaaaaaaaaaaaaaaaaaaagaaaaaatgaaaaaaaaaaaaaaaaaaaaaaaaaaaataaaa

SEQ ID NO: 56463 - DNA, 332 bp, Zea mays
  Clone ID: LIB3068-002-Q1-K1-B12
ccagaaaatgcactggaagacccagagtttcaccgactgcgacatcacccaactccttcgcctcactgtcacgctcatcggagcagcgaccgccgtgcccactgttattcttactttcccgttctaccccacctattgctcctccggctcggcagacacctctgactcgctcttctgtgacaactggatgctgcccgtagagacagccaacacaggcccctgaatctccataccctcgcgctgtggagcttcccccaacactacatggacagacctcactacacatatgactcctccgtcacctacgccgacgccctaaccttcacctccaa

SEQ ID NO: 56464 - DNA, 301 bp, Zea mays
  Clone ID: LIB3068-002-Q1-K1-C5
ccagtgaaagaggaagcactgcttgtgtacatcacattaggttacaaatacaaatcaccaatagaaatccgccgaaaggaaaaggggagagaaaggaaggggaagaaagaattaataaagccacaaatgcatggatgggtacatggatggatggggcacaccaactctatgatcgtatcgaccgtgcgacattgtatggcaatgcacggcgcgcggcgcaggagcgatcgatcgccaccgtagtagcgcctagccttgtgatctcaaatctgaacgattgtgactgactctatccttcctc

SEQ ID NO: 56465 - DNA, 115 bp, Zea mays
  Clone ID: LIB3068-002-Q1-K1-E4
aaaaaaaaaaaaaaaaaaaaaaaaaaaaaatttaaaaaaaataaaaaaaaaaaaaaaaaaagaaaaaataagaaaaaataaaaaaaaaaaaaaaaaaaaaaaaaaaaaaaaaaaa

SEQ ID NO: 56466 - DNA, 51 bp, Zea mays
  Clone ID: LIB3068-002-Q1-K1-F6
aacttcattactcttctatactgccacctaaattcaattcactgcccccca

SEQ ID NO: 56467 - DNA, 286 bp, Zea mays
  Clone ID: LIB3068-003-Q1-K1-D2
cggacgcgtgggcggacgcgtgggcgaaatatcagatgaatcacactatttcatacaaatgctggggatagcctttgagcaggccactactaccatgttgattttgtaacagcttgtgcagaatcataagaaaccctaggacttgaccgcagccccttgcgcctacatgtatgcgagcattctacttggcagttcttgtaaataatataaccatacagtaacttagcattcaaaatatataatgttatggtattgaaaagaatatggcacgtaccattggttgaaa

SEQ ID NO: 56468 - DNA, 83 bp, Zea mays
  Clone ID: LIB3068-003-Q1-K1-G10
cggacgcgtgggaaaaaaaaaaaaaaaaaaaatagaaataaaaaaaaaaaaaaaaaaaaaaaaggaagggggaaaacaatata

SEQ ID NO: 56469 - DNA, 263 bp, Zea mays
  Clone ID: LIB3068-003-Q1-K1-G5
cggacgcgtgggaaaaaaaaaaaaaaaaaataaaaaaaaaaaaaaaaaaaaaaaagaaaaagaaaaaaaaataaaaaaaaaaaaaaaaaaaaaaaaaaaataaaaaaaaaaaaataaaaaaaaaaaaaaataaaaaaaaaaatgttattccatttaaaagatacaatattaacaatccttatattccaaatataaattttttttttttgttattttaaatttaattaattgcccttttttttaaaatttttaaattttgaaaa

SEQ ID NO: 56470 - DNA, 178 bp, Zea mays
  unsure at all n locations
  Clone ID: LIB3068-004-Q1-K1-A4
aagccatgtggaggagggctttagcgatggtcctgttcatggctggcnccgcgctgctcaccagggctggcggcgccggcncncancanggcatgtggagcatcatcacccggcccatgttccagagcatgctgagccaccgcggcgacagcgggtgccagggcgccttctacaccta

SEQ ID NO: 56471 - DNA, 105 bp, Zea mays
  unsure at all n locations
  Clone ID: LIB3068-004-Q1-K1-H7
cctttcatcccacnttatatctcttctatattttcacctaaattcaatttacttgccctctttttacaaactttttaacttttaaaaccctgtctttacccaact

SEQ ID NO: 56472 - DNA, 91 bp, Zea mays
  Clone ID: LIB3068-005-Q1-K1-E10
tcattcgttgacgcgcgctctagcgcttccaagccattttactccatcctgcgaccacataacggaggggtagtttcaacgatatgcaatt

SEQ ID NO: 56473 - DNA, 85 bp, Zea mays
  Clone ID: LIB3068-006-Q1-K1-B8
cggacgcgtgggaaaaaaaaaaaataaaataaaaaaaaaaaaaaaaaaaaaaaaagagagagaaaaaaaaaaaaggaggggaaaa

SEQ ID NO: 56474 - DNA, 452 bp, Zea mays
  Clone ID: LIB3068-006-Q1-K1-C11
gcactcgtacggatggaggtagttgatggtcctaatgatgtttgtgaaatgttcaccctccctggtaaaaggagcgttctcttcccacagccttatgcaaactatcaatcagcccgttttgctaatggtggtgcataccctccggaccttagtctcatcacaaatgcaaggcacaatgttcagaactatgttttcgctcttcttactggatatcatgatccacctgctggtgttcagattcgtgagggtctgcactacaatccctacttccctggtggtgccatagccatgcctaatatgcttaatgatggagctgttgagtatgatgatggttcacctgcaactgaagcccaaatgggtaaggatgtcctatcattcctttcgtgggcagcttaacctgaaatggaagagaaaaaactgatgggagtgaaatggatctttctactatcact

SEQ ID NO: 56475 - DNA, 244 bp, Zea mays
  Clone ID: LIB3068-006-Q1-K1-E5
agcgatgatggtgtaatacggctggtatgtgtttttggtttggtgtgtgcgtgcggggggtacgcgtgccgtgcgcgccctgtggctgtggctgcagtggcgtctcgttgggtgttttcttgttgtgagttgtgacgaacaaaaaagggtgtgggttggggtggtccggcgcaccgggaaatgacaggttttaatcaacttatattaacctgatgaggtgccaaaaaaaaaaatcaaaacctat

SEQ ID NO: 56476 - DNA, 64 bp, Zea mays
  Clone ID: LIB3068-006-Q1-K1-F7
attttggttcttattgcatgggatgtactgctctgtacataatcatttacatttggaccgaacc

SEQ ID NO: 56477 - DNA, 60 bp, Zea mays
  Clone ID: LIB3068-006-Q1-K1-H10
acgcggacgcgtgggttaaatttaaataaaacatcatcattattagtttaaaaaagaaac

SEQ ID NO: 56478 - DNA, 391 bp, Zea mays
  Clone ID: LIB3068-007-Q1-K1-A2
ggacgcatgctgcccgaaccaaaaccagagccaaagcctgatcctaaacccgaaccaaggccagaacctaggccaggggcaaagcctgaggcgaaaccgaaaccagatccaaagccagagccacaaccaaagccagagcctaatccagaaccaaaaccagagccaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaaacccgaaccaaaac

SEQ ID NO: 56479 - DNA, 317 bp, Zea mays
  Clone ID: LIB3068-007-Q1-K1-A8
tcttcctaaaaaaaaaaaaaaaaaaaaaataaaaaaaaaaaaaaaaaaaaaaaaaaaaaaagggaaaggaatataaaaaaatccaaacaaaacaaacacatactttcaacttcaattactcttctataatatcacctaaattcaattctctgtccttcattttacaacatcttttcttttaaaacccttcctttacccaacttaatcccctttcaacacatccccctttcaccagctttctttattcccaatattccctcacctatctccctttccaacattttctcatccttaatctctatttcaactctcccttt

SEQ ID NO: 56480 - DNA, 292 bp, Zea mays
  Clone ID: LIB3068-007-Q1-K1-B1
gcgcccacgcgttcgcggacgcgtggggaaattttgatgcttttctggagcgtgccaagcaggaaataggatggtaccaattcgttcaagctatagagttaggtcccaaaatgtgctgttattccctcctgctgacatggggtgttggtattgcgacaaatttgtgcttctatccgccgtggtcgaccttttgttcttgcaatgaggaattttcgtgatcaattgatgcaacatgatattgtaagggctaaattggctcaaaaaaaaaaaaaaaaaaaaaaaaaaaattaaa

SEQ ID NO: 56481 - DNA, 180 bp, Zea mays
  Clone ID: LIB3068-007-Q1-K1-B2
tcttcgggagcgtgggcgacggagttcaggcctctccacgaaacttcatccatgatccgtgggattctgggcgtggtgctgtgttcacaaacaccagtctgtcagtcctgtgttgtgtattctgctttccgatacagattttggaccaatcaaatcctgcattgtgttgcttgcgagcag

SEQ ID NO: 56482 - DNA, 356 bp, Zea mays
  Clone ID: LIB3068-007-Q1-K1-D4
taattttcgggtcgacggacgcatgctctcatttcgtcagcatcctctaggaccgtctcgattctttgttttaattaaactgtctgggtcccggtgtccgttccaggtctgagtcggttgttctactcccggggaaggccccctactggtccgttcctcttccgtccccacgtccggtactcttcgtaccgctttctcctttctagcagctcgaacattctctcagcattcaacgggttcggtgcctatacctcctgtcccaaccctcatagcctatccttttcccgaagttacagatcctcttttccgtctttccttgactacatttttccattggccatattcttttcaccttt

SEQ ID NO: 56483 - DNA, 200 bp, Zea mays
  Clone ID: LIB3068-007-Q1-K1-E12
aaacagaaagcatcagcctgttgggtaatttcaaaggggtcttgggtgattcattaaacagattcaactacaaactgtattcaactgcaatcattgtccataacactcaaagccttacagattcacacatcattgttaagcaagtaatttttattactcataattatatattgatgtcatcattgttacttaaacattca

SEQ ID NO: 56484 - DNA, 250 bp, Zea mays
  Clone ID: LIB3068-007-Q1-K1-E3
gcggttagagatctgcgctgccgtgtaccattgatctgggcatctgctgggtacccgtacgcggtgccgtcgatttcgacaaggaagggtaaggtgaggtggtgacccgactccagccagatgagatgagatccattgaagccgacagccgaaggttgggtgtaaaatatggagtccatgagtgtggcgtctcttctgtcccgaggtgaatgacacatactgtagatcgttgctctaaaaaaccaaaaat

SEQ ID NO: 56485 - DNA, 82 bp, Zea mays
  Clone ID: LIB3068-007-Q1-K1-E6
tcgcccactcgtccgcccactcgtccgtccactcgttcgcaccccgcctctgaagcaaatgcgatgcaattgcaatgcaagc

SEQ ID NO: 56486 - DNA, 382 bp, Zea mays
  Clone ID: LIB3068-007-Q1-K1-E9
cacggttccaagagccaccttcagctgggttccatcggagccgggacgacggcgggccgggtgtacaaggggaagaagatgcccgggaggatgggaggaaccaagaccaagatcaggaagctcaagattgtcaagatcgacaacaacctccgggtgctcatgatcaagggggccgtgccagggaagcccgggaacctcctccgcataacgccagccaagatcgtcggcaagaacatccccaagaactagacttcttttttttcaggggggtgaatgttgagtgtttgtgtttgttaccctgctacaaactggatgtaatcctttgccaatttccagtttttgaacacatgcaacttcagattagtaaaactataacctgtac

SEQ ID NO: 56487 - DNA, 93 bp, Zea mays
  Clone ID: LIB3068-008-Q1-K1-A10
acgcccacgcgtccgaaaaaaaaacaaacttatgaacaaaaaacataaaaaaaaataacataggatatgataacgaataaagtgcagaaaaat

SEQ ID NO: 56488 - DNA, 53 bp, Zea mays; identical to SEQ ID NO: 11688
  Clone ID: LIB3068-008-Q1-K1-B4

SEQ ID NO: 56489 - DNA, 372 bp, Zea mays
  unsure at all n locations
  Clone ID: LIB3068-008-Q1-K1-C10
tccgacgccgtccggcanaagggannntcagcacgccgtcccgttggggaaggggaggcttcgagggcgggcccgccgcgggggcgtgcggctcgggccgggcttggagcgcaatnnngcacgggccctttggnnggcgcgaacgcccnnntaacgtgggnntcggggcgggcgaaacgagcagaggggcgccggttggcttagcttgggattctnnggacttagagnngcgttcagtcatttaatccggcacaacggtanngcttcgcgcccactggcttttttcaaccaagcccgcgatgaccaattggtgtgaatcannacggttcctctcgtactaggggttgaattaccttatcgcggcgcggtcat

SEQ ID NO: 56490 - DNA, 55 bp, Zea mays; identical to SEQ ID NO: 5483
  Clone ID: LIB3068-008-Q1-K1-C3

SEQ ID NO: 56491 - DNA, 60 bp, Zea mays
  Clone ID: LIB3068-008-Q1-K1-E9
cggacgcgtgggaaaaaaaaaaaaaaaaaaaaataaaaaaaaaaaaaaaaaaaaaaagag

SEQ ID NO: 56492 - DNA, 74 bp, Zea mays
  Clone ID: LIB3068-008-Q1-K1-F3
aaaaaaaaaagaaaaaaaaaaaaaaaaaaataaaattaaaaaaaaaaaaaaaaaaaaaaaagaaaaagaaaaaa

SEQ ID NO: 56493 - DNA, 160 bp, Zea mays
  Clone ID: LIB3068-008-Q1-K1-F8
cccacgcgtccgcggactcgtggtcggactcgtggagaacagttcggcccatggcgatggcatagtcttaggtcaaattcttgcatttatgaaacactaacatctgctaaagcatttgccatggatgttttcattaatcacaacgccataacttggacaa

SEQ ID NO: 56494 - DNA, 57 bp, Zea mays
  Clone ID: LIB3068-008-Q1-K1-H6
aaaaaaataacacaaaatacgattttacaattatataaaaaacaataataaacaggg

SEQ ID NO: 56495 - DNA, 166 bp, Zea mays
  Clone ID: LIB3068-009-Q1-K1-B3
cccacgcgtacgagcaaacccatgttggccagcgcagcaagagaatttcgaaggaccgacacaaaatagtgcttgttagttgctgaattgtccatttaggcaacaaagtttttgaaaaccacaatatttaaaatactaaataaaaaaagaaaaaataaatgaattt

SEQ ID NO: 56496 - DNA, 364 bp, Zea mays
  Clone ID: LIB3068-009-Q1-K1-C8
ccgaatcgaagggcgacccagagcgtacccatcccgcttctttaccggcattctgtgatggctatacaagtctattcttccaaatggggtgcgctgcaaccggagcagtgctaacataacatactaccacctattccatgaaaactcgagtggagtggtaagcaacaatggtgatcccttgttttgggggatctttctgtacacgtgtaattatcgttaactcagttgtctatctataggcccatttcagcttgagttttatggataactcggcgatctatataggctcagctcacctgcaacgcacttcagttcaaaaacttcgatggtagcaaatgtttgtctgttcaaagttgtttgtatc

SEQ ID NO: 56497 - DNA, 80 bp, Zea mays
  Clone ID: LIB3068-009-Q1-K1-D3
cggacgcgtgggcggacgcgtgggcggacgcgtgggcgaacacgttgaaaagggctggagaaatttaatgatgacggcac

SEQ ID NO: 56498 - DNA, 235 bp, Zea mays
  unsure at all n locations
  Clone ID: LIB3068-009-Q1-K1-F5
cccacgcgtccgcccacgcgtgcgganactcatnnggggacggttggtttttagtggcggcctgaccacccacanaccaataanttcttancttgccaccaaattcttccgggagttcaaaataagcatatatcccgatattcccaaataggtcaacctttttaactgcctgctgaatccatgagcaggctagagacaacctggcgaacttaaacatcttattagccacaggaaa

SEQ ID NO: 56499 - DNA, 52 bp, Zea mays
  Clone ID: LIB3068-010-Q1-K1-A10
tacgtcatttctcttctatacagtcacctacattcaatgcactggctcaaga

SEQ ID NO: 56500 - DNA, 305 bp, Zea mays
  Clone ID: LIB3068-010-Q1-K1-A8
atacctcccgccccttctaaaaaacacacaataattatactaaacactaaatcttagacactgtaaaatttaataacagatcaacccaccaacccaaactacaacctaacaaatcttccatcctcatcattccccccaaacccaaccttttagccaaaaacacattcatcgcacagcttactatccaccacataaccaaaatatccataaaaatatagctattacacttacaccctcaaactcccacttatcctacacctctaaagtcatttcacaaaatcgtactataatcaaactcaacacct

SEQ ID NO: 56501 - DNA, 439 bp, Zea mays
  unsure at all n locations
  Clone ID: LIB3068-010-Q1-K1-B3
tactaatcgtcacgatacttcagatgataaaagattgttggaaatagctaacacaacacgcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctntgatgacgctggaattgacggttacttcgaattgaaagagacaccacctttttatttcaacgagcagcccaaagctatgcagatagaatgtggcaacgtggtatcagctgattgtgcgatg

SEQ ID NO: 56502 - DNA, 349 bp, Zea mays
  Clone ID: LIB3068-010-Q1-K1-D4
gcattgcgaatttaggataataatatatatatataagcatccagtccaccaatccccagtctacaatacactcacgcctaaaacacacggcacgacgctttgaaggtccatcttgagcgcgcaacactagctcactttaggggtcgaccacaaacaaaataaagcgcgctgtcaagcttgaagaaatgagaaactaagggtggtagtagcgtactatatagttagctatcactagacctcaacttgatggagaaccaccgggatgagctcatcagtgttagtgtggagaatagttgcaggagtagttgatgggcacgtgcagacgagtaactcctcttgcgaggggctt

SEQ ID NO: 56503 - DNA, 91 bp, Zea mays
  Clone ID: LIB3068-010-Q1-K1-F4
cgacccactcgaccgaccactcctacgaaaacatttaagaacaccttattatgtcaaaaaaaaaaaataattaagagaaaaagtgagacat

SEQ ID NO: 56504 - DNA, 84 bp, Zea mays
  Clone ID: LIB3068-010-Q1-K1-F5
aaagaaaaaaaaaaaaaaaaaaaaaaaaaataaaaaaaaaaaaaaaaaaaaaaaaaaaaaagagaaaataaaaataaaagaaag

SEQ ID NO: 56505 - DNA, 55 bp, Zea mays
  Clone ID: LIB3068-010-Q1-K1-F8
aaaaaaaaaaaaaaaaaaaattaaaaaaaaaaaaaaaaaaaaaaaaaaaaaagag

SEQ ID NO: 56506 - DNA, 71 bp, Zea mays
  Clone ID: LIB3068-010-Q1-K1-G8
aaaaaacaacaaacacaaactcaaaaaacaaaaaaaataaaaaaaaaaagaaaaaaaaatgaaaaaaaata

SEQ ID NO: 56507 - DNA, 74 bp, Zea mays
  Clone ID: LIB3068-010-Q1-K1-H8
ggttgctattattatctttattatatcaatatattatatctttttataacaaactgacttactaccttttaaat

SEQ ID NO: 56508 - DNA, 58 bp, Zea mays
  Clone ID: LIB3068-011-Q1-K1-A8
agaaaaaaaaaaaaaaaaaaaaaaaataaaaaaaaaaaaaaaaaaaaaaaaagggcgg

SEQ ID NO: 56509 - DNA, 294 bp, Zea mays
  Clone ID: LIB3068-012-Q1-K1-B7
gaggaactgatcacgaattcactaattgttgctgcttccggtattgctacttgggggagcgtagggctagattatattgggcccgtagctgatcaaggtactgctgcaggacaagctgtaaaatgtattcgatagacacccagaagcagaaggtaaaataagaggtactttattgcttactctatcttttatggaagctataacaatttatggactgattgtggcactagcgcttttatttgcaaaccctcttggttaatcctagtgatcaaacaaccacaatatgaaccactt

SEQ ID NO: 56510 - DNA, 409 bp, Zea mays
  Clone ID: LIB3068-012-Q1-K1-D2
cagaatatcgctttcgaggtgatgaaaaacggatatattgcaactgtcaccctcttccagtcatgagtgtgccactacatgtgctgctgctctgagctctggctgcaacaatggtggttaacctgcagaaaggaagtatgccgtacttttgtgcttcagcagcagcaatttcgagtcgaagccaactctatggggcctggtgacggtgcttggtttatggaatgggatgcagctgcgcagtcgatatggatcagcaccgtgacttgtatttgtgctgtacatcccggccgttgtacatgaactaactgtaccctgtgacctcaccttgtgtacataaatggtctttatttattggaaaaaaaaaaaaaaaaaaaaaaaaaaaaaaaaaaaaaaaaaaaataaatataaa

SEQ ID NO: 56511 - DNA, 366 bp, Zea mays
  Clone ID: LIB3068-012-Q1-K1-D7
cccacgcgtccgcccacgcgtccgcggacgcgtgggaatgatgatgataagagggcacggctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaaggaaaaaaggcttctacttctaaaaaaaaaaaggcataaaaaagcacaacgcccaagactctatgctcaaac

SEQ ID NO: 56512 - DNA, 65 bp, Zea mays
  Clone ID: LIB3068-012-Q1-K1-E3
aaagaaaaaaaaaaaaaaaaaaaaaaaaataaaaaaaaaaaaaaaaaaaaaaaaaaaaaagggag

SEQ ID NO: 56513 - DNA, 402 bp, Zea mays
  Clone ID: LIB3068-012-Q1-K1-F3
cggacgcgtgggcggacgcgtgggcagaagctacctaaacttccagccgtctcctccgcgcgcgaaaaccctagcagctccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggc

SEQ ID NO: 56514 - DNA, 458 bp, Zea mays
  Clone ID: LIB3068-012-Q1-K1-H4
aaggcacgtacgtcgacacctactcagatgcatatgcccacaccaagacgtaccactaggtcgggcttaattagaagtcggacagccacacccagcaagtctctaaatcatactacgaatcacatcctgacttcctctacatgaaagcatacgtagtgaccacctattgttttcttctcagcggacccaatgagtaactacaccatgttacgaataaaagcgagggaaaatcggatgagcaacttttgcagctatatgaaatgcactttgaaaaatcacgtcttgaggacgaaaaacacgataaaatggacttgcctacttttgcaccgaataaactcataagtaatccaatttccgaggacacgaacggaagtaagctgattttggtattcgtatcggaattagccagaagaagaaaccatgttcactgcccttcattctctggcctgactgcctta

SEQ ID NO: 56515 - DNA, 432 bp, Zea mays
  Clone ID: LIB3068-013-Q1-K1-B12
taatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggccacgagggccgaccgcaccacggcggcggcggatcccagtacggccacgagacacgcccgcacc

SEQ ID NO: 56516 - DNA, 59 bp, Zea mays
  Clone ID: LIB3068-013-Q1-K1-B8
atttggacttgtgtgaatttgtgataaaaaaaaaaaaaaaaaaaaaaaaaaaaggaggg

SEQ ID NO: 56517 - DNA, 125 bp, Zea mays
  Clone ID: LIB3068-013-Q1-K1-F1
aaaaaaaaaaaaaaaaaaaaaaaaaaaataaacaatataaaaaaatccaaaaattacaaacgcatgcatacaaaataaaaaaggctactataaaatcacctaaaatacaattcaatgaccgtaca

SEQ ID NO: 56518 - DNA, 433 bp, Zea mays
  unsure at all n locations
  Clone ID: LIB3068-013-Q1-K1-H12
cccacgcgtccgaagcgcactctagcaatggcttctgaggttgtccgccctagcgacgcggagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggngatagggc

SEQ ID NO: 56519 - DNA, 224 bp, Zea mays
  Clone ID: LIB3068-013-Q1-K1-H4
cccattttcatcttccgatccgtatagtctcgttactgtagatagcttctttgtcattgattgggatctcaacacacacgtcggtctcctgttcatttgattcattcttttacataatgatgcaatgcaattattgagatttcgaatctaaaaaaaacaaaaacaaaaaaaaaaacagagataatcacaaagacaagaaataaaatgaatatcaaaaaactaca

SEQ ID NO: 56520 - DNA, 92 bp, Zea mays
  Clone ID: LIB3068-014-Q1-K1-B12
gtagttaggggccctaatggtagtagcttctcagtttgttcatcgccgtgggattcattgggcaagatatatgtatgaaatgaataaatatt

SEQ ID NO: 56521 - DNA, 68 bp, Zea mays
  Clone ID: LIB3068-014-Q1-K1-B4
accacgcgtacgaccacgcgtgcggttgagaccgaaatgtagagattgaggagattcttcggaaaaga

SEQ ID NO: 56522 - DNA, 449 bp, Zea mays
  Clone ID: LIB3068-014-Q1-K1-E10
aagcaagccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacct

SEQ ID NO: 56523 - DNA, 381 bp, Zea mays
  Clone ID: LIB3068-014-Q1-K1-E11
aagcaagccatgtggaggagggctttagcgatggtcctgttcatggctggcgccgcgctgggcgccggggctgccggcgccggcgcgcagcatggcgtgtggagcatcatcacccggcccatgttccagagcatgctgagccaccgcggcgacagcgggtgccagggcgccttctacacctacgacgccttcatcgatgccgccagtaagttccccggcttcggcaccaccggcgacgagcagacgcgcaggcggtagctctccggcttctatggccagacgtcccacgaaaccaccggtggatgggcgactgctccggatggaccgtttgcctggggatactgccgggtgaaggaacagattcagaccgacccaccctac

SEQ ID NO: 56524 - DNA, 398 bp, Zea mays
  Clone ID: LIB3068-014-Q1-K1-F4
gcaatgaaatcgatccatactatacattacatggtacatacatagacagaaaagaaagaaaaaaaacagagaggaacaccccatctggttcacgcacgttacccagaagaaaccaccaacacagacagtagattgctgctacgctcttctttcggcttcaatctgcgaagcaaggcgtctgatcccgttgaaccggacgtccctaagaagctaaccaccccacgcaatcgagaactgactcgttcgccggcagcatgcaaatcataggccgagcgcgccgagcggcgtcttgccctgcccggcctcgaagtagaaggcgagcatggcaagcatggcgatgcgggcgtgcttgatctcggccagcttgagccgctcgagcttgtcgacgtcggggatgt

SEQ ID NO: 56525 - DNA, 65 bp, Zea mays
  Clone ID: LIB3068-014-Q1-K1-G4
aaaaaaaaaaaaaaaaaaaaaaaaaaaaaaataaaaaaaaaaaaaaaaaaaaaaaaaaaaaagaa

SEQ ID NO: 56526 - DNA, 56 bp, Zea mays
  Clone ID: LIB3068-014-Q1-K1-H2
tcaactatctaccttctctatagtcgaacctaaattcaattctactgtgccctcta

SEQ ID NO: 56527 - DNA, 236 bp, Zea mays
  Clone ID: LIB3068-015-Q1-K1-B10
gttttagatcgcgagcggccgcgaccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgcc

SEQ ID NO: 56528 - DNA, 58 bp, Zea mays
  Clone ID: LIB3068-015-Q1-K1-B11
cccacgcgtccgcggacgcgtgggtctgaagtaattgagctaaggaacgaaggtcttg

SEQ ID NO: 56529 - DNA, 337 bp, Zea mays
  Clone ID: LIB3068-015-Q1-K1-C4
acgcctacgcgtacggagagagagagagaggggaagagagagagagagagagagagatagatgtggtaacgcaagaactgttcttatgcatgcagcagccataagcattgctactagggtttcatgcggggcgaagcacttggtctctgccgtctgaacgccgtcggaatctgcgaggcctacccgagctgcgtccgtcgtcagataaggcagccgccggcacggcaatgccggatccgcttgctccgtacccagctcctccggcgccattcacgccgtccaatggggcccagagccagctcgtctgcaccgggtgccggaacctgctcatgtaccc

SEQ ID NO: 56530 - DNA, 79 bp, Zea mays
  Clone ID: LIB3068-015-Q1-K1-D11
cggacgcgtgggcggacgcgtgggaaaaaaactgaaaactataatatatagaatatatatggaaggggaaacatgaaac

SEQ ID NO: 56531 - DNA, 153 bp, Zea mays
  Clone ID: LIB3068-015-Q1-K1-E3
aaaaaaaaaaaaaaaaaaaaaaaaaaaaaatataaaaataaaaaaaaaaaaaaaaaaaaaaaagaaaaagggcaaccaatctataggataccaaacttacatacacttacatgcaacataatagctcttttatagtgtcaccttttttcaatt

SEQ ID NO: 56532 - DNA, 306 bp, Zea mays
  Clone ID: LIB3068-015-Q1-K1-F2
cgtagctatagcagtgcccggtgcggactgcgagtgacatgggctaaataaagtgtgcgtcgtctggtctggtggtggtagtggggcgcggtgccccatgtgtgccgctgcagcttgtgtctctgtgttgcttcatgttctctgtctatctactctcatgtatggcagtttgggtacgggtatatcaagcatgttcagtcttctttggttgaaaagttggctgcgttgtgggggtatgattatggatatgatcttctttatagatgcagccagttgttcaaaaaaaaaaaaaaaacaagcaagcaa

SEQ ID NO: 56533 - DNA, 267 bp, Zea mays
  Clone ID: LIB3068-016-Q1-K1-A11
taaggggattctttctttctctattttggtgctcgaaaagatcccacgtcttttttactgatataaagacaagctaggagaggatcatgatgaggaagagagagagtgaaaggagtgggagactgggcatctccccccaccattcttggcgagatcctcatcgatgttactggctggtttcaaataacatcctgtaataaaatttcttctccaaagtaaaaaaaaagatgaagaaggtacacgaagacaaagaaaaacaaacaaacc

SEQ ID NO: 56534 - DNA, 333 bp, Zea mays
  Clone ID: LIB3068-016-Q1-K1-C5
tacacgcgtacttacacttgttcttactgtttctgtgacaactttgttgacgacgatctgggtgcatcatctaacggaccgacagatgcactacgagaggcacgacccaaagaacgacccatagcacacgcattggcacaacatcgaggcgggcgctgccgtgatcactgccctattcactgccaactatgaattcaacgagcacgacgacaagaacgcggccaaagacgcggcgaaggacgcagacgcggaccacgactccgaccgtaacaaggagtggcacaagaagcaccgatcgttctgctgatcaatctatcgattgaactatctact

SEQ ID NO: 56535 - DNA, 253 bp, Zea mays
  Clone ID: LIB3068-016-Q1-K1-E3
gcgacgcacaaggagaaaccatccattgtcacaagtcatcatgaaacacggtacagggaaggagggagggaacaacgtctcagctggatctatttttttttatgagatagtacagagtagacatgggctagcggaacgcagcacgagaacgaatccacaggagggtaaaaaaaaccgccgctgctcctttgagaggaggtcggtccatcagaagagtgacgaggcgatcgcggagaccacggcgagcgcgacg

SEQ ID NO: 56536 - DNA, 386 bp, Zea mays
  unsure at all n locations
  Clone ID: LIB3068-017-Q1-K1-C5
aagcaagccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcatgcgggagctcgccgnctcttcggccagacgtcccacgaaaccacccgtggatgggcgactgctccggatggaccgtttgcctggggatactgccgggtgaaggaaccagaacagacggacccaccctactatgga

SEQ ID NO: 56537 - DNA, 74 bp, Zea mays
  Clone ID: LIB3068-017-Q1-K1-F1
aaaaatggcaaacggacatacgcatgcatgcaacagtcataactcttctatagtgtaacctaaattcaattcat

SEQ ID NO: 56538 - DNA, 124 bp, Zea mays
  Clone ID: LIB3068-017-Q1-K1-F8
aaagaaaaaaaaaaaaaaaaaaaaaaaaaataaaaaaaaaagacaaacaatctaggagaatggcaacttacaaacacatgcatgcgaaatcaatactcttctatattgtcacctaaattaaatt

SEQ ID NO: 56539 - DNA, 343 bp, Zea mays
  Clone ID: LIB3068-017-Q1-K1-H1
tccacacgagatttcttttctcttttagctcatcttatgacacctgcgttatcggtgaacttataaaccggcccagccaaactccccacctgacaatgtcttcctccctgatcggcccttctaagccgtaccttttatccaaaatgaggttctgttccccgcttccgacccaccgaataagtaaaataacttttaaagtactgttatttcacttgcacctctaagctctcacttattctacacctttcaagtcatttcacatattccaactatagttcagctcaacattttcttttttttcacttattttccctaacccctttccctttgctttggtttctct

SEQ ID NO: 56540 - DNA, 90 bp, Zea mays
  Clone ID: LIB3068-017-Q1-K1-H12
aaaaaaaaaaaaaaaaaaaaaaaaaaaaaaaaaaaaaaaaaaaaaaaaaaaaaaaaaaaaaaggaaaaaaaaaaaaaaaaaaaaaaaaaa

SEQ ID NO: 56541 - DNA, 84 bp, Zea mays
  Clone ID: LIB3068-018-Q1-K1-C1
caagagttgtacataaactactattgtccgaagcattaataaagagagagggggcaaatggggcgttggttttaaaaagggaag

SEQ ID NO: 56542 - DNA, 436 bp, Zea mays
  Clone ID: LIB3068-018-Q1-K1-C10
ggatgacttatctgtcgacttttccactatcaaccccaaaaaacccaactctgcgttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggtgactggagcaggctaccatgagacaaaagatcttctttctaaagagattcgattcggaactcttatatgtc

SEQ ID NO: 56543 - DNA, 71 bp, Zea mays
  Clone ID: LIB3068-018-Q1-K1-E5
aaaaaacataaaaaaaacaaaaaaaaaaaaataaaaaaaaaaaaaaaaaaaaaaaaaaaggaagggaaaaa

SEQ ID NO: 56544 - DNA, 144 bp, Zea mays
  Clone ID: LIB3068-018-Q1-K1-F6
aaaaaaaaaaaaaaaaaaaaaaaaaaaaaaaataaaaaaaaaaaaaaaaaaaaaaaaaggacgggcaatcataaatggctcaggcttacatactcatactttctacatacataattcttctattacctcaccttatttcattta

SEQ ID NO: 56545 - DNA, 64 bp, Zea mays
  Clone ID: LIB3068-018-Q1-K1-G7
ctgacgcgtgggaaaaaaataaaaataataattaaaaaaaaaaataaaacataaaaaaagaagg

SEQ ID NO: 56546 - DNA, 209 bp, Zea mays
  Clone ID: LIB3068-018-Q1-K1-H1
cccacgcgtacgatataaaataagtgctggatagcccactatgtccgacgtcggaggcgaccggccggagactgcggaagggaggcgtgacgccgtccgcccgttccaaacaacggccgtccgccttaaaggacccatgtttacgtccgcgctcatccaactgcatagctcttcgaatagggtctcctaagttcaatacacgggccact

SEQ ID NO: 56547 - DNA, 73 bp, Zea mays
  Clone ID: LIB3068-019-Q1-K1-G6
gactctccctgtagcgtcgcattaagctcggctgctgtggaggttacgctcatagtgaccgttccacttggca

SEQ ID NO: 56548 - DNA, 147 bp, Zea mays
  Clone ID: LIB3068-020-Q1-K1-B12
ctcacacggactaacacgatttcaggcgcgtgtcaacaacacagatctagtcttatctatgggagtcctatgcaagcccaattatctcatggacacatttaaaaatgaatgcatatttttaatgaataatggttcaaaaattaaatt

SEQ ID NO: 56549 - DNA, 457 bp, Zea mays
  Clone ID: LIB3068-020-Q1-K1-C1
tacgcctcggaatcagaggagcagcgaggaagccgaaggaggggcgaatctaagcccaattgaagcatgagggcgtcgattaatcgtcccccgacgccgagcgcggaggaggatcgggagcggcagccttctctcggagagatcattaacatcaagttggtagagactggggagaaggagaagctaatggagctactccgcgagcgactcgctgagtgcggctggagggatgagatgaaggcactctgcagggcatatgcaaggaagaaaggaagaaataatgtgacagtagatgacctcattcatgttattactccgaaaggaagagcatccgtgcctgattcagtgaaggcagaactcctgcaacgcatccggtccttccttatgtctaccacacttcggtagtcatttgtcgcgtcggttggagcctatatgtaagatcattgggaagtcgatc

SEQ ID NO: 56550 - DNA, 372 bp, Zea mays
  Clone ID: LIB3068-020-Q1-K1-D7
cccacgcgttcgccctcgcgttcggccacgcgtccgaaagccaggagggcgcagaggatgcagtatgttccgacaatcactaatcatactcaagtttggtgggttcctaatgttgttgttgtacatgaaaaggaagggatagaggttgtccatctagcttctggacgtacaatatgcaagcttcatttaaatgaaggaggccttcatgctgatattaatggagatggagttctggatcatgttcaggttgttggtggaaatggtattaaagagcagactgttgcgagtggatcaatggaagtgctgtaccctgttgggcaatcgctacatccggtgtgccagtgcgggagcaactttttaacgtctctatct

SEQ ID NO: 56551 - DNA, 369 bp, Zea mays
  Clone ID: LIB3068-020-Q1-K1-E1
aatctggaattttgggggggaacgcattcatgttctggaaatttagcagacataattaggtccctgaaactattccaaggaggagcatgattacacaccagtggggaaaaacacacacacacacacatagaaaatggatcaaatttgcgcgcgacaccaacaagcctgagatcactgcttctctatcctaccagagatctaaagaacagcatgacattatacagataggttcatgacaaagtaacaagacaggcagttgggagttgcatggacagggtaagtagtaatacactgattaatactccagttacgacagttcacaggcaaacccccttacactctgataagcatggcatgagccatgaccat

SEQ ID NO: 56552 - DNA, 100 bp, Zea mays
  Clone ID: LIB3068-020-Q1-K1-E4
gacgcgccctgttacggtgcattaatcgctgcgtgtgttgtggttactctcatcgtgatcgcttacagtggtcagttgcctatagtccatttcttttgat

SEQ ID NO: 56553 - DNA, 445 bp, Zea mays
  Clone ID: LIB3068-020-Q1-K1-H1
gacggagacggaggcggcagcggcgaggcgggcgaaggagtctctggagctggctttccagatgtcccagatcctagacaccggcctcgaccgccacaccctgtcgctgctcatggcgctttgcgaccgcggagccaaccccgaggcattggccgccctcgtccgcgagctctcctctgctgctcccccaacctccgccgcggcttcctcccccgtgagcaacggcgccgcggggccggcctcggcaattgcgcccacgttctcctccggccttcgccgtccctagggtgctgctaaaaagtctgaatggaaccggtgtagtttttcaagcaagacaagatctcgctgctggaatcgctggatgaaaaagattgcctttacaattccatgtgcgcgctgctgtggtggtgtggttcgaccacaaaacatgtggctgggttcatag

SEQ ID NO: 56554 - DNA, 106 bp, Zea mays
  Clone ID: LIB3068-021-Q1-K1-C9
aaaaaaaaaaaaaaaaaaaataaaaaaaaaatttaaaaaaaaaaaaaaaaaaaaaaaaaaagaggaaaaataaaaaaaaaaaaaaaaaaaaaaaaaaaaaaaaaaa

SEQ ID NO: 56555 - DNA, 108 bp, Zea mays
  Clone ID: LIB3068-021-Q1-K1-D12
aaaaaaaaaaaaaaaaaaaaaaaaaaaaaattaaaaaaaaaaaaaaaaaaaaaaaaaaaaggagaaaaaaaaaaaaaaaaaaaaaaaaaaaaaaaaaaaaaaaaaaaa

SEQ ID NO: 56556 - DNA, 263 bp, Zea mays
  Clone ID: LIB3068-021-Q1-K1-F11
gtgatgcgattccaagcgtgctctcggggcactgaggcgtttagggaaggacgcgcatgcacctgtgcagtgcagctgtgctaccatgaagtatttcgtgctcttgtgcgctagcttcgtttactttcgagttttcgagtaaggaataagatgcctcttgttgcaatagtgataaagctaatcctgcttgtaattacatttcgtggaatggccattccggcaacatgtccagtaaaaaaaactttttagtccataaaaaacac

SEQ ID NO: 56557 - DNA, 211 bp, Zea mays
  Clone ID: LIB3068-021-Q1-K1-H5
tactagagtaatgctactggtattataagctagatggatgtgtgcctgtatctacacgggcatggtgtttatcaatcgtgtacacagtctgtaaacggtgtatcttggatgcatgttgtcgcgagcagagtacgtaggtatgaaccgatgtgtgcgcttgtgtctgactactctatctatgtagcaatgagttgtcagtgtgtgctttgat

SEQ ID NO: 56558 - DNA, 293 bp, Zea mays
  Clone ID: LIB3068-022-Q1-K1-C2
tcttcctaaaaaaaaaaaaaaaaaaaaaaaaaaaaaatttaaaaaaaaaaaaaaacaaacactctaaaaagatccagaataacatactcatacatacaacaacataaactcttctataataaaacctacattccaattcactgaccatcattttacaacatcttaactactaaaaccctgaccataccaatcttaatatccttacatcacataccccttttttcagcatccttaatagcaaacaatccctaaccgctatcccttcccaacagttcttcatcctgaatttctaa

SEQ ID NO: 56559 - DNA, 238 bp, Zea mays
  Clone ID: LIB3068-022-Q1-K1-D7
cccacgcgtccgtttgcatgttggctatgttgtgtaagctctatttatggtggtctcgctgagacgggtatttggcttcgcagttatctagctatgtgatgtactgttgtcttgtccctgggtattatatggtacactgcagccagtaatagtaaaaaaaaaaaaaaaaagacaaaacaagaacaaaaagaaaaaaaaaaaagcaaaaaaaaaaacaaaaaagagcacatagtaaaaa

SEQ ID NO: 56560 - DNA, 223 bp, Zea mays
  Clone ID: LIB3068-022-Q1-K1-E4
attttgagatgaatattgtgtaagttatgaataaaatagttaaccactgtgccgttgtctagaaaatctgcatgacacgaataatccacgtacacggctgtactaaaaagatgatgaatctgtggtggctaaaaaaagggaaatagaaaagtctggtaataaaagttgtttctgaacaaaaaaaaaaaaaaaaaaaaaaaaaaaaaaaaaaaaaaaaataaat

SEQ ID NO: 56561 - DNA, 212 bp, Zea mays
  Clone ID: LIB3068-022-Q1-K1-G5
cccacgcgtccggaaaagttcatgacatttatatttgcagatatggacctcggtggttttggccacattaggaaagctggaatagcctttttgaactcagatttttttgctaacagtggtgttatggtgaaacaaagttttgtttgtatgtaccaacagctaaaatgtaaacacgacattatcatagttgagtacaggaataattatctctt

SEQ ID NO: 56562 - DNA, 96 bp, Zea mays
  Clone ID: LIB3068-023-Q1-K1-A6
aaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaa

SEQ ID NO: 56563 - DNA, 260 bp, Zea mays
  Clone ID: LIB3068-023-Q1-K1-E12
aaagaaaacaaccttaatctaactacttttacactacacaaatcaaaaaacccaactaaggcatggttcactccacctgaggagtactatcacaagacccatactcatactaatagaccgcggcctaaacactcggtgaatcatgatctttaattaaacactacgctcaaaaccttaaaatcccttcacatatgaacaacaccacctgtttttaaacctatcgtacttactatcatactaaatctgcatatctttcccca

SEQ ID NO: 56564 - DNA, 161 bp, Zea mays
  Clone ID: LIB3068-024-Q1-K1-E12
cggacgcgtggggaaacatccacgactctcctcccaactgttttcctaaagcgaaatgataacacttcttaataattgtctatacgattgaagctgatttgattggtaattgtaaacaacttgtctttggatctttgaagtcaaacaaagtcagttggttg

SEQ ID NO: 56565 - DNA, 409 bp, Zea mays
  Clone ID: LIB3068-024-Q1-K1-F7
cccacgcgtccgcccacgcgtccgtacaccccgtcccccaagcctccgacacctagagccgacccggccgacgtacactccaagccccaaacctccgacgcccaagccgaccccaccgacgtacaccccttcccccaagcctccgacacctaagccgaccccgcctacgtacactccaagccctaagccaccggctaccaagcctcccacgcccaagccgaccccgccaacgtacaccccttcgccaaagcctccgacacccaagccgaccccgccgacgtacaccccttctcccaagccttcgacgcccaagccgaccccgccgacgtacactccaagccccaagccttccacacacccgacgcccaagccgaccccaccgacgtacacccctttcccaaagccttcg

SEQ ID NO: 56566 - DNA, 236 bp, Zea mays
  Clone ID: LIB3068-025-Q1-K1-A7
aaaaaaaaaaaaaaaaaaaaaaaaaaaataaaaaaaaaaaaaaaaaaaaaaaaaaagaaggaaaaaaaaaaaaaaaaaaaaaaataaaaaaaaaaaaaaaaaaaaaaaaaaaaaaaaaaaaaaaaaataaaaaaaaaaaaggggcgccccttttaacggccccatgtttaattcccctttcttgcccctttttattttttttataggggcccctaatttcaattatgtgcccagct

SEQ ID NO: 56567 - DNA, 422 bp, Zea mays
  Clone ID: LIB3068-025-Q1-K1-C9
aagcaagccatgtggaggagggctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaacta

SEQ ID NO: 56568 - DNA, 441 bp, Zea mays
  Clone ID: LIB3068-025-Q1-K1-D9
tagacaggcgtcttcgtactcgcctatctccgcgacccaaagcgttcccccttctcccatggttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattg

SEQ ID NO: 56569 - DNA, 65 bp, Zea mays
  Clone ID: LIB3068-025-Q1-K1-F4
cccacgcgtccgcccacgcgtccgcccacgcgtccgaaaaaaaaaaaaaaaaaaaaatggaaggg

SEQ ID NO: 56570 - DNA, 81 bp, Zea mays
  Clone ID: LIB3068-025-Q1-K1-G5
cccacgcgtccgcccacgcgtccgaccacgcgtccgcccacgcgtccgaaaaaaaggaggaaaaaaaaaaaaaaaagaaaa

SEQ ID NO: 56571 - DNA, 81 bp, Zea mays
  Clone ID: LIB3068-025-Q1-K1-G9
gccacgcgttcgaccacgcgtgcgcccacgcgttcggccacgcgtgcgaaaaaaaaaaaagcgggagaacaaaaaaagaat

SEQ ID NO: 56572 - DNA, 66 bp, Zea mays
  Clone ID: LIB3068-026-Q1-K1-A2
cccacgcgtccgcggacgcgtgggaaaaaaaaaaaaaaaaaaaaaaaaaaaaaaaaaaagagaaaa

SEQ ID NO: 56573 - DNA, 273 bp, Zea mays
  unsure at all n locations
  Clone ID: LIB3068-026-Q1-K1-B7
tgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaaaanaa

SEQ ID NO: 56574 - DNA, 386 bp, Zea mays
  unsure at all n locations
  Clone ID: LIB3068-026-Q1-K1-D1
cccacgcgtccgggcagatcccactgataaagctgcacatagagaagaaagtctgtagcgagttcaacgattggctcgtccatattagaagaatggccaagcagattgggcaggcctccataagccaggcgtcgttggcttaccaaaagggcgaggagatgtgtgcacggcagagggaagccgaagcgcatagccatgctggaccagatgagcatctgtatgccttggacctggagaacacggaagaggaatcgacgctntattttgatctcacaccggtttatcgggcgcaccacatgcacacatgtcttgggatggaggacaagtttagagactattactacaagaacaggctgatgcaactcaacttgtacatgcagatcttc

SEQ ID NO: 56575 - DNA, 440 bp, Zea mays
  unsure at all n locations
  Clone ID: LIB3068-026-Q1-K1-D7
cccacgcgtccgcccacgcgtccgcccacgcgtccgtacacgtttatgtttcgtcctgcggcctagcttgaagtcaattttcattggatccgtgatctcgtttccaaaaaaaaaagtttgaaactggatctgagttgaagatcttggtccgtagttaccccagtaccccacctttacttagatctgagcatgtaaggtactctttttgtttccttctgcaattttatgctatgtcatttagttgtttttagtttgattgagaagcacgtgaagagtaatttcggtaaatagagaggatcggtgcttcaaaatggagtatgagtttattatgaccttttgagattccaaatactgtcgactntatgataaaatacttgaaagttgaaactgtcctttctggtaagtccgtaactctttcgaagttctgaagttgcatttgc

SEQ ID NO: 56576 - DNA, 339 bp, Zea mays
  Clone ID: LIB3068-026-Q1-K1-E6
tggttttcggcggaggtgcgggtggtggctttggaggaggcaagggtggtggttttggcggaggtgcaggtggtggcttcggaggtggcggaggttcgggtggtggcatcggtggtggactctagaggtggcgggagctcggcgcgcgcacgttgagtgcgtgcatgccatgaaattaaaaagcgatacatggagtgtgtggtacggtatggacattgctagagttacattacatcatcactagtatatataaggttgactcttatttgtaagcctaatgaaagtgaataattggatgcgttatgtaagcctactctactatatatatgcttgttttgg

SEQ ID NO: 56577 - DNA, 83 bp, Zea mays
  Clone ID: LIB3068-026-Q1-K1-F2
aaaaaaaaaaaaaaaaaaaaaaaaaaaaaataaaaataaaaaaaaaaaacaaaaaaaaaaaaaaaggggacaaccgatctaaa

SEQ ID NO: 56578 - DNA, 95 bp, Zea mays
  Clone ID: LIB3068-027-Q1-K1-C11
aaaaaaaaaaaaaaaaaaaaaaaaaaaattaaaaaaaaaaaaaaaaaaaaaaaaaaaaaaagaaaaaaaaaaaaaaaaaaaaaaaaaaaaaaaaa

SEQ ID NO: 56579 - DNA, 52 bp, Zea mays
  Clone ID: LIB3068-028-Q1-K1-B12
aaaaaaacaaaaaaaacaaaaaaggggaaatggttgaaaaaaataaaaggaa

SEQ ID NO: 56580 - DNA, 198 bp, Zea mays
  unsure at all n locations
  Clone ID: LIB3068-028-Q1-K1-D2
tattgttcgcttttccaatatagggttcgttnggtgctcaaaaaaaaaaagagaattgttaaatttaaaaaaaaagggcgcccactctaaaaaatccaaacaaaacttacccctccttaccacgtcataactcttctataatgtcccctcccttcacttcacttcccgccgttttactacatcgtaactcctaaaacc

SEQ ID NO: 56581 - DNA, 281 bp, Zea mays
  Clone ID: LIB3068-028-Q1-K1-E4
gtccgaccacgcgtccgcccacgcgtccgcccacgcgttcgcccacgcgtccgaaaaaaaggggactggttaatttaaagaagggagagcgcaacaccctccgctttaaaggatccgacgctccttacacaggcatccgaccgtcatacctcttctatagtagggccaaacattcattctactgcccgttaatttacaactgacgcgacgtgtaaaaccctgtcgtgaccgaactaaactgcggtgcaacacatttcactttcttcaggtggcgttttatt

SEQ ID NO: 56582 - DNA, 240 bp, Zea mays
  Clone ID: LIB3068-028-Q1-K1-F1
cccacgcgtccgcccacgcgtacgcttacgcgtccgcccacgcgtccggcgacgcggtcgcctacgcgtgcgagaaaaaaaaaaaaaaaaaaaaaaaaaaaaaaaaaaaaaaaaaaaaaaaggggggtcgatttaaaagaaaaaaaataaaaggcgcgtgcatgcgaagaaaaaggttttctataagggtacctaaatttaattgagtggccgtgggttaaaaatacaaaaattgggaaa

SEQ ID NO: 56583 - DNA, 275 bp, Zea mays
  Clone ID: LIB3068-028-Q1-K1-F12
cggactcgtgggaaaaaaatttaaaaaaaaaaaaaaaaaaaaaaaaaaaaggaaaaaggtaaaattaaaaaggggggccgatttaaaaaaatccaaacttacatactccttcattcaaaatcataactatttttttatttcacctaaattcaatttactttcccccgttttacaacctcgtggcttgtaaaaaccttgccttttccaacttaatcccctttcaccacattcccttttttccagctagcctaataactaataggcccccgcctttt

SEQ ID NO: 56584 - DNA, 398 bp, Zea mays
  Clone ID: LIB3068-028-Q1-K1-G10
tccacgcgtccgcccacgcgtccggttcgcccgccgccggagttcgccgggttcgtcttctccgttgcgtccgtccggatctgaggatctccattttctactagtacgtacgtgcaccgttttcgtcgttgctggatccgatgaagactcatcccctccaagatctacgtttgcaatggatggatctgcgcatccgctgacttactagtccgccttgccaacaatgagagatacatggaggagcgggagccatgggcggttgtaaaatctgaaaaaaaagtggtgagtgtgaatttggatctggtggtgagtgtgaatttggatgagtgtggtgtttttgtcccgaggtgaaagacacagactgttgtttgttgctcttgttctacaaccatgctttt

SEQ ID NO: 56585 - DNA, 368 bp, Zea mays
  Clone ID: LIB3068-028-Q1-K1-G11
catctgaggaggatggcttttgttatctccatgaatagagacgcttgtccgggtggggccttgtcctttcagtcacgggatccccagaaaagatttcttggttgtgctgctcttgcagttttgtagtagggtgtccattgtagcaatggcaggggtgaccgttgcttgggtttgttgacctgcgtagcacttaagattgtgtatctaaagttgtagggattcatgttcatgcgattatgcttggatatacggagtgacatcgtggagcataaagatgacttgtacattcgtcttgttcatcgagagtcatgtgacttttatcaaaagaaacaaatacattgtgatatcaatcacgatatatgtttttc

SEQ ID NO: 56586 - DNA, 273 bp, Zea mays
  Clone ID: LIB3068-028-Q1-K1-G5
ggaggactagtgtaataggtctgtccaaagttgcgtgtgacatatacatacacctaacccaatccaaccaacccatctgttcatcgtttcgggccctcaaccactgcaccaccaccattattattactccactattcttcgtccacctcttctcctcccattcccatagccataggacaaatattttttttttaaaaaaaaaggagattaaaatcaaaggaacagcgtaataataataacaccgaagaccttgtctgcacgcctttcttccct

SEQ ID NO: 56587 - DNA, 231 bp, Zea mays
  Clone ID: LIB3068-028-Q1-K1-G6
accacgcgtgcgcaaaaaacaaaacttctactttcaaccttagcaaataaaaattgggctgtgtttattaagaaaccagagccgacccacacatccattcaaccacatacctacactatacccacaccaaacaacaaatcactgcctgtctttttacaacttacctactgacaaaaccctttcttaacccaacttaatccctttgccacacatcctccttccaccacctta

SEQ ID NO: 56588 - DNA, 122 bp, Zea mays
  Clone ID: LIB3068-029-Q1-K1-B12
taaatatattataaaaaaaaaaaaaaattaataaaaaaaaaaaaaaaaaaaaaaaaaagggaggaaaaaaaaaaaaaaaaaaaaagataaaaaaaaaaaaaaaaaaataaaaaaggataagc

SEQ ID NO: 56589 - DNA, 72 bp, Zea mays
  Clone ID: LIB3068-029-Q1-K1-C4
cccacgcgcctaataaaaataaaaaaaaaatatttaataaaaaaaaataaaaaaaaagggaaaaagaaaaat

SEQ ID NO: 56590 - DNA, 118 bp, Zea mays
  unsure at all n locations
  Clone ID: LIB3068-029-Q1-K1-E5
ggagtgtacttcaaggttcttgcatgacaagtatgtgtgtaacatttgtgatgaacatggaggcgatccgggtaattctcgaataatcaatgaactgggtaagattgtaacanataaa

SEQ ID NO: 56591 - DNA, 202 bp, Zea mays
  Clone ID: LIB3068-029-Q1-K1-F3
tcgtctcgctccactgcgtcacgctccacgcctgtccgcaagggtgcctgaagcagtgtgcacctcggacatctggcatctgggtgcaaggtccatgtccatctatgaactctcttcatcaaccgacatcgttctgagaagtctcgccgtgcgaggtcggccatagctcgctccgcttacaacatagatagcccactcatca

SEQ ID NO: 56592 - DNA, 408 bp, Zea mays
  Clone ID: LIB3068-030-Q1-K1-E5
cccacgcgtccgtacaggctcgccgggcaagcgctgaacctgaacctggtgggcgacccggaccgggtggcgagagaccccgtggtagccttcaagacggccatctggttctggatgacgccgcagtcgcccaagccctcgtgccacgccgtgatgaccggcgactggaggcccttcgacaccgaccgcgccgcggggaggctccccggatacggcctgaccacgaacatcatcaacggtggtctagagtgcggcgaggaccgctccaccgacggcgccaaagccgccaaagaccgggtcggctactacaagaagtactgcggtatgctcggagtggggtacggggacaacatggcatgcgggagccaaaagccttacggaggatgatgacactagtagctgatctat

SEQ ID NO: 56593 - DNA, 301 bp, Zea mays
  Clone ID: LIB3068-030-Q1-K1-G12
ctgacgcgtgggtgcgtctgtggtattcgtctattacaaggatggtgccactaatgggagattcctctatttgtctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaagattggattgcttgttaaagctcaatattgttattgaagtgttaaaaaaaagtagtctatccctaaaataaaaatc

SEQ ID NO: 56594 - DNA, 259 bp, Zea mays
  Clone ID: LIB3068-030-Q1-K1-H2
ccacacgatatttctgttctcgttgagctcaggttagggcacctgcgttatcttttaacagatgtgccgccccagccaaactccccacctgacaatgtcttccgcccggatcggtccggcgaggccgggccttggagccaaaaggaggggcggtgccccgctttcgacccacggaataagtaaaattacgttaaaagtagtcggattttacttgctccccgaggcttccacttatactacaccttttaaggcattttac

SEQ ID NO: 56595 - DNA, 411 bp, Zea mays
  Clone ID: LIB3068-031-Q1-K1-G8
ccaccttctatggcggtagcgactcttcacgaacgatgggtggggcctgtgggtacggcaacctgtactcgacggtgtacggcacggacacggctgcgctgagcacggggctttttaaacaacggtgcttgttgcggccagggttaccgaatctcctgcacttaccaggcggaccctcggttttgaatccgcggaacgtcggtgaccataaccgccaccaacctgtgccctccaaactacgcgctgcccaacgacgacggcggttggtgcaacccgccgcggaagcacttcgacatggccgagccggcctggctaaagatcggcatctaccgcggcggcatcgtgcccgtcaactaccaaagggtgccgtgtgtgaagaaaggcggcgtgaggttcagcatcaacgggcgc

SEQ ID NO: 56596 - DNA, 69 bp, Zea mays
  unsure at all n locations
  Clone ID: LIB3068-031-Q1-K1-H3
aaaaaacatacgncactctttcggataacatttttacaaatcagtaaatatataaacaagggggggtat

SEQ ID NO: 56597 - DNA, 127 bp, Zea mays
  Clone ID: LIB3068-031-Q1-K1-H5
tcttctccactcgtactccacacgtccgaccacgctttcgtccactcgttcgatataaaaataaggggaaaataaaacaaatctaactaataacaaataaaaataataaaataaataaaaactaaaa

SEQ ID NO: 56598 - DNA, 301 bp, Zea mays
  unsure at all n locations
  Clone ID: LIB3068-032-Q1-K1-A6
acaaaatcgacttcggctctgatgtagtagaatttacagtagagccatcgcgaccacacgangggtctgagctaaattccaaggtgcactgaatcaccctaggcttttccattacctgtgttggttactggaaaaccagtccggtagatgcgggtttgcgcagaacgatggagtgtttttccctgcacatttgatgtctcatgttcgccaccaagtttcaaggtttgtaccacaagatccatttattaaaaagaccacacagtgagatatttaaaccattattgtgacaaattatatattt

SEQ ID NO: 56599 - DNA, 352 bp, Zea mays
  Clone ID: LIB3068-032-Q1-K1-D5
cccacgcgtccgccgcgacgcggtcactctacatcgagcacgctcgccgcaagaccgtgaccgcgatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcgagatcaagatgtatctttctttgcagtaatgaaatgttaaaatcgagatcaaaaaaaaaaaattttttttaa

SEQ ID NO: 56600 - DNA, 302 bp, Zea mays
  unsure at all n locations
  Clone ID: LIB3068-032-Q1-K1-E9
atgcgttcgtgcctactggagcagcctacattggttcgaaaggccacatgctgttcaccttgaagaggcgggtgcaggtatcgagtaccacgcgtccgtcnaccagaatgaggtaccttccgattcacaagggcgcatctgcgccgcaccaaacaccgatcgatgtgctgtgcttcatgactcgctgcaccctacctaccgatgaccctattccactattcgctggcctgtatgctcatgacatgaccctttcctaggccccatgctgcatgtacagacttactaactttttcatctgacgc

SEQ ID NO: 56601 - DNA, 432 bp, Zea mays
  Clone ID: LIB3068-032-Q1-K1-H5
cccacgcgttcgcccacgcgtccgcccacgcgtccgcaaggctgtgctcttcgaccaggccacctacgataagctgctctccgaggtgcccaagtacaagcagatcaccccatccatcctatctgagcgcctcagggttaatggatccttggcacggagggccatcaaggatctgatggcaaaggggctcataaggatggtctttgttcattctagccagcagatatacaccagggcaaccaacacatgaggggtgttttgccgtctggggaccgtatctaatctaaacgacttgatggtgctattatatcaaggttaaattaatcggggctcgaacaatcttactggtgggttgaatggtgaaaatttttgagattattgtactattttaagatcatgtttttataacatttaagaccatggtgccatccc

SEQ ID NO: 56602 - DNA, 80 bp, Zea mays
  Clone ID: LIB3068-033-Q1-K1-C1
aaaaaaaaaaaaaaaaaaaaaaaaaaaaaataaaaaatacaaaaaataaaaaaaaaaaaaagcaaacgggcaaaatcatg

SEQ ID NO: 56603 - DNA, 226 bp, Zea mays
  Clone ID: LIB3068-033-Q1-K1-C2
cacacgccttcgtacccactgcgcctacgttgaacatgtacctttaggtacccacacaaggcctaggctaatttttgatattgataagagtgctcattataaagcaatacttgcgatttatttaagaattgaccaaagcatcattaggtgtcaaaataaagaaaacccatcctagtggatccgtatggtaaggaaaaatgcctaatctattcacttaacaaacatg

SEQ ID NO: 56604 - DNA, 295 bp, Zea mays
  Clone ID: LIB3068-033-Q1-K1-D9
cccacgcgtccgcccacgcgtccgggcaaaacggatccgtaacttcgggaaaaggattgggtctgagggttgggctcgggggtcccggccccgaacccgtcggctgctggcggaatgctcgagctgctcgcgcggcgagagcgggccgccgcgtgccggccgggggacggaccgggaacggccccctctggggccttccccgggcgtcgaacaaccgactcagaactggtacgggtatatcaagcaaaaaaaaaaatacaaaaaaattataaaaaaaaaaaaaataaacaataaa

SEQ ID NO: 56605 - DNA, 296 bp, Zea mays
  Clone ID: LIB3068-033-Q1-K1-E3
agaggaagagacctaagtcattctccgcagtgcttggtacagatatgatattccttgtagcgctgtgagtactcgtcagtttgaggttcgtgtggtgatgcttgctaggtactagatgggtggtattgcttatgaatgcgatgttgtcgtgacagaactgcatttcattttgtattatggttgttcaagatgttatattaccatgaggtgaggtagcttgactgaaaaaaaaaaaaagaaaaaaaaaaaaaaaaaaaaaaaaacaacaaaaaaaaaaaacaaataataaataaaaa

SEQ ID NO: 56606 - DNA, 321 bp, Zea mays
  Clone ID: LIB3068-033-Q1-K1-F11
tccggacgatcacactcgcatccgatctattgaagatgcaatgcactccttcacgtatagggagcctctctacctaacgaatagcatcaagctaactacaaacctaccttcagcatgtgtctactagctaatcatatcgtgtgtacgagtatgaaagatgatgtactgtcaccaactcacttgtgtatgataaaggatacatgataagactatcactactaaaaaaaacatataaagaaagagcataaccaacttaaaatgtaaaaagctaaagtagaagaaaaacctaagatcaatatgaataaaaaggacgtcctcatc

SEQ ID NO: 56607 - DNA, 67 bp, Zea mays
  Clone ID: LIB3068-033-Q1-K1-G1
ctctgcttcagcatatatgtagttgtgtctactggtttttgcagttgttaaaaaaaaaagaaaaagg

SEQ ID NO: 56608 - DNA, 250 bp, Zea mays
  Clone ID: LIB3068-033-Q1-K1-G5
cccacgcgttcgcccactcattttaccattcttcccaatagatgacctcaacgccaactgtcaaaattaacaggtgttgagcttcccgtctatatctgatactacctgctactatttacatattgatgtgaattcctctgctgaagaaacactgatcaacgttatgaacccatacacaataaccaaccatcgcaagctccacacaaaggctgatcacaaacatatcctttaagccatcaaactttatagc

SEQ ID NO: 56609 - DNA, 62 bp, Zea mays
  Clone ID: LIB3068-034-Q1-K1-A5
cggactcgtgggaaaaaaaaaaaaaaaaaaaaaaaaaaaaaaaaaaaaaaaaaagggaggag

SEQ ID NO: 56610 - DNA, 288 bp, Zea mays
  Clone ID: LIB3068-034-Q1-K1-B2
gcggccatggcgctgacagccgcgtcgtcgaccggatcggcttctacaaacgatactgtgactcgcttggggtcagctacggcgaacactttgtactgcgccaaccagacgccccttcaacgggctaaattaaataagctagctacctaaccatgcatgcatgctttattattagagaacacatttagacctgatcgatatgatgatgggtatgtattactttactacacgcagatccagcaatcaagaatcaagcatattaacgcttactcaaaacaaaccaattat

SEQ ID NO: 56611 - DNA, 68 bp, Zea mays
  Clone ID: LIB3068-034-Q1-K1-E11
aaaaaaaaaaaaaaaaaacaaaaaaagtttattaaaaaaaaaaaaaaaaaaaacaaaaaggcggaaaa

SEQ ID NO: 56612 - DNA, 268 bp, Zea mays
  Clone ID: LIB3068-034-Q1-K1-E5
gtcgagcggtccgacaaaatctaaaactaataaatagatcaaaagcaaaaaatatagaggggccaatctaaaaaacgggtgcatacaaacaaaatggccagcctatattgtcaattcaagcttacatactcgtacttgcaacttcttagatctcatttggtgtaccctaaattaaattcacttgccgcctttttacaactatccgactgggaaaactctggcgttaccaaacttaatcgcttcgaataacataccccttttacgagct

SEQ ID NO: 56613 - DNA, 68 bp, Zea mays
  Clone ID: LIB3068-034-Q1-K1-F7
aacacacatccgaaaaaaataaccttatttcaaagcataatcaatacaaaatccagggggattcatac

SEQ ID NO: 56614 - DNA, 171 bp, Zea mays
  Clone ID: LIB3068-034-Q1-K1-G2
ccatctagtgattgtgtgtattgaaattgggggggaaaggctgttgtcgcaggataacaataacttgctgcctgctcagtaattatgactctattcagtttgtaattgccggtgggagtacaattatgcagctgtattgtctgctaaaaaaaaaaaaaaaaaaagagagcc

SEQ ID NO: 56615 - DNA, 150 bp, Zea mays
  Clone ID: LIB3068-034-Q1-K1-G3
gtaattgttggttaaaggttttttttggggggtatcaatatcttggttggtgtttattaattatgactctattcattttgtaatagccggtgggagtacaattatgcagctgtattgtctgctaaaaaaaaaaaaacagccaaaaaacac

SEQ ID NO: 56616 - DNA, 457 bp, Zea mays
  Clone ID: LIB3068-036-Q1-K1-A9
gcgcccacgcgtccgaagcaagccatgtggaggagggctttagcgatggtcctgttcatgtctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgc

SEQ ID NO: 56617 - DNA, 62 bp, Zea mays
  Clone ID: LIB3068-036-Q1-K1-E1
cttagcgtccgcttccttccaacgtattacctcttctaatgggtcacctaaattcaatcact

SEQ ID NO: 56618 - DNA, 115 bp, Zea mays
  Clone ID: LIB3068-036-Q1-K1-H6
aaaaaaaaaaaaaaaaaaaaaaaaaaaaaaaaaataaaaataaaaaaaatccaaacaaaaaaacggtacattcaaaaaaataagctagaatataatgtaaccataaaattcaatt

SEQ ID NO: 56619 - DNA, 290 bp, Zea mays
  Clone ID: LIB3068-037-Q1-K1-B2
aaaaaaaatcaagtaagtacggtctcatgcgctgcatgcagtgctttcgtagcaactccaagggcattggtttcattaagtaccgttgaagaggccactgtgctgttgtggagaacttccttcatgagataaatgggtccttcattagaaggcctaatttatgcgctttagctatttgttcataacttgagactcatgggttaaactcgacttgttaaagttttgatggctactttgtgctcgaaggaccatctattatgagaagattgcaattttctcactttataaaa

SEQ ID NO: 56620 - DNA, 59 bp, Zea mays
  Clone ID: LIB3068-037-Q1-K1-E6
aaaaaaaaaaaaaaaaaaaaaaaaataaaaataaaaaaaaaaaaaaaaaaaaaaaaaaa

SEQ ID NO: 56621 - DNA, 53 bp, Zea mays
  Clone ID: LIB3068-038-Q1-K1-E1
aaaaaaaaaaaaaaaaaaaaaaaaaagaataaaaaaaaaaaaaaaaaaaaaaa

SEQ ID NO: 56622 - DNA, 267 bp, Zea mays
  Clone ID: LIB3068-038-Q1-K1-E2
gaaaccgaggagcaatgataagggcgggtgtggtcaacttcgaaggcttcaaacgtggaggggccgggcatatgaagtggcttcgtgcacttggcgtgtacggagctcaatatgtgggaccttggagccacttggacttggtggttgtggcagttaaattggggtgttcacaagtgagtaatcttttttttttgtgatgacgcctagcatgtaaaaatgtgagctatgacatactgatgggttacacattttgcaaaaaaaagaatt

SEQ ID NO: 56623 - DNA, 132 bp, Zea mays
  Clone ID: LIB3068-038-Q1-K1-G12
gttctagatcgcgagcggccgctcgcgatctagagggacgcgtgggcggactcgtggtataaacaaaacttactactcgacgtcactgacagtgtcaggtacaacagaggtatacaaaaatacataataact

SEQ ID NO: 56624 - DNA, 166 bp, Zea mays
  Clone ID: LIB3068-038-Q1-K1-G6
accacgcgtacgaccacgcgtaacgaccacgcgtgcgcgatataaaacatccagggttagggacgcgtatatgcgaggtgatagatcttatatagtgtaaactaaattgaattcactggccgctaggttatcaagagcgtgaatgataaaaccctttggtgaacgc

SEQ ID NO: 56625 - DNA, 399 bp, Zea mays
  Clone ID: LIB3068-040-Q1-K1-F5
cccacatcgtccgcagaagctaccttgggcacgtcggcggccgccgcggcgactagcctcgctgccactggggctgctgcaaccgcgcctaccatggctcctgtcggtgctgctctcaccctgatcatataccatagcccatgtaccgttctgagctcgtcgaggaccacatctaaatactaatgacatgcgctgctactatatataccggtacctatgcactacgtgaaccacatcacactcgtagtacactcgtcctactagtcaatacaagttaagttccatcaccacgtcatgaaataaaagtaacgaggttgcaagcatctctgtgcgtgactgaaaacgtcgactgtatctcatgcatggaataaatttaatagattatgtccaacacgtagc

SEQ ID NO: 56626 - DNA, 80 bp, Zea mays
  Clone ID: LIB3068-041-Q1-K1-C5
cccacgcgtccgcttttaaaatgaaataaaaattaaaaaaaaaaaataaataaaaaaaggagaaggttaaaaataaaagt

SEQ ID NO: 56627 - DNA, 399 bp, Zea mays
  unsure at all n locations
  Clone ID: LIB3068-041-Q1-K1-D1
cccacgcgtccgaagcaagccatgtggaggagggctttatcgatggtcctgttcatggctggcgccgcgcggctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgncttcttcggccagacgtcccacgaaaccaccggtggatgggcgactgctccggatggaccgtttgcctggggatactgccgggtgaaggaacagaaacagacggacccaccctactatgga

SEQ ID NO: 56628 - DNA, 354 bp, Zea mays
  Clone ID: LIB3068-041-Q1-K1-E1
taatcatcagagagtcctgagctgctcatgaccgtgagctcggctagtataccagttttacactctgcagaggttgtaccctttacccacaagtcatgttacccatctgccaaggggtaacgactcccatacacctctacctaggaagcgcggcagggcaacactacgaggcctttacaaagttccactagcttccgaaaacccgctacagtttatgggaagagcacttgcaagaatctcccgtctgaccgccatcgcagctaaatcaacccgagaacctccttgcatgcaacttccctactgcccttgcccctttcgggtaaagtagtcttccactagctttcctaattagtc

SEQ ID NO: 56629 - DNA, 73 bp, Zea mays
  Clone ID: LIB3068-041-Q1-K1-E10
cccacgcgtccgaaaaaaaaaaaaaaaattaaaaaaaaaaaaaaaaaaaaaaaaaaaaaagggaggaaataaa

SEQ ID NO: 56630 - DNA, 427 bp, Zea mays
  Clone ID: LIB3068-042-Q1-K1-E11
aagcaagccatgtggaggagggctttagcgatggtcctgttcatggctggcgccgcgctgctcgcgggggctgccggcgccggcgcgcagcatggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggctggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggc

SEQ ID NO: 56631 - DNA, 355 bp, Zea mays
  Clone ID: LIB3068-042-Q1-K1-G10
ggctcatggaaaaaaggagcaactcgagatggtaatgtacaaagggtggattacaagagttccattccatgcgagcgcgattgagttcgtccatccaacaaactacgcagttattcatgctacacacagctcgcgtcccatgcgttcagaatttcagatccagagctggcaacccctcgatcaaaagagagaagaggggagggaaaaaaggttcagggtcgacagagctggcaaagttaaggagccgtctgccggggtcgtcgtcgtcttctcccctcaacagaaggacgggacgacgccgtccgacgcggctggcgccgaccccgtgggcgagaagcacgccccttcctcgtgc

SEQ ID NO: 56632 - DNA, 88 bp, Zea mays
  Clone ID: LIB3068-043-Q1-K1-A10
aaaaaaaaaaaaaaaaaaaaaaaaaaaaataaaaaaaaaaaaaaaaaaaaaaaaaaaggaagaaaaaataaaaaaaaaaggaaaaaaa

SEQ ID NO: 56633 - DNA, 81 bp, Zea mays
  Clone ID: LIB3068-043-Q1-K1-B1
tccacgcgtccgcttttaaaatgaaaaaaaaaaataaaattaaaaaaaaaaaaaaaaaaaaaaaaaggaaagggatattat

SEQ ID NO: 56634 - DNA, 203 bp, Zea mays
  Clone ID: LIB3068-043-Q1-K1-B9
cccactcgtccgcccacgcgtccgtttgttccggcctcgccgggccgatccgagcgggaggcattttcaggtggggagggtggctggcgcggcacatctgttaaaagataacgcatgtgtcctaagatgagctcaactcaaaatagacagaaatatataccgtatttgtcactgaaacaaagataataaaaacaaatagatac

SEQ ID NO: 56635 - DNA, 65 bp, Zea mays
  Clone ID: LIB3068-043-Q1-K1-G12
ctgaaaatgcttttgtggggaaaaaaattaaaaaaaaaaaaaaacaaaaaaaaaaaggggggaaa

SEQ ID NO: 56636 - DNA, 315 bp, Zea mays
  unsure at all n locations
  Clone ID: LIB3068-044-Q1-K1-B7
ccggggcgacgcacgcgnccggggccgcaccgcnggccgacccngagcncngngaagggcncgagnnggagcacgccgggcgggacccgaaagaaggagaaccangcccgagcggggcgaagccagaggaaacacaggaggaggcacgaagcgacaccgacgagcaaancgnacgccggacgngggcacaggggcgaaagaccaaacgaaccaacgagnaccagggcccccccgaagggacccgcaggagagcgggagcccacacgagancaagcggagaaagccaacagacagaggcagcgggggcgcaacgcc

SEQ ID NO: 56637 - DNA, 442 bp, Zea mays
  unsure at all n locations
  Clone ID: LIB3068-044-Q1-K1-C10
aagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgncagcaccgccgncgacaggcgcgccgnctgcaactgcctcaagaacgccgncaggggcgtcagcggcctcaacgccggcaacgccgncagcatcccctccaagtgcggcgtcagcatcccctacaccatcagcaccttcaccgactgctccagggtgaactaaacctagaccacgcgcg

SEQ ID NO: 56638 - DNA, 344 bp, Zea mays
  unsure at all n locations
  Clone ID: LIB3068-045-Q1-K1-B4
cccacgcgtccgattctctacctacccacctgtgtcggtttcgggtacaggtacccttgtgttgaaggtcgttcgagcttttcctgggagtatggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctnctncgtccctccgtaccaacaaggggtagtacaagaatattga

SEQ ID NO: 56639 - DNA, 372 bp, Zea mays
  Clone ID: LIB3068-045-Q1-K1-D3
cgggggacccacgcgtccgcggacgcgtgggttttatttcaacttctgctgttatgtctttctataatcttttaaagggaggctcacttgctctatattcttcaaagctgctagccatgtgcatcatctttattgggtcttgacacccctaagctgctcattttgtagtgtgaacatggggccacttggaaagcatgataaactaattagcattgatgacccaaatatttttctttggaacgtagacatgtcaaagaaatcaactaaggtgatctcacagggatcagatgacatgctttcaaatatgagtggtggggcttgggatccacacaatcataatttaaattgcgttaatatggcgatgcaatcact

SEQ ID NO: 56640 - DNA, 273 bp, Zea mays
  Clone ID: LIB3068-045-Q1-K1-E1
agaacacggagcttgaagcgcaaatacaggcgatgcgtgcagctaaagaggcgctgaagctacagctaacagaagctgaggcaagcgtcaaagctgctgagaagaaaggctcagacctcgagcaacagctcagtgagattgagaagaaattagttgcatcaagtgaagaaatagagttgctgaaagagcgtattcaacaagaagctgctgtatcagcagaaagaggaatgcaccttgtagaaacaatgaccagtgcagaccgatacaaaaaga

SEQ ID NO: 56641 - DNA, 76 bp, Zea mays
  unsure at all n locations
  Clone ID: LIB3068-045-Q1-K1-E4
cggacgcgtgggaaaaaaaaaaccagtaatagnaacatgaactaaatgtactgttgcgatgcccggatccagagag

SEQ ID NO: 56642 - DNA, 247 bp, Zea mays
  Clone ID: LIB3068-045-Q1-K1-F9
gggggagcgacgcgttcgaaaaaaaataaaaaataatataaaaaaattttatttttataaaaaaaaaaaaatataatggggcgggggttttataagtaccaagctttcttaccctttcttgcaacattatactttttttatagttgaacctaaattcatttcactggccgacgttttacaactttggtactggtaaaacccttgcgtaacccaacttaattgccttgaataacattcccctttctcc

SEQ ID NO: 56643 - DNA, 202 bp, Zea mays
  Clone ID: LIB3068-045-Q1-K1-H6
ccacgcgtgcgtcaaaagtccattcatacttgcgacttgactggttatttaggtgataacgatttggggaccattgtgccctgttgaactcatgtattaccttgtgaagtccgttgtgtctggtttctacctgaccgtttcgttatctgatgctgtttctttaataaacaagagaaaaacaccacctaaaaccatacaaaca

SEQ ID NO: 56644 - DNA, 429 bp, Zea mays
  Clone ID: LIB3068-046-Q1-K1-F6
gcgcgttgaggccgagctccacgagcccaccggcaggagcggttcgcttatcgtctccgcctgcgggttcggcttcgtccccgccgagttcggcttcctgtttcactccaggcagtgggaagtgggaaccacccttcgcgccggccaccgtggaggcgtacgtgagcctgcaggtggtgtttggtttgatgaatcatattcctcaaatttggtagatgagcccattcatattagaaatttggtggatgagcctattcatattagtactaactaactatgagaaatgaggtgttgatggatcaacttattacattccacaaaccaaatgaaaaaaagtgaggagtgagaactagctcgttcatcaaagaacaccctataaaagaattgtcattgacatcagcacctacgaatcagccacgctcgaagtag

SEQ ID NO: 56645 - DNA, 212 bp, Zea mays
  Clone ID: LIB3068-046-Q1-K1-G12
cccacgcattcgtcgaaccatctagtaactgtttccttccgaagtctccctgaagatatcatggggcacgtacaaattataatcgggtaaagtcaatgattagaggcatctggagcgcaacgccctcgacctattctcaaactttaactacgtatgacggctcggctgcttcggagagccgtgccacggaatatggagcttcaagtagtcca

SEQ ID NO: 56646 - DNA, 252 bp, Zea mays
  Clone ID: LIB3068-046-Q1-K1-G6
tcggcttctacgagaggatatagagaggaagaacagctcgtccgagaccatgaagagcagccgacacctggtgctgatcctgtgcctccaggccgttctggtcatgggcgtattcgccgatttggctaaagaaaatgccctggctgagagcaaggccatcgacatcaacccgtttcagctcatgtgctgcaccaactgaagcttgtacttatcggggctctacacctgcgaccacgctgaatgggacatggg

SEQ ID NO: 56647 - DNA, 428 bp, Zea mays
  unsure at all n locations
  Clone ID: LIB3068-047-Q1-K1-A1
aagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgnctgctgcggctcctcgccgcgtcgggcgtgttcaccgtcgacaagcagagcacggaagaggagcggtaccgcatcagccccgtgtcctacctcctggtggacggcatccctcacgaagaccacatgaaccacaccgctctggtgctcacctgcacctcgacgcgctacatcgaggcggggatagggct

SEQ ID NO: 56648 - DNA, 238 bp, Zea mays
  Clone ID: LIB3068-047-Q1-K1-A12
cggacgcgtgggcggacgcgtgggcggacgcgtgggttcttttggggtccagcaccatatacacatatacttgtagcccccctaacgtctttgtcttgggtcatagttatagagatatattaacggtgcattacatggctgtaaaaaacaaaaataaacaaaaaaaaaaaaagaaaaaaaaaaataaataaaaaaaagaaaaaaaataggaataaattacaatatagaaaaagtagcg

SEQ ID NO: 56649 - DNA, 277 bp, Zea mays
  unsure at all n locations
  Clone ID: LIB3068-047-Q1-K1-D3
cagcagtcaccactcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgncatcgcgccctgcctctcctacgcccgcggcacggggtccggccccttcgcgtcctgctgtagcggcgtcagggaacctcaagagcg

SEQ ID NO: 56650 - DNA, 51 bp, Zea mays
  Clone ID: LIB3068-047-Q1-K1-F5
tgctgagattacagcaacagtggcctacggcagtttactactgttttgtgc

SEQ ID NO: 56651 - DNA, 267 bp, Zea mays
  Clone ID: LIB3068-047-Q1-K1-G2
attatgtgcattattattttttcttttttttttctttttttcttttttttttttttttttttcttttttttttggggcaaaacccattttcccttttttttttgcccctaaaccttcttttcatacctcaggccattcggatcctttccaatttccccccgtcttttttcccctcctttaaacagtgccccccttccccactttcgttttcatcacccttaaatggttaaaaaaacccaggcccttttttttaaccaatcccccggg

SEQ ID NO: 56652 - DNA, 268 bp, Zea mays
  Clone ID: LIB3068-048-Q1-K1-B1
cccacgcgttcgctgaatggacattttactactctgcgttcgctctctctctactgatatagtatatatgtggtgtgtctatatatgtgtgcacgtggttttcgctcagctttttatcaacgctttgtgaataaaagctgtctcttcatctgtaaaaaaaaaaaagaaataaaataaatataaaataaaaaaataatatattatagaaaaaaaataaataaaaaaataaaaaatataaaaataaatattatattgtttaaaaaacaat

SEQ ID NO: 56653 - DNA, 268 bp, Zea mays
  Clone ID: LIB3068-048-Q1-K1-C1
gtgtgtgtgtctctgcatggacattttcctactctgcgttttttctctctctactgatatagtatatatgtggtgtgtctatatatgtgtgcacgtggttttcgctcggctttttatcaacgctttgagaataaaagctttctcttcatctgtaaaaaataaaaaataaaaaaaaaaaaaaaatgaaataaaaaaaaaaaaagtaataaataataataaataaaaaaaaattagtaatatgttaaaaatgttatttgttaaagtaata

SEQ ID NO: 56654 - DNA, 65 bp, Zea mays
  Clone ID: LIB3068-048-Q1-K1-C9
cccacgcgtccgaaaaaaaactacaaaaaaataaaaaaaaaaagacaaaaaaggataaaggaaac

SEQ ID NO: 56655 - DNA, 275 bp, Zea mays
  Clone ID: LIB3068-048-Q1-K1-D5
ctctaattgaggaccaccttacgcaagagcccatcaatgagtacgtccagagttgcgacatgctggctttcaacaagatctagagttcagtttctgagattgggcaacggcagcggctcatctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaacaaaccaa

SEQ ID NO: 56656 - DNA, 272 bp, Zea mays
  Clone ID: LIB3068-048-Q1-K1-F2
cccacgcgtccgagagagttgactgaaagtgtttctgcggtgcgacaatacgcatttcttgagacttggaacttcatgtcgcatactttaaatttcatgtttcggacttaaaaaacaaaaattaagacaaattatacttgctaaactataaaatactcagattacataacctataaaattataattaaaggccggcccctctttaggttccaattttacatcccctagcttgcgacgccatatctcttttgtagggtcacctaacttaaatt

SEQ ID NO: 56657 - DNA, 362 bp, Zea mays
  Clone ID: LIB3068-049-Q1-K1-A1
atgctgaatgccaagatgagattatgcgaaatcattacatttcggtcacctgcaagatgtcatattctgaaatgaaatacggctacagactctgccccaacacataacgataggccagatgtacaattaacaggcttccggtcctccacagaatgaaatttacagtgctgtcgccgccccccacccggcccccgctcgtcagcgaactgcgatccttttcgccttggacgatttgtgtctgatgaagagagccgccagcatgcttttagtgccaacaggggccttttggatcgcacgacctttggggttgtcgaaggaatggaatgttgaaagttcctttacaccagatatgttcttagcgc

SEQ ID NO: 56658 - DNA, 359 bp, Zea mays
  Clone ID: LIB3068-049-Q1-K1-F1
gctcgacgagcaagacgagagcggcccggatggacgccggaggcggtgaagtgagatggctgagaaagaagtcctaggattttttagaacgactgtcaagtctagccatccattcattcccctgtcgaatcaatccgggggctaagatttacgtaattctttttttcttcttctttgctcttctccccacccccactattttaaataatcctccagtgtaaatacatgtactactgcggtttggccacgccagccagcattgttgcaacttggaagtgaaaggaaaaacattcgtttttttacttctgctaaaaaaaaaaaaaattataaaaaattaaatataataattattattaaaa

SEQ ID NO: 56659 - DNA, 94 bp, Zea mays
  Clone ID: LIB3068-049-Q1-K1-F11
aaaaaaaaaaaaaaaaaaaaaaaaaaaaaaaaaaaaaaaaaaaaaaaaaaaaaaaaaaagggaaagggaaaaaaaaaaaaaaaaaaaaaaaaaa

SEQ ID NO: 56660 - DNA, 380 bp, Zea mays
  Clone ID: LIB3068-050-Q1-K1-E5
tatggaatgaaatgagttgatcaagctggcttcgacaagtggcaacctcgtgctatacaagtaatcatgttttttgtcagtgagttcgtttcttttgtcacctacggtgcatctggctataagaagataagatttggaaataggtggattgctctggttgttgagaagtttgttgaacccgatgtttccttggttccaacactgtcatgctccatcgattattttggagagttgatcagtgggcagaaaccgtggaagaaaagctgacatttgcactcacccgagccctatcagcagcgccggccctggcaggggtcgagcagtgcccttaaccaggcccccagattaatggagccctcctttagaatttggcacttggg

SEQ ID NO: 56661 - DNA, 134 bp, Zea mays
  unsure at all n locations
  Clone ID: LIB3068-050-Q1-K1-G5
gagcgcaccaggcggcggccgcgcgagaggaaccaagcgaacggacgcgagcaagcgacgccagggcacggcgatagaggcacctaaaagcaaaacacaggcagacgncgaacaacgacgagacagggaaaacc

SEQ ID NO: 56662 - DNA, 272 bp, Zea mays
  Clone ID: LIB3068-050-Q1-K1-H3
gcgacgcacaaggagaagaccatccattgtcacaagtcatcatgaaacacggtacagggaaggagggagggaacaacgtctcagctggatctatttttttttatgagaataatccaaatagacattggctaaccgaacccaacacgagaaccaatccacaggagggttaaaaaaaccggcggttgttctttgaaaagaagtccgtccattagaagaatgaccaggccatcgccgagaccaacggcaaggccaagcccgcggttaacccaagc

SEQ ID NO: 56663 - DNA, 66 bp, Zea mays
  Clone ID: LIB3068-050-Q1-K1-H8
gacagacatagcactactatagtgtgacctaaattcaattcagtgagagtaaacttacaaagtacg

SEQ ID NO: 56664 - DNA, 69 bp, Zea mays
  Clone ID: LIB3068-051-Q1-K1-B12
aaaaaaaaaaaaaaaaaaaaaaaaaaaaaaaaaaaaaaaaaaaaaaaaaaaagggaaaaaaaagaaaaa

SEQ ID NO: 56665 - DNA, 72 bp, Zea mays
  Clone ID: LIB3068-051-Q1-K1-C1
aaaaaaaaaaaaaaaaaaaaaaaaaaaaaaataaaaaaaaaaaaaaaaaaaaaaaaaaaaaaggaaaaagaa

SEQ ID NO: 56666 - DNA, 187 bp, Zea mays
  Clone ID: LIB3068-051-Q1-K1-E1
cccacgcgtccgcccacgcgtccgcccacgcgtccgcggacgcgtccgcccacgcgtccgaaaaaaaaaaaaaaaaaaaaaaaaaaaaaaaaaaaaaaggacaaaagatataaaagataaaaaaattacatacacatgaatgaaaagtaataaataatggtatagtggtactataaattcaattcat

SEQ ID NO: 56667 - DNA, 359 bp, Zea mays
  Clone ID: LIB3068-051-Q1-K1-E11
aaaaagaactcacggaataattgttcgtcttgtatcatacttaatcgtaggaataaataacctcatttacaactcagtttcgcaaatttgcgctaagaaaattaagcctgcgtgcgccgtgagattcatgcggagtgcagagcaaaaaccacgctactagtaccattaccagccggccgtgagccgcagttcctgcagccgtgccggcgtcggccaactccaagaacagatctacggtaaactctagtactaatcttttttgtacgtacgtatagtgggcacaaattgtgtccgtatgtacgccgtatctatagatacttcacgaggaagaaagaatcggtgtcgtgtcgtgtcgtgtc

SEQ ID NO: 56668 - DNA, 341 bp, Zea mays
  Clone ID: LIB3068-051-Q1-K1-E8
gtctggtctgatggagaggccgtctgtccagaaggtcgctgccctgatgaagcgatctggttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagacattgaattgttcggaaatgagcattcctgtgctcttcttgaaaataaaaaacataaataaatattataattattttaatttattttatttattctatcatattttatatttatacttaattttttatatatataattaatctctttta

SEQ ID NO: 56669 - DNA, 91 bp, Zea mays
  Clone ID: LIB3068-051-Q1-K1-H10
aaaaaaaaaaaaaaaaaaataaaaaaaaaaaaaagaaaaaaaaaaaaaaaagagaaaaaaatgaaaaaaaaaaaaaaaaaaaaaaaaaaaa

SEQ ID NO: 56670 - DNA, 262 bp, Zea mays
  Clone ID: LIB3068-051-Q1-K1-H4
tgccacgcttccgaccacacttccggcagaatggtaagggaactattcaatatgacggacctaatgggtctacaaattcaagtgagaacaattcattgtgtgacctatattccaagcttgctaatgatgcaaggctatatggtgcatgtgacaatgatcaaagccacttgccgtcaacttcttaagttttaccgtttgcatactccaattcatattattttctaaccttcaagtttacctgacttgcttattggcacccctt

SEQ ID NO: 56671 - DNA, 256 bp, Zea mays
  Clone ID: LIB3068-052-Q1-K1-A10
ggataaaaaacactcccacactcgtcgggcccctagacaacgccaacatctacactaaccttactgacaccagctccaccgggaatgcacacccaccctcaacccccaacacctggactacaggcccaccgacgtcgcccactatgaggaccacacgttacaccgaaactcgcacgccagcactcagcaccttctcctgcgacacgcccagccccaccacgagccgaccggctacaactactcatcgaacgaagac

SEQ ID NO: 56672 - DNA, 91 bp, Zea mays
  Clone ID: LIB3068-052-Q1-K1-A7
aaaaaaaaaaaaataaagtaaaaaaaaaaattaaaaaaaaaaaaaaaagaggaaaaaaaaagagaataaaaaaaaaaaaaaaaaaaaaaaa

SEQ ID NO: 56673 - DNA, 175 bp, Zea mays
  Clone ID: LIB3068-052-Q1-K1-B7
tccaacaatacataacctaacagtttccttacgaatacgattcttactgacatttctttgcaaatatctaaaaaagctcaaaaaccgctatttaataaacctgcttattattatgtaattggtcaagtaaatgctgaccaagccaaagatccttacctttacttttcccatgatc

SEQ ID NO: 56674 - DNA, 417 bp, Zea mays
  Clone ID: LIB3068-052-Q1-K1-B9
ctgactcatgcgacgccctccaggccgtgctcaatggcaactcctctaacctcttactgagcgtctacaccatgggcctagatgtatatacaaaattacatcaactacatacataacacagtctacaccaccaagaacgagtcacctgacatgctcaccacgcacactactcacccagttagcttctaaccacacgacaagtactatcgccagcggtacctgttgaagaacacatttgtacttatgccaacacagaatccagcactgaactactgaagcttcaactttccaaccatggatgtgcaaattgtgtaactgattgatgcttggttgctgcaatgtacaaatagtatcttatgaaaccatttaaacactgctacgcactactatgacatctcagcgcatttaagcactata

SEQ ID NO: 56675 - DNA, 108 bp, Zea mays
  Clone ID: LIB3068-052-Q1-K1-E9
cccacgcgtccgcccacgcgtccgcccactcttccgcccacgcattcgcccactcgtcctggcacgcttccgccgacgcgtcctcccacgcgtacgcccacacgtcct

SEQ ID NO: 56676 - DNA, 424 bp, Zea mays
  Clone ID: LIB3068-053-Q1-K1-B4
gcgcacaaccttgctagcttgccggagccgctatacctgacagagtgggggctgaaagcgggggcgcacctttcgcatctcaccctctgaactctgaccctgctccgcgaagttgtttccttttcttctattatgacaaatgcagtcgcttgatcaagcatctagacggccgtttcactcccgttcacggaagtacagaccacgtgtcctgccggactttgtttcggtcaagctgagtgtgcacacgcgtatccatgccttactcaactgctgacctgtaacatctaaatggtctgctctgcgtcacgtggtactcatcagcaaacacttgacagccttttcaccgatcaccaacgcctcgttgccttgccactggctgagcattgacccgcagctatttgccttgcacgcacgacacccgtat

SEQ ID NO: 56677 - DNA, 52 bp, Zea mays
  Clone ID: LIB3068-053-Q1-K1-C10
cccacgcgtccgcccacgcgtccgaaaaaaaaaaaaaaaaaaaaagggaaaa

SEQ ID NO: 56678 - DNA, 353 bp, Zea mays
  Clone ID: LIB3068-053-Q1-K1-C5
ctcggggacctgtccaaggggatcacctactcgctccacaggaacatcgggatcacagtcttggctctcggcactcgtcagatcttcgcgctcttcctgaggccgaagaaggaccacaagtaccgggtgtactggaacgcctaccaccactcggtcggctacgccatcatcgtgctgggcgtcgtcaacatcttcaagggcatggccatcctcgacgtggagcagaggtggaagacgggctacatcgccgccatctccgtcctcggcgccgtcgccgtggccctggaggccgtcacgtggggcgtcgttctgaggcggaggaaggaggaaagcaagagctacaacggcacctc

SEQ ID NO: 56679 - DNA, 381 bp, Zea mays
  Clone ID: LIB3068-053-Q1-K1-D10
aaaaaaaataaaaaatcacataaaaaacaatctatacgcaaacgcttggagaaattcatactgagacacgtgtgcatgccttgtagccactatgatatactgtcacctaatttcaattcactgaataagttttatcaccttaaaaactgtgaaaacccatttgttccccaacgttatagtcttcctaacatcctaatttattcaacaaacgtaatatagaataaatctcaacagattgttctttccaacattattccatcatgaatggtcaattggatgcgctttgtatcgatacattacacgcacagtgtgaatttattacatccattcatactcgtaaattattaaatgacctagcatctggttatcttaatagattca

SEQ ID NO: 56680 - DNA, 96 bp, Zea mays
  Clone ID: LIB3068-053-Q1-K1-D2
aaaaaaaaacatacaaaaaaaaaaaaaaaatataaaaaaaaaaataaaaaaaaaaaaaaaagagagaaaaaaaaaaaaaaacaaataaaaaaaaac

SEQ ID NO: 56681 - DNA, 390 bp, Zea mays
  Clone ID: LIB3068-053-Q1-K1-G9
acctgttttatgagatagtacagaggggacatggtctgggggaacgcatcacgagaacgaatccacaggagggtaaaaaaaaccgccgctgctcctttgagaggaggtcggtccatcataagagtgacgaggctatcgcggagaccactgcgagcgctacgccgtcgctgaccccagtccggaacttgacaccgctgcccgcggcgctgtcgctcgcagggttgccgtcagctgacggcgtgatcttagaggcgttggcaaacagggcgtactccgcaaagcctggcttcaggttcagcaaggagatgcactgcgagacgtttgagttggtgaggttgcaagcagcggacatcgccatgagtcgatccaagcgcatgccgagcgactgta

SEQ ID NO: 56682 - DNA, 230 bp, Zea mays
  Clone ID: LIB3068-053-Q1-K1-H11
aatgccgtaagtttttgatcccaagcctgattcttggactggtctagggaacctatccggggttgtcaccgtcagagttgacttgcattctttgctcctgatcctgtcggttaccgtggatcacatttcctgttgaattacacaaaagcctactggtttctaatagattgctgccacctacaatattatgacgctgctgaactttaaaagcaaccaaatgcggccgaaga

SEQ ID NO: 56683 - DNA, 275 bp, Zea mays
  Clone ID: LIB3068-054-Q1-K1-A6
gaaaaaaaaaaaaaaaaataaaaaaaaatttttattattaaaaaaaaaaaaaaaaattgaaagagtctaattttactccgcccccctccccctcctttctttctttttaattaaaccaaaattcaattcacttgcctcttttttccaaacttttgggcttgcaaacctctttcataaaccaaatttatccccttttaaaaaaattcccctttttttttgttgtcccaaaaaaaaaaaaaccccccccctttttcaaacccaaaaattttccaaaa

SEQ ID NO: 56684 - DNA, 312 bp, Zea mays
  Clone ID: LIB3068-054-Q1-K1-B10
cggccgaatccgggccgacccacgcgtcgccacgctcgccacgcgtcgccactctccccaaggaggtgcgacagaggaacgaaacctccgcgacgaagccgcggagtcagactgacctaccggccacttgcggctaagggcttaaggacctgctccgggatgcgccggctctcggatgcatacctggctctgggttccgtcatcttacgacacgctggatgggcgggagattacacggaccccaggggcaacgccaatctggcgtaacgaaggtcgagtcggcgttcgctgtactaactggtattctaggtc

SEQ ID NO: 56685 - DNA, 82 bp, Zea mays
  Clone ID: LIB3068-054-Q1-K1-B11
aaaaaaaaaaaaaaaaaaaaaaaaataaaattaaaaaaaaaaaaaaaaaaaaaaaaaggaaagagaaaaaaaaaaaaaaaaa

SEQ ID NO: 56686 - DNA, 320 bp, Zea mays
  Clone ID: LIB3068-054-Q1-K1-B9
cgacaggtgaagccgccgccgctgcagtgtccatatccacctctttatgactgagatggggggttttgtcaagaccggcaagagcaatgcgtacttcaagcgtttccaggtgaagttcaagagaaggcgcgctggcaagacagactacagggccaggataaggctgattaaccaagacaaaaacaagttcaatacacccaaatacagatttgttgtgcgatttaccaacaaggacatcacagcacaaatcatctctgctagtatagcaggtgatatggttcttgcttctgcttactcgcatgagttgccacgatatggtc

SEQ ID NO: 56687 - DNA, 399 bp, Zea mays
  Clone ID: LIB3068-054-Q1-K1-F12
cccacgcgtccggcggcggcagcgcctgttggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaggaagcgctacgagcgcattcagcccgtgcctgccgtcaacgcgcaagcgag

SEQ ID NO: 56688 - DNA, 270 bp, Zea mays
  Clone ID: LIB3068-055-Q1-K1-B2
tatagatcgatcgacctctgtttatatgtatagcgagtcgtccgtagtcacgtcatgtgtgtatcattctttgcgctcccagcagttttgtttcctttcatattctctacaaaattttctaccaatttaattgatactttatgtcacagtgtatatgtttatgtgtcatttgtttttctttagaatggcttttatgagatgtttttcttgcatagaagttctattatttaagtcatgattatgcaagtacatagtagacgtttttactat

SEQ ID NO: 56689 - DNA, 356 bp, Zea mays
  Clone ID: LIB3068-055-Q1-K1-C11
cccacgcgtccgcccacgcgtccgcccacgcgttcgaaaaaaaaaaaaaaaaaaaaaaaaaaagaaaaatttaaaaaaaaaaaaaagaaaaaaaaaaaaaaaaaaaaaaaaaaaaataataaaaaaataaataaaaaaaaaaaaaagggcgtcctttttaaagaatccaaatttacttacccttgctttcaaaatcataacttttttataatgccccctaaattcaattaactggccctcttttaaaaacatcctaatttgaaaaacccttgctttcccaaattaaacccctttgaaaaaaatcccctttttccaaattgcctaattaccaaaaagcccccacccaataccctttc

SEQ ID NO: 56690 - DNA, 112 bp, Zea mays
  Clone ID: LIB3068-055-Q1-K1-E6
aaaaaaaaaaaaaaaaaaaaaaaaaagggcaaacaatataagaaataccaaacttaggaaggcatacatgcgacggcataggctattttatagtgacacctaaattcaattt

SEQ ID NO: 56691 - DNA, 57 bp, Zea mays
  Clone ID: LIB3068-055-Q1-K1-F11
aaaaaaaaaaaaaaaattaaaaaaaaaaaaaaaaaaaaaaaaaaaaaagaaaagttt

SEQ ID NO: 56692 - DNA, 67 bp, Zea mays
  Clone ID: LIB3068-055-Q1-K1-F12
aaaaagaaaaaaaaaaaaaaaaaaaaaaaaaattaaaaaaaaaaaaaaaaaaaaaaaaaaaaaagaa

SEQ ID NO: 56693 - DNA, 163 bp, Zea mays
  Clone ID: LIB3068-055-Q1-K1-H7
gacggtacttactacactacatgtgctgcatcgctgagctcagctcatgacaccaggggggtgtgcaaacacaagaacgagctaaaccatactcttgacctgatgatatattcccttcaggtcagatagcctaggagccgactgacatgccagcgctactact

SEQ ID NO: 56694 - DNA, 210 bp, Zea mays
  unsure at all n locations
  Clone ID: LIB3068-056-Q1-K1-A1
cggacgcgtgggcggacgcgtgggatcttgattttgttatctatctggtgtccagttggtagttgttcatggtgtcagacatgttgcancgtcagtgttaagtcaggaagtgcctgagtatgcacctgttcagttattatgttttgatatggtttctcaatttcttaggataactctgtagtctgaaaaaacaggatccgacttcttact

SEQ ID NO: 56695 - DNA, 316 bp, Zea mays
  unsure at all n locations
  Clone ID: LIB3068-056-Q1-K1-B12
cccacgcgtncgnccacgcgtgcggattttcctactctgcgttttttctctctctactgatatagtatatatgtggggtgtctatatatgtgtgcacgtggttttcgctcggctttttatcaacgctttgagaataaaagctttctcttcatctgtatattttatttttaatgaaagaaataaaccactatatatttcgacaaaaaaaaaaaaaaaaaagggaggaccatctaaaagaaccaaacttacaaactcgtgcaatgcgactaaatacgttctctatagcggcacccaaaattcaattccatggccggtt

SEQ ID NO: 56696 - DNA, 129 bp, Zea mays
  unsure at all n locations
  Clone ID: LIB3068-056-Q1-K1-C5
cccacccgtccnaaaaaaggatttcatttaaaaaaacaaaaaaaanccccgcgtctctgatataatacaaacttacgtacacctacatncaacatcttacctcttctatactctcacctaaattcaatt

SEQ ID NO: 56697 - DNA, 161 bp, Zea mays
  Clone ID: LIB3068-056-Q1-K1-F2
tatcttatctatctatagtatcgtgttaccgttcgcttctttcaccgtgttagtgtccgttctaccttttgattaggtttttgtacccctgttgttccctttggttgctcccgctatgaaacgagactagagaagaatgagcaatgtttttgttcgcagct

SEQ ID NO: 56698 - DNA, 244 bp, Zea mays
  unsure at all n locations
  Clone ID: LIB3068-056-Q1-K1-F7
gcgagggtggtggtggcggctacgggttctgcggcngcggctggaaggactgatgttggtgcccatcctgggttcggccgacttatcttatctatctatagtatcgtgttaccgttcgcttctgtcaccgtgttagtgtccgttctacctttggattaggtgttggtacccctgttgttccctttggttgctcccgctatgaaacgagactagagaagaatgagcaaggtttttgttcgcagct

SEQ ID NO: 56699 - DNA, 199 bp, Zea mays
  Clone ID: LIB3068-057-Q1-K1-B2
gcgctctgatcattaaggttatgtgcattcgattgctcgctggcattgccaggattgtgggtgctggggtatgttcatgatgttgtaagcttaatgaacggctggtaatggtatatgtagtaccaccaccctctgtaatctcagctgctgtggcaactttgactcttttcggaatactcacttgtactgcgtagaacag

SEQ ID NO: 56700 - DNA, 220 bp, Zea mays
  Clone ID: LIB3068-057-Q1-K1-C5
ttcccggcccgacccactcatcctaaaaaacaaaaaaaaaaaaaaaaaaaaattaaaaaacaaacaaaaaaaaaaaaaaaaaaagaaaaaatacaaaaaacagaaaaacaaaacaaaacaaaaaaaaaaactccacccaatcatactcaccccctctaacatccactctcattcacccatacatccacctctcacattccccccactttccccccaaaac

SEQ ID NO: 56701 - DNA, 158 bp, Zea mays
  Clone ID: LIB3068-057-Q1-K1-C6
tgcttttgaagctggatgatctgagttctgtggtaaaaccttggtttgcacttcactgggttccctgaaatgggtttgcgaccactgaatttgcatgtgtaacctttccaagaaaccagtagcagtttgtaaaaaaaaaaaaacaaagacacataaat

SEQ ID NO: 56702 - DNA, 68 bp, Zea mays
  Clone ID: LIB3068-057-Q1-K1-E7
cacgggtttaccggacattttggcagatcgcatggtacggagacgaatttgcatatttgttttctcgt

SEQ ID NO: 56703 - DNA, 140 bp, Zea mays
  Clone ID: LIB3068-057-Q1-K1-G8
aattcgcggcaaaaggaaaacaaaaaaaaaaaaaaaaaaaaaaaaaaaaaaaaatggacagacgatttaaaaagatccagggtgacgggcccgtgcatgcgacggcttcgctcttacatagacttacctaaattcaatta

SEQ ID NO: 56704 - DNA, 68 bp, Zea mays
  Clone ID: LIB3068-057-Q1-K1-H3
cccacgcgtccgaaaaaaaaaaaaaggataaaaaaaaaaaaaaaaaaaaaaaaaaaaaaagagaaagg

SEQ ID NO: 56705 - DNA, 425 bp, Zea mays
  Clone ID: LIB3068-058-Q1-K1-D8
cagcagtcaccactcccaagccagtggctattcctacgagcagtcgcacgcaagtgtcagtagactaaacgggggacatgggtcgcacgcaatctgtcgtagcggtcgtcgtggtggccgcggtgctgctgctggcagcggcggcgacgaccttgtatgccgccatcacctgcgggcaggtgagctccgccatcgctccctgcctctcctacgcccgcggcacggtgtccggcccctccgcgttctgctgtagcggcgttaggaacctcaagagcgccgtcagcaccgcctccgacaggcgctccgcctgcaactgcctcaagaactccgtcaggggcgtcagttgcctctacttcggtaacgcctgcagcattcccttcaagtgctgtgtcagcattccctacaccatcagcaccttcacctac

SEQ ID NO: 56706 - DNA, 199 bp, Zea mays
  Clone ID: LIB3068-058-Q1-K1-G6
cggacgcgtgggcggacgcgtgggaaaaaaaaaaaaaaaaaaaaaaaaaaaaagagaaagggaaaaataataaggatacaaaaattaaaaacacatacatacaaaaaaatggcgtcttctttataggttcctagtttcctttcacttgctttcgatttactactttttttttagtgtaacttatatttatttcattgtt

SEQ ID NO: 56707 - DNA, 213 bp, Zea mays
  Clone ID: LIB3068-058-Q1-K1-H4
gctttacatgctggccacgcagatgcaggccatggaggtcgtgacaacgctggggatggtgtcgccgcactcgcccgacgaggagtacatgggggagttcgcggagccgtcgtggctggcggagcccatggtgaatgctgcgttcgagaagttcggcggcatgatgaaggagatcgaggggttcatcgacgagtgcatcaacaacctgtacct

SEQ ID NO: 56708 - DNA, 321 bp, Zea mays
  Clone ID: LIB3068-059-Q1-K1-A7
aaaaataagaaaggttaattataaaccaaggggcatcatatatattcatacatacgtacatgatcactgcatgtgacacatctaagcacataaagttagctatttactcatagacactcacgaaggctctgtctgcacccaaagcacagaattttaacaactaaagccttacgagacgaccaacatcattaaggacttcaacgagcctccgtttctggacccgatcagtctcttacttggccccaccaagttcatggtcatacaaggcgagcccggcgctgtcatccatgggaagaagggatctggaggcataactgtgaa

SEQ ID NO: 56709 - DNA, 274 bp, Zea mays
  Clone ID: LIB3068-059-Q1-K1-B12
cggacgcttgggcggactcgttggcaaaggacctgagtgcgctgtggactggcgcaccgggctgttctgtgtgccaccggacagtgttcggtgcaccatgcccgtgcaaatccgaagcagccactctagggaattcaacgacgccctccgctataattcaccggactgtccggtgtgccagcggatcatcggctaactcgtgccaacgggcgactctgacggctgaacagtgttacgacagaagtcatagcagaaagtcacagggcaccggact

SEQ ID NO: 56710 - DNA, 444 bp, Zea mays
  Clone ID: LIB3068-059-Q1-K1-B9
cccgcatcgaacctcacccccgatctgatctaatcgaaggctgcggcggcgatgggcggggaccatggcggtgggcacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctgcaactagcatgaagtgtgggcaccttgcttttgccttctatatgtggaaacctgtgcctagccataatgctgggttaagtgttaggagcatctctggaatgcttcgcgtagtatctcttgatacttctttccttc

SEQ ID NO: 56711 - DNA, 326 bp, Zea mays
  Clone ID: LIB3068-059-Q1-K1-C1
acgcttacgtccagctagcccttgccgtcgctcgtctcctttagaggcgccggcaccgacgatctggcccgggtctatttgcagaagcgcggtcacttgtctcagcccggggtctgctgcgtctggtggtggtgaatgggagaacctcgtgacgatctgttccggatcaagcgtgcgagctcgggaatcaggggtttcacacatagctgttgcgatctgaattcgatgtactaatggagtctaatgccggctaaaagtctagccttacttactctatgatgtctgaagctccccttggctacagcattgacgacgttcgatctgtc

SEQ ID NO: 56712 - DNA, 451 bp, Zea mays
  Clone ID: LIB3068-059-Q1-K1-C2
tatcactaaaaccgaggactgtgagagttttttcaactttttcaatcccccgcaggtccctggagatgatgatgacatcgatgaagacactgctgatgagctgcagagtcaaatggagcatgattatgacattgggaccaccataagggataagattatccctcatgcagtttcctggtttactggtgaggctgtgcaaggtgaggattttggtgagttgggcgatgatgatgaagatgatgatgatgaagacgatgacgaagatgatgaggatgaagaagaggatgatgatgatgaagaggatgatgaggaagaaagcaagccagcaaggaagtcaagatctggtcgcagacataaggcgccacagaaagtgtcccatggaaatgcggaacaaccagcggagtgcaagcagcaataaaatggcccgttgatgttggttgatgcaatattt

SEQ ID NO: 56713 - DNA, 280 bp, Zea mays
  Clone ID: LIB3068-059-Q1-K1-C8
cggacgcgtgggcggactcgtgggcttacgtgtgggcgacgagggtgacgagtactagagaggtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgctaattcccctgcattgctaccgggttattgagaataattatggctgcttacgttgttgcttcaaaaaacgaacacattatt

SEQ ID NO: 56714 - DNA, 77 bp, Zea mays
  Clone ID: LIB3068-059-Q1-K1-D7
cccacgcgtccgaaaaataaaaaattttatttataaaaaaaaaaaaaaaaaaaaaaagaggaagagtaaaataaaaa

SEQ ID NO: 56715 - DNA, 217 bp, Zea mays
  Clone ID: LIB3068-059-Q1-K1-E6
tcggttacgcgtccggggacgcgtgggaaaagggaagggaaaaaataaaaaaaaagaagggaaaaaaaaaaaaaaaaaaaaaaaaaaaaaaaaaggacgggagatatagagggataaagagtaattagacttaaatgcgactaaatatatattcgatagcgtgagataaattaaatttaggggctagtagttttaaaaataacgagactgtgaaaac

SEQ ID NO: 56716 - DNA, 445 bp, Zea mays
  Clone ID: LIB3068-059-Q1-K1-F3
cggacgcgtgggcaggccgcggccggcgggtacggttagtccgccgagtacacggaggccacggtgacggaggtcgtgtccacgggcgagaacgagtacgacgagtacaagaaggaggagaagcagcacatgcacaagcagcacctcggcgaggccggcgccatcgccgtcggcgccttcgcactctacgagaagcacgaggcgaagaaggacccggagcacgcgcaccgtcacaagatcgaggaggaggtcgcggcggcggctgtcgtcggctccggcggcttcgccttccacgagcaccactagaagaagaaggaccacatggaggccgatgaggccggctgcgagaagaagcaccacttcttcggctagctgattgatcctaccatatcgatcgtcgtacctaccctgttgctacgcgtgcgtgtgagagtgatatcgagcg

SEQ ID NO: 56717 - DNA, 146 bp, Zea mays
  Clone ID: LIB3068-059-Q1-K1-F9
tcgcccactcgtccgcccactcgtccgaaaatttattaaaaaaaaaaaaaaaaaaaaaaaacagaggggttttataaaaaaatgcgggcttacaaaaacgttcatgctacttcatatccctatcataggttcacctaaatacaatt

SEQ ID NO: 56718 - DNA, 266 bp, Zea mays
  unsure at all n locations
  Clone ID: LIB3068-059-Q1-K1-H10
gaaagaatttcactggctacatagcaccacggtttgacaaccgcagaccaaacaaangaggcggccnatttccaaggccgccgggcctggcaccgcagctacctcctctacggctcgccgggcacaggcaagtccacgttcgcggcggccatggccaggttcctaggctacgacgttgacctgtctcgcaccgatgccgtcgtcgacgacctccgcgcgctgctcctgcacaccaccccgcgctcgctcgtccttgtcgaggacct

SEQ ID NO: 56719 - DNA, 336 bp, Zea mays
  Clone ID: LIB3068-060-Q1-K1-A5
tctggctgcagagcactagagttctgctgcctacccttgccgccttgcgtatggtgtgtacacttcacaatatggcaagagctcttgcctacggtggagcagctgccgcagctggcttcgtctcgccgtggcttgccgtgctcggtgcggccatgctctccgtctgggccatcacgctcgccatcctcctctgtggcgacagctcagacaacccgagaccaagatacaatcctgccgttagtgcggctatagcagctggtggcggaaggggctgtggtggcggaggcggtggtggtggagggggctgtggtggcggatgccgttgtggagggggct

SEQ ID NO: 56720 - DNA, 71 bp, Zea mays
  Clone ID: LIB3068-060-Q1-K1-E5
aagaaaaaaaaaaaaaaaaaaattatataaaaaaaaaaaaaaaaaaaaaaaaaggaggaaaaaattaaaaa

SEQ ID NO: 56721 - DNA, 98 bp, Zea mays
  Clone ID: LIB3068-060-Q1-K1-H2
atcattttgtaatggtagtggccaattgaattggagagtgggttaagttttcacatgtgatgactatatataaggcatcatatggagtttagaggtgc

SEQ ID NO: 56722 - DNA, 404 bp, Zea mays
  Clone ID: LIB3068-060-Q1-K1-H9
cccacgcgtccgaccaggtgctgtgactcaaaccctgaggtccgtcccccattgactgagatcgtgaggatgctggaacaggtggagatggaggttctgaccaccgtccgaaaggctcggttccgctgctgcatcgcccaaccgatgacgctggactgagtcatccacaaaatccaggaaaataacctggagtgccgtttactcctatgtatttataatatatattattagagttgtgcttcagaagcagggagctgactcctcagtctgccttctgtctttgacatgtcaccgtagagtacaccagagtggttgtaatagaggtagctttttttaaattgcttgaccaaatacccttctccgtgtaaaagtgcctgttcttgcaaaaaaaaaaaaatttaaaa

SEQ ID NO: 56723 - DNA, 445 bp, Zea mays
  Clone ID: LIB3068-061-Q1-K1-B2
gtacggcgcgggcatcgtccccggtgtcatcgtcatccactcccccaggatcccgtcgggtgaggatatcgccgaccgcagcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttatcttgatctcgccctcacgcggtacctgttttactactctctgattggtggtttctgaggcaagttgcccgtgtacttgtatcgtaaaaa

SEQ ID NO: 56724 - DNA, 389 bp, Zea mays
  Clone ID: LIB3068-061-Q1-K1-C4
cggacgcgtgggaaaatgcatactctgaatttcaatgatttccatactgaaaagttcaagttgaatgaagaagaatggcacttcttagaggtcgattttgatgaagattgatcattgaaggtaactgtaagagttgactgccatggtttgtgacagggttgccatggtttgctgcaccgccggcctactagttgggggttcatttgcgatggcagcatagacagacgggcggccatttttcttccattttggagtaatagtccaagcctgaactgtgacattcgtgcatgcttatacgtgaaagtgtacctgagagcagattatacgtgaaagtgcatcagcgttgcatatgcaaaaaaaaaaattgttatatatattataaataatat

SEQ ID NO: 56725 - DNA, 284 bp, Zea mays
  Clone ID: LIB3068-061-Q1-K1-D11
aaaacccggcccgacccactcgtccgcccgcgcgtccggctaatcgcacgtttgatacgcgcatagggtcgaaagactaatgtagggttctatcagctgatggcgggcgaagtttacctcaagatagctggagcccacacaagttctatcgggtaaagccaatcattataggcatcgagcgcgcatcgccctcaacctattctcaaacctcaaataggtcggacggctcgtctagcttggtgagccctaccacggaatcgagatgctactagtacgccattttt

SEQ ID NO: 56726 - DNA, 70 bp, Zea mays
  Clone ID: LIB3068-061-Q1-K1-D6
cccacgcatcctctgactcgtggcattatttaaaaaaaaaaaaaaaaaaaaaaaaaggagaaaatattaa

SEQ ID NO: 56727 - DNA, 417 bp, Zea mays
  Clone ID: LIB3068-061-Q1-K1-E7
tagctctaggctctagctagccgcgctacttcttcgtgtagccatcaaccttctcatcgccaccaatggccactgcggaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgcctatgctgaggctgctgctcctgctggtcccgatgagactcctgcggtcgagcaggaggcagccgtcgaggaggaggctgctgctgctcctcctgctggtgcctaggagc

SEQ ID NO: 56728 - DNA, 223 bp, Zea mays
  unsure at all n locations
  Clone ID: LIB3068-061-Q1-K1-G12
cagaccaaacaaancgggcgggctaactccacagccggcggggcaggcgccgcagcnaccnccnctacggctcgccgggcacaggcaagnccacgnncgcggcggccatggccagngccctaggctacgacgttgacctgtctcgcaccgatgccgccgccgacgacctccgcgcgctgctcctgcacaccaccccgcgctcgctcgtccttgtcgaggacct

SEQ ID NO: 56729 - DNA, 355 bp, Zea mays
  Clone ID: LIB3068-061-Q1-K1-G4
cccacgcatccgcaagatcctccaaccttttattcccgaacaaagctacaaccagaaaggagggttttaaaaacagccggcgcggcaaaagaacgccagcgaacaaacccaacaaggatcaccagatcaaccaccttaacagcacccacctactcaccattccagacttctacaccagtgcctacgcaaagacctacatccataacgatcattctaaagactatactcaccaaagcaacatgctaccactaaacggccaagctcacccagacaactatcggacatccgagacggaaccaatgctcgctcaaaccatttcggaatcatgaatatacatgatttttacagacattaa

SEQ ID NO: 56730 - DNA, 63 bp, Zea mays
  Clone ID: LIB3068-061-Q1-K1-H6
aaaaaaaaaaaaataattaaaaaaatttataaaaaaaaaaaaaaaaaaaaaaaaaaaaaggga

SEQ ID NO: 56731 - DNA, 180 bp, Zea mays
  Clone ID: LIB3068-062-Q1-K1-B12
aagaaaagaaacccattaaaaaaaaatttaattataaaacaaaaaaaaaaaaaaaaaaagcaagatcaaaaaaaaaaaaaggcagccaaacaacaaaaaaaaaaaaacaaaaaaaaaacaaaaaaaaaattaaactagaccgccatttaaaaacaccatctactgcaaaaaccctctcaa

SEQ ID NO: 56732 - DNA, 87 bp, Zea mays
  Clone ID: LIB3068-062-Q1-K1-H10
cccacgcgtccgccctacgcgtccgaataaaataaaaaaaaaaaaaaaaaaaaaaaaagagaaggttaaaaaaaaaaagagtgcaag

SEQ ID NO: 56733 - DNA, 496 bp, Zea mays
  Clone ID: CPR9103_LIB3068-037-C1
catctcctgagtcctgcctgcgctcgcctcagctcctttcttccccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaactgtgctgctgtaattgctgtttgattattattaattattaggggttaaaaaaaaa

SEQ ID NO: 56734 - DNA, 477 bp, Zea mays
  Clone ID: LIB3068-002-F12-R1A
gttcatcaaacattatgatgagcatgctctgcggactccttcaaacccattcctgctctgtgtgaggtgctccattgaactgcttgatcacccaaaagattacacgacacctccagaagaacttgtacttctaccagcaagtgctaccctaggtgacctgaaagtacaggcttcaaaggctttccaagaaacgtacctgatgttccaaagcttccagactgaacagctccctgactttccaaacttcagtgatacaacccccgtgaagcatgtgcttggatcaggccagttgcttcgagtaaggggacgttgcactggggattacaggagaattgtacagttcaggatggagaggggtttggagaactggacggtggactgctcatgtggggccaaggatgatgatggggaacggatgctagcttgtgacatatgtggagtctggcagcataccaggtgctcgggaataagtgattt

SEQ ID NO: 56735 - DNA, 84 bp, Zea mays
  Clone ID: LIB3068-006-A4-F1A
aatcaaagcccagggcttccattatatattatatatatatcggccaacttagggggtgtttgctgctgcaggtccatagcccgc

SEQ ID NO: 56736 - DNA, 143 bp, Zea mays
  Clone ID: LIB3068-006-A4-R1A
ggggagtgcccggggcgggccacgcggtccggcgggcgtagtggacgtgcagcagcaagcaccccctagggttggccggtgtgtatatagtatatggtggggccctgggctttgattaaaaggaaagggagagaaaagggcgg

SEQ ID NO: 56737 - DNA, 242 bp, Zea mays
  unsure at all n locations
  Clone ID: LIB3068-011-D12-F1A
tgttttgttgctaggggtggaggaggacgaatacatcacagagacgaattaatgtaagactgcacagaaagaaaatcaataggcgacgaacaggcgacgtgtatttcccacgcacgacgaacaacttgtctgactgagaaaaggaggaacccggcacaaagttcggtgctngtgttgttgttgtggcactgccaggtgaacncctccgccctcgatccgcgatcgaatggcagcgccctcgc

SEQ ID NO: 56738 - DNA, 527 bp, Zea mays
  unsure at all n locations
  Clone ID: LIB3068-011-D12-R1A
ggacggcngagaccgtgggcggacggtgggcggacgcgtgtggcagcgctgtcccctcgcgtggccttcctcgaccaccagcgatcgctgctcaccgtcggcaacagccacctcaagcaacgaatcgcggcgctcgcccaagacaagatcttcaaggatgctcatcaagaggcgctgaagaaggagatcgagcggctacccatgtgtaccagcagcagcagatgaaggtggccaccaccggcggcgccgacatcgccgcggcggcttccatgcaggccaggcaagagctgctcgcgtgcgagggcgctgccattcgatagcggatcgagggcggaggcgttcaactggcagtggcacaacaacaacaccagcaccgaactttgtgccgggttcctccttttctcagtcagacaagttgttcgtcgtgcgtgggaaatacacgtcgcctgttagtagcctattgattttatttctgtgcagtcttaattaattcgtatatgtgatgtattcgtcctccttcacctagc

SEQ ID NO: 56739 - DNA, 527 bp, Zea mays
  Clone ID: LIB3068-011-G12-R1A
gataaactccgtggtccgcagccaccgagccgagcccggcacagacgctactggcacgcacgcacgcaccagcaccagcaccacaccacatgcatggtggagcctagcacgggcagctagctcccggccggcgacgtgacgaccaccaccaccacatgttgcatgagcagcaggcaccgccaccggcagtagcagcgccaccgccatccatcaaccccgacgacgacggcgcccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgacatgcagaccggcggctacgacggcgccgcgaccagctcaccagcatcggcgagacgactgaggagacaaccgctgccatgtcccgaagcacccatgcagcagcagtcagcgtcggtgagtc

SEQ ID NO: 56740 - DNA, 505 bp, Zea mays
  Clone ID: LIB3068-012-C5-F1A
aaggatcgacgaatcaaatgatatttttgttctaatttctgccgcttcttctccctctgaatcaaacttttttttgccataatgtgccgttcctattattaccaagtatatggttctaatcctagatagaaaaataaatagcaaaaatctaaaaaggcggatcctccctctccatcaagagtaatgaactgggttctgatacagtacaaaaaaaaataactaaattaaccaaacttgcctgatgttgaggcaatcaagaaagctgcataagtgaatatataacccacggaaaagtgggctaatccgaccaatcttgcttgcacaatggaaagagccacgggcttatctctccagcgaattaaattagccaaaggtgtccgttcatgagcccatgctaaagtctcaattaattcctgccaatatccacgccaggaaattaagaacattaatcctgtagcccaaacaagatgtccaaattaggacatccaagcccatactggtaaac

SEQ ID NO: 56741 - DNA, 142 bp, Zea mays
  unsure at all n locations
  Clone ID: LIB3068-012-C5-R1A
cnacgcgtccgtttacacgtaagacctattgctcatgccatttgggatcctcattttcggcaacngctgtggaagcctttactcgaggacgtgctgcccggtccactgaatatcgcttattctgcggtttatcactggtggt

SEQ ID NO: 56742 - DNA, 167 bp, Zea mays
  unsure at all n locations
  Clone ID: LIB3068-015-D12-F1A
acctattacaactcagccacacggagcgacagatctactttcgacaccgtcaagcatgaaatcacggttcgttgttccccagcgagcggaggcgggcaataagttcaactatcgtcatggactcctacacagagaaacnaagacccgaagacaatgattacgacaat

SEQ ID NO: 56743 - DNA, 547 bp, Zea mays
  Clone ID: LIB3068-024-E10-F1A
gccaacctcggtcacttggaaaaacttcatgagtccctctttaaggagaaaaaggaaaccgatcaaaaaccatctctgcatctactgcctctatactttgcctttgatacggctgagtagcaaccttataaccaaagcacccgattcaaacccaacccatacatacaacactatcaataaaaccataccataagagcatgcggccactgcctggttggccggttcacgcggcgtcggtccggccggctttccaggactcgtactccgggtcgtcggtgggcagctcgaagcggcagagcgggcacgagttgcgcacctggagccagggcacgatgcagccgtcgtggtagcggtgcgagcacggcagccgcttgacgcgctggccgaccgcgaccccgtccttgcacacagcgcactcatccccctggacttcctggccggccgcgacgacggcggacgggagcgcctcgacggcggatctggcggccgggggcttggtcttgaggaacagcccctccccggctgctacgagcacctcgtacgccgc

SEQ ID NO: 56744 - DNA, 549 bp, Zea mays
  Clone ID: LIB3068-024-E10-R1A
ggcggcggcgtacgaggtgctcgtagcaggcggggaggggctgttcctcaagaccaagcccccggccgccagatccgccgtcgagggctcccgtccgccgtcgtcgcggccggccaggaagtccagggggatgagtgcgctgtgtgcaaggacggggtcgcggtcggccagcgcgtcaagcgctgccgtgctcgcaccgctaccacgacggctgcatcgtgccctggctccaggtgcgcaactcgtgcccgctctgccgcttcgagctgcccaccgacgacccggagtacgagtcctggaaagccggccggaccgacgccgcgtgaaccggccaaccaggcagtggccgcatgctcttatggtatggttttattgatagtgttgtatgtatgggttgggtttgaatcgggtgctttggttataaagttgctactcagccgtatcaaaggcaaagtatagaggcagtagatgcagagatggtttttgatcggttgtctttttctccttaaagagggactcatgaagtttttccgagtgaccgaggttggc

SEQ ID NO: 56745 - DNA, 528 bp, Zea mays
  Clone ID: LIB3068-038-F1-F1A
actgggaatcgaaatcttagattgatctaaagattattttgatttctttactatatttagtacaattgttatattacacatcgttttttttatagaataactacgtcctcgagctcgaggtctgaattttttcataatagtactcctactgacttcggctttagtgatgaataaattcgttttgtcgaaatccctataatgagtagcatttgctgctgccgaataaaccaactttaagatgggatacgatgctcgataaggcatgagattcagtatcataacggtttcctcgtagtaacgccagcgaatctcatctagaactctttgtgctttgaaaacagacatatgtatgcgtttttgtgctttgaaaacccgttcgaatttaagtagacgatcggttggaacttttcttgcgagttttctcagccccttcttcttctttatcctaggggtatactttaccaatttgaaacttgtcataaataagggtattacccgcctacctttactttaattgattatttgaat

SEQ ID NO: 56746 - DNA, 555 bp, Zea mays
  Clone ID: LIB3068-038-F1-R1A
aggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaact

SEQ ID NO: 56747 - DNA, 524 bp, Zea mays
  Clone ID: LIB3068-038-F11-F1A
ccaacctctataagaatgaacttcattgagaggcaaaaatatatatatataagcggaatacaactatacaacaacttgtgtatgtatatcgtatatggcacctgttgttagaatatatggtatgtatatgtgtatctatgttgtctttaatttggatggatgtgtaagatgtaaaattgctcgctcattgcatcttccaaatttcctccaaggcccaaaagttatctgtaatgctctcggagaagccttgcacccaaccactgagctccatgtcctgaaactggccagcgccggcaccagcagcctgcaccaccgactgatcaagatcagacgtcggcggcggcggcggccacagcccttggtcggcctcctgctgcgccgcccaatctccgccgtccatcagcatctcgccggcgcgcaagttcgcgaaaagcaggcccccgtcatcgtacgactccgacgcgagcgagtcggacgacgacgtcgccgccatgcccgacgacggcagcgcgtgcaactggcgg

SEQ ID NO: 56748 - DNA, 518 bp, Zea mays
  Clone ID: LIB3068-038-F11-R1A
tctagatcttctcatcataccgataccggcctcaacgccctctctttcccagcctcacaaccaattcctgtttcagtcgatcgcagttagcatggccgcgacacagagctgtcaggctgctgcttgcttcccggccgccgtggcggtcgacgaggagcacggccaccacagccaccagctgaagggaggagcgcaggaggaggctgagaacgacaataagccggagctccggcgtggcccctggaccgtagacgaggacctcaccctcgtcaactacatcgccgacaacggcgacggtcgctggaacaaactcgcccgcgccgccgggtctgaagctgacggggcaagagctgccggtctgcggtgggctcaactacctccggcccgacgtgaaacgtggcaacttcagcgccgacgagcagctgctcatcctcggactccacacccgcttgggcaaacgatggtcgaagatagcgcacacctgccgggggaagaccggacacgagatcaagaactta

SEQ ID NO: 56749 - DNA, 394 bp, Zea mays
  Clone ID: LIB3068-038-G2-R1A
ccacgcgtccgctctcgcgaccgtccacgcgtcttgcacacgttattaagaaattcacaatgagctcatgggttaccatgtcgctgtcttttctcgtggctccggcagtggcctcgcccactgccgtcctccagctcacctccatggatatagctctgtgttcccagcccgtgtcagcgtatgtcgtctacgagaaccccatcgatcgtccggccgataccattatatgagctctgtcccgtgcgcatgttccctactacccaatggccggccgtctcgccgtcactggggaccatcttaagcacgcgtgcaccggcgtaggcgtacgttcgtcggttcgtcggcgagctgcaccctgcaggacgccaggctctgcgaccgtcgtcccgtggtc

SEQ ID NO: 56750 - DNA, 80 bp, Zea mays
  unsure at all n locations
  Clone ID: LIB3068-043-C2-F1A
cttcttttttttttttttggcatgacgcaccttgagattgtaataatcaggagtccattgctacgacnctcactattact

SEQ ID NO: 56751 - DNA, 578 bp, Zea mays
  Clone ID: LIB3068-043-E3-R1A
ccccgggggcccatcgtagccgtcctcgatctccctcgctccgcagcacaccactcgtagccgccggcaaggcgactgacctctttcctgctgccgagcgccatcgtctcctcggaccatctcacctcagagctgctgcgaccgccggccaacccgtctaggtcttgtccctgccgctttctgagcctagaacatctttgcattttggagagtctccactcggagctattgtacagtctccatccctttcaacgagatggcacgtcagtctgctctctcgcttgtgagggatcgagcaaagacgggagcgctgaagcgtctgactctgagttcatcgaagacggctgggaggaactcgtctgggcgcatcacctctttccaccgtggtgaaggggccaagaagttgcagaggaaggtcgatgtgaacgcgacgcctgttccacgggtattgtggagcggatcgagtaccacccgaatcgctcctccgaccttgctcttatgccatgggtgcaagggttcatttccgccgccccaagagtccacaaaaactcagtgccatgtctcaaatccaacaatct

SEQ ID NO: 56752 - DNA, 455 bp, Zea mays
  Clone ID: LIB3068-027-Q1-K1-E6-129a
tacaagtgcggagattacaccctgccatgagcggcggtgagttctccaggccggatttgctgcatggcatgcccgagtatcaccgaagcgcgagctcttgtgtcgtgtgtccgtgtctgtcagtcagtctctatgtgttgcccataataaacaaagacatgcgagtaccagacatgtgcaactctagtagtatggtgcgtgttatcactaggcacgcgtactcgtatagttgtgttcagttctgggtctatagagatatgtagccctgcattgtcgaaataaatactgtgtccactcgttcgtgaaatgaaaaaaaaaaaaaataaaaaaaacaaatataaaaaaaaaaaataaaaaaaaaggtgtgaattaatttaaagttgttaaagtttataacacctattaaaatagatgaattgtaatggattatttgaacttaaaggggggggcccttt

SEQ ID NO: 56753 - DNA, 576 bp, Zea mays
  Clone ID: LIB3068-059-Q1-K1-H7-Fa
gtataaaatatggtccaattccattcaatggcataactaggtagtatccccctctcctcatggctacatcccagccaacaaatgcatgtccacccacccaccccccaaaaaaaatcccccagcaacaattaattcgattattgcgacacaataattggaaagctaaggtaaaaaaattgtaacagacttgtctctaccaaaaccaactaccatggtgcgaaagcagctggaatgttattacagagtccagcagtaatagcatagaacggtcaaccctgtatccgtccgatgggaatcctatatgccgatcttcttctcaaacttctggatctgattcaagaatatccaggtcatcatgacatggggtgcaatcctgacgcagtacaccgggaaaccagtgtagaacttgaatgggccaccgctcttgaaggtcttcacagcacagtccaaagaccctgtgtatgggtacttgccattagcatcaggttgcatcttctgaatctgtgtcttcacatagtcaaagggcaaactgcatgctgaggcgaagaatccagaaacagcgctggctccaacaac

SEQ ID NO: 56754 - DNA, 279 bp, Zea mays
  Clone ID: LIB3068-005-Q1-K1-C4-R3B
aacccaagccctccaaacaggctggaagcgccaaatcttctggggctgggtcctgctgagttccgcacgccactcgttaactcatacgatcctcacttcattgaacttgatgtgctctccacacgctgttgatctcttttaggcgcatagtaatgaccagctatcagaactaagacccgacgctgacatgactgctgacgagcgcccaaccttatgtgcctcaatcataggagactccggctcccaagcccacggtccagaagataccgttacaagatt

SEQ ID NO: 56755 - DNA, 437 bp, Zea mays
  unsure at all n locations
  Clone ID: LIB3068-005-Q1-K1-C4-R4B
tatattnctcntgttgtccgatcttgagtataagctaagcgtgcaagctttgtctccacactactaactacgagatgaactgtttccatttccttctggaaggcacttagatctccatggatgattgtaacctcttcctttgtggcttctgtaatttcttggcattcatctaaactacaatctacacgatcaatcctttcagcaagatgtttctctgcaacattaacactttctgaaacctgatccactagtttccccactacattgcaggcatctgataacccacgctttgtcacagacatcatatcaaaaaagttccaccccttccatcttatgaataaatagccaatagctccttcaataacaacaggtgttataccgtatgcaccagggcccaggtttaccatcaacaggggacaattggaaaacatgaattt

SEQ ID NO: 56756 - DNA, 284 bp, Zea mays
  Clone ID: LIB3068-005-Q1-K1-C4-R5B
gcagatccttctgagatgattgacctgctgaacactcacagttttggactgctggtagacggcccatccttgcctgactttgcactctcggtcaagaacttgaaagcaccagatattgcatccctgaattcgggaaggccaaactcaccgcctgtcagtactgatccgacaattccggagccgatgacgatggcgacgtcgccaagaaccatggccgctgacgatggcgacgttgccaagagcccaagatctggaggactgcatcgccacctccgctggctttg

SEQ ID NO: 56757 - DNA, 243 bp, Zea mays
  Clone ID: LIB3068-036-Q1-K1-E2-F4B
ctaccctaagcttatcaaagaagcactgatactgtggttctacactgcctatgctgatgtttagggacccggcgatcggatcggggtatcagctggaagccctgtacctcgcctgtcattacccaatgtaaaccattggacctgcacacacatgttgccagctgatttagtaagtaccagggcctgaccatggggactatcagacgagcggggaatttgatgcctctcaacacacctgcagaa

SEQ ID NO: 56758 - DNA, 87 bp, Zea mays
  Clone ID: LIB3068-036-Q1-K1-E2-R3B
acctccgcccattctacaggactctcgtgctccaaccttgtatttctcctatagggctacgcattacagttcactgatcgaagatag

SEQ ID NO: 56759 - DNA, 361 bp, Zea mays
  unsure at all n locations
  Clone ID: LIB3068-060-Q1-K1-A4-R4B
gattccattaatcttgacatgcttcccattctttggtagatacaacagtgctggaagcgtctcactggcacgctgtggcggctttggatcgacaccatctgaaacattatcatgaggcccctcaacagccagcaccctcccacgatgagatggaccgtatgcagcaccttctccagcatcaacagagtcatacatccgatttactgcaggaatcaaacacccacaaagcattgcaacgcanatcaaccccaggagactaacacttgcaaccttcttggtcttcctagccttcttggccggtggctctgctacagcagatgcaggctgcgggggtttcagccgaggaattggcacgagcggc

SEQ ID NO: 56760 - DNA, 664 bp, Zea mays
  Clone ID: LIB3068-005-Q1-K1-C4-R3C
ttccttagaaaccaagccctccaacagggttgaagcaccagatctcctggggcttggttctgctgagtttcgcacgccactcgttttactcagaggatccttccttcattgaacttgctctgctgtacacacccggttgatctcttttaggtggtattgtagttccagctagcaaactaagacccgatgctgacatgactgtagatgagcgcacaaccttaggtgcctcaattctaggagactccggttccaaagccaggggtaaagaagcaaccctaacaattctctctgaggattcaatagcaggacgagaagttgatgatgtaacctgacgagtatcagctttcgggctctgatccaatcttttagtgaattcacacaaatcatatattcctcgtgttgtccgatcttgagtataagctaggcgtccaagctttgtctccagactacgaactacgagatgaactgtttccatttccttctggaaggcacttagatctccatggatgattgtaacctcttcctttgtggcttctgtaatttcttggcattcatctaaactacaatctacacgatcaatccttccagcaagatgtttctttgcaacattaacactttctgaaacctgatccacttgtttcccactacattgcaagcatctgat

SEQ ID NO: 56761 - DNA, 561 bp, Zea mays
  Clone ID: LIB3068-005-Q1-K1-C4-R3D
agttcccagaaacccagcctcaaacgggttgaagcaccagatctcctggggcttggttctgctgagtttcgcaccgcccactcggcaactcagaggatcccttccttcattgaacttgctctgctgtaccacacccggttgatctcttttaggtggtattgtagttccagctagcaaactaagaacccgatgctgacatgactgtagatgagcccacaaccttaggtgccctcaattctaggagaatcccgttccaaagccaggggtaaagaagccaccctaacaattctctctgaggattcaatagcaggacgagaagttgatgatgtaacctgacgagtatcagctttcggcctctgatccaatcttttagtgaattcacacaaatcatatattcctcgtgttgtccgatcttgagtataagctaggcgtccaagctttgtctcccgactaccaactaccagatgaactgtttccctttccttctggaaggcacctagatctccatggatgattgtaaccctttcctttgtggcctctgtaatttcttggcattcatct

SEQ ID NO: 56762 - DNA, 602 bp, Zea mays
  Clone ID: LIB3068-005-Q1-K1-C4-R4C
acaaatatatattcctcgtgttgtccgatcttgagtataagctaggcgtccaagctttgtctccagactacgaactacgagatgaactgtttccatttccttctggaaggcacttagatctccatggatgattgtaacctcttcctttgtggcttctgtaatttcttggcattcatctaaactacaatctacacgatcaatccttccagcaagatgtttctttgcaacattaaccactttctgaaacctgatccacttgtttccccactaccattgcaagcatctgataacccacgcttcgtcaccaaacatcatatcagaaagtttccaccccttccatcttatgaataaatagcccatagctcctcccataacaacagctgttatacccgtatgcacccagggccaggtctaccatcaacagtgaccaatggaaacatgatttgatttagacaacatttgcagctcctctctgagatgattgacctggctgaacaactcagcagtatgtggactgctggtagacggcccatccttgcctggctttgcactcttggtcaagaacttgaaagccccagagattgcatcccctaagtcgggaa

SEQ ID NO: 56763 - DNA, 571 bp, Zea mays
  Clone ID: LIB3068-005-Q1-K1-C4-R4D
acaaatatatattcctcgtgttgtccgatcttgagtataagctaggcgtccaagctttgtctccagactacgaactacgagatgaactgtttccatttccttctggaaggcacttagatctccatggatgattgtaacctcttcctttgtggcttctgtaatttcttggcattcatctaaactacaatctacacgatcaatccttccagcaagatgtttctttgcaacattaacactttctgaaacctgatccacttgtttccccactacattgcaagcatctgataacccacgcttcgtcacaaacatcatatcagaaagtttccaccccttccatcttatgaataaatagccaatagctcctccaataacaacagctgttatacccgtatgcaccagggccaggtctacccatcaacagtgaccatggaaacatgatttgatttagaccaacatttgcagctcctctctgagatgattgacctggctgaacaactcagcagtatgtggactgctggtagacggcccatccttgcctggctttgcactcttggtcaagaacttgaaagcc

SEQ ID NO: 56764 - DNA, 670 bp, Zea mays; identical to SEQ ID NO: 5509
  Clone ID: LIB3068-035-Q1-K1-H11-A

SEQ ID NO: 56765 - DNA, 804 bp, Zea mays
  Clone ID: LIB3068-035-Q1-K1-H11-F3F
acccaaatattttattgatgcaaacgctgtacctagaggatagggatagaggtttagggaaaaatcgaaatgaaataaattaatgaataaagccaaaaaaataagtcgaagattgaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatgggccaaaaagcaaaaaataaggatcgtttagccttataaagaaacgatcttgaccttttacctatgacgtgagtctgagaaa

SEQ ID NO: 56766 - DNA, 705 bp, Zea mays
  unsure at all n locations
  Clone ID: LIB3068-035-Q1-K1-H11-F3G
tagcctacttagtactatccggcgnnnnnngattaaagccaaaaaaataagtcgaagatagaagagcccagattcaaaatgaagaaatggaaactcgaatggatccttctgattctcaaagaatgaggggcatggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaacgaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttag

SEQ ID NO: 56767 - DNA, 253 bp, Zea mays
  unsure at all n locations
  Clone ID: LIB3068-035-Q1-K1-H11-F4D
aatatatctgaacgccggagcctgcagagactaagccgcttttatcgtttctcatgcgggcgcgccaaccgagtgtgtgnaactgctacgacgagttcaaaaagagtnntttttaacccccttcattaaccctctccttattctctcttgacaatgacatatacgccctccgcaactaaatatcaataaatgacaatggtgatacccatcaataacccagcataggatagaaaacacatactcttaactaccc

SEQ ID NO: 56768 - DNA, 444 bp, Zea mays
  unsure at all n locations
  Clone ID: LIB3068-005-Q1-K1-C4-F4A
agggttgcttctttacccctggctttggaaccggagtctcctagaattgaggcacctaaggttgtgcgctcatctacagtcatgtcagcatcgggtcttagtttgctagctggaactacaataccacctaaaagagatcaaccgggtgtgtacagcagagcaagttcaatgaaggaaggatcctctgagttgccgagtggcgtgcgaaactcagcagaaccaagccccaggagatctggtgcttcaaccctgtttggagggcttgggtttctaaggaactacaccagctgagatgtatgtgctcagataggtgttttttttcccaaggagaccagcagtttgagctgtatatgtaggtagtaggtaatagggcagttgccaaaaggacggctcccttttcctattgggaatngcgaatttttgtaggaactaataccttgcaaa

SEQ ID NO: 56769 - DNA, 484 bp, Zea mays
  Clone ID: LIB3068-024-Q1-K1-E10-F2A
gccaacctcggtcacttggaaaaacttcatgagtccctctttaaggagaaaaaggaaaccgatcaaaaaccatctctgcatctactgcctctatactttgcctttgatacggctgagtagcaaccttataaccaaagcacccgattcaaacccaacccatacatacaacactatcaataaaaccataccataagagcatgcggccactgcctggttggccggttcacgcggcgtcggtccggccggctttccaggactcgtactccgggtcgtcggtgggcagctcgaagcggcagagcgggcacgagttgcgcacctggagccagggcacgatgcagccgtcgtggtagcggtgcgagcacggcagccgcttgacgcgctggccgaccgcgaccccgtccttgcacacagcgcactcatccccctggacttcctggccggccgcgacgacggcggacgggagcgcctcgacggcggatctggc

SEQ ID NO: 56770 - DNA, 325 bp, Zea mays
  Clone ID: LIB3068-024-Q1-K1-E10-R2A
ggcggcggcgtactaggtgctcgtagcaggcggggaggggctgttcctcaagaccaagcccccggccgccagatccgccgtcgaggcgctcccgtccgccgtcgtcgcggccggccaggaagtccagggggatgagtgcgctgtgtgcaatgacggggtgatgtggagtacatgatcataaagccagattgtttggaacacgttgtgatgggaatcaacggccagttgccaggcccaactattatggctgaagttggtgacattcttgacattgctctcaccaacaagcttttcactgagggaactgttattcactgggatggaa

SEQ ID NO: 56771 - DNA, 689 bp, Zea mays
  Clone ID: LIB3068-036-Q1-K1-E2-R4A
tgccgtggtctatgaatgcttgcaaagcttggtcgggcatcgtgttgaccgtgtcaggtccgatgagactgtccacataaagagtgtcaggataagctgggttcttgacaccggtggatgcccacaacaacctttgtttcttggcacctttcttggccaacgcctcccaccttgggccagagaatttcttctggtagagccgatttgctagtttggcctgcgctactgcagcctttcctctcaaggcaagggcctcaggtgttccaatcttgtcaagcattttgtcaataagggtgtccactcggctgacaaagaaggatgcaacgctagtaactcgggataagtcactcaagccagaagcctctagcccatcgaggtaagcatcaatcacagcctcatatctcgcaattgagaaaataagcgtgacgttgacgctaatgccattagcgataacttcctggatggaaggaacacattctgcagtagctgggatctttatgtagacattggggcggttgaccactttgtgtaaccactttgccgcttcaacagttccttgagtgtcatttgccaacctaggagacacctctacggagacatacccatcagccccatcagtctcgtcgtagatgggctcaaaagtttgcacgcatcttggatatcctttataacgaagtcccagtaagcgc

SEQ ID NO: 56772 - DNA, 422 bp, Zea mays
  Clone ID: LIB3068-002-F12-F3A
gctagcagccacatatgcggagaccgtcacaatactaagagctcggtaattacctgaactggacgaagttcctgtaaatcccatctgaacaaagtgtgcctgtacacacctgggctacatgacaagcgcgttcttggcagcaactgtggtgctacaatggaggatgctgcgtatgtgaggagcatggatgaaattgaaccttaagttcgtggatcagacagccttgggacgcctggcctcatgatggatgattgggcataaatgttgctggaaacgaagaatcagggagattggagaggagaaggggcacctaaaggctgatcaaggcaccttgaatgggagcaaaatgcacactatgcacgattgccacttgatatgaatgcctaatcatgcatgtctctatgcataatgcacccatgaac

SEQ ID NO: 56773 - DNA, 358 bp, Zea mays
  Clone ID: LIB3068-002-F12-R3A
acccctgtccatcctgaactgtacaattctcctgtaatccccagtgcaacgtccccttactcgaagcaactggcctgatccaagcacatgcttcacgggggttgtatcactgaagtttggaaagtcagggagctgttcagtctggaagctttggaacatcaggtacgtttcttggaaagcctttgaagcctgtactttcaggtcacctagggtagcacttgctggtagaagtacaagttcttctggaggtgtcgtgtaatcttttgggtgatcaagcagttcaatggagcacctcacacagagcaggaatgggtttgaaggagtccgcagagcatgctcatcataatgtttgatgaac

SEQ ID NO: 56774 - DNA, 550 bp, Zea mays
  unsure at all n locations
  Clone ID: LIB3068-024-Q1-K1-B6.F2
agcaagcggagagatacaactattttccacaacagggacatcaaatctaagaggaccattacaatccggcgcgccggatttatagagcaggcaagctagctactaggcgggtggggtgggggactggggaaaggacacagcaaagaacccttctaacagatccgcggatcccgcagcgcgctcagttgctggtgaacttggtgacggccttggttccctcggagacggcgtgcttggcgagctctccggggaggactaggcgcacggaggtctggatctcgcgggacgtgatggtgggcttcttgttgtaccgcgccagcttggcggcctcgccggccagcttctcaaagatgtcgttgatgaaggagttcatgatggacatggccttggaggatatgccgatgtcggggtgcacctgcttcagcaccttgaagatgtagatcttgtaggtctccacgctcttcttggccttcttcttcccctttttctcgccgccctccttgccgngagacttggacgcgggcagccgcttctcgggcttgggcttctt

SEQ ID NO: 56775 - DNA, 673 bp, Zea mays
  unsure at all n locations
  Clone ID: LIB3068-024-Q1-K1-B6.R2
tctcgccagnaagcaaggaaaactagnaaaaggctgcctcccgaccgcnnaacgcccctcatctccctgcgaccccgacatccccngacccgatgggcgcccaagggcggagaagaagccagcgngagaagaagccggcggccgaggagaaggcggagaagacgaccgcagggaagaagcccaaggccgagaagggggtgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatcacgtcccgcgagatccagacctccgtgcgcctagtcctccccggagagctcgccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaatccggcgcgccggattgtaatggtcctc

SEQ ID NO: 56776 - DNA, 596 bp, Zea mays
  Clone ID: LIB3068-027-Q1-K1-E6-F11A
atcgaagctacgccgacgccggtggaggaggtgcacagccgcaggtggtcgtggtcgtcgacgtggacgtggagcctgtcacctgcgccggcgccgccgaggcagctgcgggagcaggggcagatgcgtccggcgtggccgacggcggcgtccatggacccatggcgccgccggagcagctggcgatcaagcccgacatggccatttccgtggaggcgtaggttggttaaagtgtaatagcagagtgagtcgacgatatcgatcagtagtaggtttgtcgagtcaaggaagtggcctgctgctgctactacgcgacagcagcggccagatgcactgcctgcatgcatgcagtccctcccgttgactcgacccgtagagatgggatggaacggaagtagcggcgccttggcacccacgggccagccgtactggcctgtgtgatgaaccggcgagagagatatgagataatgtgcgagcgagagagggttgggttgtggtagttgaagaagacggctagctaggtgctgctgggctctctatctgtctctagatctgtgtgtgtctgtgtaatcgattccctcagcttgcttgccgcc

SEQ ID NO: 56777 - DNA, 547 bp, Zea mays
  Clone ID: LIB3068-046-Q1-K1-G7.F2
gaaccaataactgactagtcactagattagtcaatgaagcaggtacagaaagttgtgacacaagtggttagcaaaaaaaaagcacagaacagctagcagcatttggctttttttttgctaatgcactaaactaacgacatcgcgaaactaatagatccccttcataaacacctgtttgaaacaacttaacatttaaaggcagcaaaacagtaagctaattggggacctaacacttgatttgctacctcgtggccttggagacagtgtttactcatcgtcatcgttttcctcgtcactgctgccatcctcgtcatcaacctttgacttcgagccatcctcatcctcagtcttagccttctttgagcttgtgctctccttcttatcaaagtttgccttagtcttctaatagtcctgcttcttctgcccagcttggtccacatatggttgcttctcttgatctgacatagcacgccacttttcccctgctgccttgctcacggtcgcaacgctcttgttgccagggtgcagcgcctgatactcctgcctg

SEQ ID NO: 56778 - DNA, 615 bp, Zea mays
  unsure at all n locations
  Clone ID: LIB3068-046-Q1-K1-G7.R2
ngacgcgctcccggtccgaaggcaaaccagccaccagtcccaccaccaccctctgtcttcgcctccgctgccgattcgaaagccccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctgggcagaagaagcaggactatgagaagactaaggcaaactttgataagaaggagagcacaagctcaaagaaggctaagactgaggatgaggatggctcgaagtcagaggttgatgacgaggatggcagcagtgacgaggaaaacgatgacgatgagtaaacactgtctccaggccacgaggtagcaaatcaagtgttaggtccccaatagcttactgttttgctgcctttaa

SEQ ID NO: 56779 - DNA, 552 bp, Zea mays
  Clone ID: LIB3068-061-Q1-K1-D4.F2
agtcctgtatgtttcattgcgcgttacattcatataacaaaatcacagacatgtttttcgacacattgacacacagactagatcatatatgtgactgaaacacagctgtcactcttagcttgcatagagtatgatgctgccaccgcatctttatttatttcctttgcctcaagatccatcttcagagtagccatgttggcatgaagttattcatatgctcaggagcgaacccgatctgcagggttggctctgctgcagcttccaggggatgaaagaacaaaccattgccaacatgtgatggggcctgctgttgaggagagtgcctctcgtagccgagtaagttggcaccgtgctcccacacttggccatgcacctggttgctggtctcctccagctttcttctaaggcacttatttgcttcacacagcatttgctccctcctctgaagatcagtgagctgatcaagcatatgttgtgtccttgtggatcttatgtgccttaaggatgaatcaagttgcttctcaagctgctcaagctctttgacaccaagtg

SEQ ID NO: 56780 - DNA, 550 bp, Zea mays
  Clone ID: LIB3068-024-Q1-K1-E10-F2B
gccaacctcggttacttggaaaaacttcatgagtccctgtttaaggagaaaaaggaaaccgatcaaaaaccatctctgcatctactgcctctatacttgcctttgatacggctgagtagcaaccttataaccaaagcacccgattcaaacccaacccatacatacaacactatcaataaaaccataccataagagcatgcggccactgcctggttggccggttcacgcggcgtcggtccggccggctttccaggactcgtactccgggtcgtcggtgggcagctcgaagcggcagagcgggcacgagttgcgcacctggagccagggcacgatgcagccgtcgtggtagcggtgcgagcaccgcaaccgcttgacccgctggccgaccgcgaccccgtccttgcacacagcgcactcatccccctggacttcctggccggccgcgacgacggcggacgggagcgcctcgacgggggatctggcggccgggggctcggtcttgaggaacagcccctccccgcctgctacgagcacctcgtacgccgccgcc

SEQ ID NO: 56781 - DNA, 287 bp, Zea mays
  Clone ID: LIB3068-005-Q1-K1-C4-R5F
cagctcctctctgagaagatcgacctgtatgaacaactcagcagtatgcggactgttgggagacggcccatccgcgcctgggggggcactcttggccaagaacttgagagcaccacacatggcatccctgagccgggaaggccaaactcaccgcctgtaagtactgatccgacaatgccggaggcgatgacgatggcgacgatgccaagaaccatggccgatgacgatggcgacgttgccaagagcccaagaactggtggactgcagcgacacctccgctgccttgg

SEQ ID NO: 56782 - DNA, 421 bp, Zea mays
  Clone ID: LIB3068-021-E12-A4P1-A
aagcatctttagttctacagcggccgccaccgcggtgaacagaagcaacgatgatcagctgggtgtagcaagcaagccatggaggatttagggcgcttgagctggcagtagtttctcaacaagtagcgtggactttggtttgcacgattttgcatggaacactggaggggagacccgtgaagtttgactaaagtatgtagactgcgggaagatgctgttcagctgatgtgtgaatgtaagtacatacaaagactatagatgaaaactgatgttgcgtgagagactatttgtgtgtgtttttcttgttctttccaccaagcaatggctagaattcggttgagctgttgaaattgtctcctgtataaatcagtgacatgtcatactattttccaactggatttaacagagcctttatccttct

SEQ ID NO: 56783 - DNA, 609 bp, Zea mays
  Clone ID: LIB3068-021-E12-A6P1-A
cccacgcgtccgcccacgcgtccgcggacgcgtgggatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatggtgatgattcggtctctcaagacgaggcagtactgggattttccagtgcaatgatttggctgggagtcatgaccctgatgacagcactcctatcagagtttgttgtgagcacaattgaggcagcatcggaatcttgggagctatctgtcagtttcattagcgtcatcttgattccaatagttggtaatgcagcagagcatgctg

SEQ ID NO: 56784 - DNA, 702 bp, Zea mays
  unsure at all n locations
  Clone ID: LIB3068-021-E12-B1P1-A
ggggcggcaccgcggggaacagttttcatctataggctttgtatgtacttacattcacacatcagctgaacagcattttcccgcagtctacatactttagtcaaacttcacggtggtgccatccagagtgccatgcaaaatcgtgcaaaccaaagtccacgctacttgttgagaaactactgccagctcaggcgccctaaatcctccatggcttgcttgctacacccagctgatcatcgttgcttccatttccatgctgtctcaaaacgaaaaagcataaggagatgacaatgtagcaaaacacaagcagcagtcccttcagataatgtgatgatccatcctggagcgtgaaggccgttactaatattgcaagaaacaaacaaccagtctcaagcaagttgaaatcaagatccatcgggactcccatgatccatgctacaaggacactcaatggcaccacaaacatggaaatctgcgtagcggaccccaaagatactccgagggtgatgtccagattgttttaaacgcanatatcactgcaccagcatgctctgctgcattaccaactattggaatcaagatgacgctaatgaaactgacagatagctcccaagattccgatgctgcctcaattgtgctcacaacaaactctgataggagtgctgtcatcagggtcatgactcccagccaaatcattgcact

SEQ ID NO: 56785 - DNA, 54 bp, Zea mays
  Clone ID: LIB3068-021-E12-B3P1-A
tagtatagcagcggccgccaccgcggtgaacattaacagagcctttatccttct

SEQ ID NO: 56786 - DNA, 493 bp, Zea mays
  Clone ID: LIB3068-021-E12-C1P1-A
cccacgcgtccgcccacgcgtccgcggacgcgtgggatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatggtgatgattcggtctctcaagacgaggcagtactgggattttccagtgcaaatgattggctgggagtcatgaccctgatgacagcact

SEQ ID NO: 56787 - DNA, 102 bp, Zea mays
  Clone ID: LIB3068-021-E12-C2P1-A
cggccgccaccgcggtgaacagaaactaaattttttattgaataggtgataggacttgatctgtcaggatccaattatgaccaagagacgttcctgtgtgat

SEQ ID NO: 56788 - DNA, 712 bp, Zea mays
  Clone ID: LIB3068-021-E12-C5P1-A
tagtactacagcggccgccaccgcggtgaacactcaaccgaattctagccattgcttggtggaaagaacaagaaaaacacacacaattagtctctcacgcaacatcagttttcatctatagtctttgtatgtacttacattcacacatcagctgaacagcatcttcccgcagtctacatactttagtcaaacttcacgggtctcccctccagtgttccatgcaaaatcgtgcaaaccaaagtccacgctacttgttgagaaactactgccagctcaggcgccctaaatcctccatggcttgcttgctacacccagctgatcatcgttgcttccatttccatgctgtctcaaaacgaaaaagcataaggagatgacaatgtagcaaaacacaagcagcagtcccttcagataatgtgatgatccatcctggagcgtgaaggccgttactaatattgcaagaaacaaacaaccagtctcaagcaagttgaaatcaagatccatcgggactcccatgatccatgctacaaggacactcaatggcaccacaaacatggaaatctgcgtagcggaccccaaagatactccgagggtgatgtccagattgtttttaaacgcaaatatcactgcaccagcatgctctgctgcattaccaactattggaatcaagatgacgctaatgaaactgacagatagcttccaagatttcgatgct

SEQ ID NO: 56789 - DNA, 477 bp, Zea mays
  Clone ID: LIB3068-021-E12-C6P1-A
cggccgaaccgaggggaacagagggtgatgtccagattgttgttaaacgcaaatatcactgcaccagcatgcctttctgcattaccaactattggaatcaagatggggctattgaaactgatagattgcggcccaaaattcctatgctgtctcacctgagctcacaccaagctctgataggagtgctgtcatcaaggtcatgactcccagccaaatcattgcactggaaaatcccagtactgcctcgtcttgagagaccgaatcatcaccatcttcaacctattggggttggggctcacataattcccacaaggttaacaatttgctatgacaggtatgatccatactctacgaacatgaccatgatgcatgctcgggacaggtccatgcctatgtccaatgaggattgtgcgggctccccggagcttacagcttatattatcatttgtggcagacagtggcttaccacaccttgaa

SEQ ID NO: 56790 - DNA, 170 bp, Zea mays
  Clone ID: LIB3068-021-E12-D2P1-A
cggccgccactcgcggtgaacagttccaaggttagccaggccaccaaagaaaagggaggttccaaggacaagcaacttgttggacaagactgagcctagcagggagcatttcaccaccactaccttgccttgatcccacgcgtccgcggacgcgtgggcggacgcgtggg

SEQ ID NO: 56791 - DNA, 526 bp, Zea mays
  Clone ID: LIB3068-021-E12-D3P1-A
cggccgccaccgcggtgaacacttggaactgagcagctatacgacaaaatgcaagtagatgtcagcacaggacttttgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatggtgatgattcggtctctcaagacgaggcagtactgggattttccagtgcaatgatttggctgggagtcatgaccctgatgacagcactcctatcagagtttgttgtgagcacaattgaggcagcatcggaatcttgggagctatctgtcagtttcattagcgtcatcttgattccaatagttggtaatgcagcagagcatgctggtgcagtgatatttgcgtttaaaaacaatctggaca

SEQ ID NO: 56792 - DNA, 396 bp, Zea mays
  Clone ID: LIB3068-021-E12-D4P1-A
gccaccgcggtgaacaattggaatcaagatgacgctaatgaaactgacagatagctcccaagattccgattttgcctcaattgtgctcacaacaaactctggtgggagtgctgtcatcagggtcatgactcccagccaaatcattgcactggaaaatcccagtactgcctcgtcttgagagaccgaatcatcaccatcttcaacctctcgcggttggggttcaaatagtcggcggtgggttttcagttggaagaaaaggtaggctacataggcaaggagcatgacaatgctgcatgctcgggacagctccagtcctgaatcccaagaggattctgcgtgctccccggagctcacagcatatctcagcatcagtggcagagagtgcggtgaaagccg

SEQ ID NO: 56793 - DNA, 557 bp, Zea mays
  Clone ID: LIB3068-021-E12-D5P1-A
aagaaggataaaggctttgttaaatccagttggaaaatagtatgacatgtcactgatttatacaggaaacaatttcaacagctcaaccgaattttagccattgtttgggggaaagaacaagaaaaacccccccaatttgtttttcacccaacatcagttttcatttataggctttggatgtacttacattcacacattagctgaacagcattttcccgcagtctacatactttagtcaaacttcacgggtctcccctccagtgttccatgcaaaatcgtgcaaaccaaagtccacgcttcttgttgagaaactactgccagtttaggcgccctaaatcctccatggcttgcttgctacacccagctgatcatcgttgcttccatttccatgctggctcaaaacgaaaaagcttagggggatgacattgttgcaaaacacaagcagcagccccttcagataatgggatgatccatcctggagcgggaaggccgttactaatattgtaagaaacaaacaaccagttttaagcaagttgaaatcaagatccattgggact

SEQ ID NO: 56794 - DNA, 623 bp, Zea mays
  Clone ID: LIB3068-021-E12-D6P1-A
ggccgccaccgcggtgaacactccgagggtgatgtccagattgtttttaaacgcaaatatcactgcaccagcattctctgctgcattaccaactattggaatcaagatgacgctaatgaaactgacagatagctcccaagattccgatgctgcctcaattgtgctcacaacaaactctgataggagtgctgtcatcagggtcatgactcccagccaaatcattgcactggaaaatcccagtactgcctcgtcttgagagaccgaatcatcaccatcttcaacctcttggggttggggttcaaatagttggcggtgggttttcagttggaagaaaaggtaggctacataggcaaggagcatgacaatgctgcatgctcgggacagctccagtcctgaatcccaagaggattctgcgtgctccccggagctcacagcatatctcagcatcagtggcagagagtggcatagcacaccaagaatcagaagtcctgtgctgacatctacttgcattttgtcgtatagctgctcagttccaaggttagccaggccaccaaagaaaagggaggttccaaggacaagcaacacgttggacaagaactgacctagcagggagcattttacca

SEQ ID NO: 56795 - DNA, 699 bp, Zea mays
  unsure at all n locations
  Clone ID: LIB3068-021-E12-E1P1-A
cgccgccaccgcggtgaacaaataccaagtgatnntatattaattacacgggnnncggncctntttnnnncccnncctctttttttttgtcctggtccgcctgtatctccctccgagggggattattttcccttcctcttatggactctctctccttcacctatgccttcatttaatgttacctcatactccacaaagccgccctagagcatcagctgacgtgcctgcccatgtcctataatctaatacatgtacctgcaacagcttcaatcccaagctccaggtttacgctcctattggttgccgactntggtaggaacgcgccgacgcgggcctcagcttaggagccaggaggcggagggggtgcagaaattttatatcttctccaccacggtaaagatgtcgctctccttgtactacaagggtggacccggcggcccatgaggtggaggcggtatctttacattcattgctacgcggcatgaggccgacgaggtggagcacggagaaagccgatccnctcctctatgcttttacgagcaatggacagcaggccggtgggttcttttcctcaccccgttcgtttcgccgtctggaaccatcgaagctattccangatttgaggagttttttctcggatacttatgtgtccttcttgaacctgagtttccttcaagcgatcacctgtacaaccacttt

SEQ ID NO: 56796 - DNA, 480 bp, Zea mays
  Clone ID: LIB3068-021-E12-E4P1-A
cggccgccaccgaggtgaacacaaatactgaaggattagcgtgagatccttttgttctgcacttaaagagctgttttccaacgaatacaccactggttctggtggtggtgtgaccagcggatgatgacctaccaactatttttccgaagaccgctgggtactgaagacggcagataccagattgtgctcaagggccagcgcttaacggagggttatatcacacatctcaacattgaagcggatcgaccaacacgctaacggatatacctacagcttcatgctatgacaaacgcctggctcacggatcgaagaaagtggcacaggttttggcacagcaggagggacaggacagcaaatcccacgatggcacttgctaagcgtaacgcctgatatgtttactagtaactgatggtataggcgacttttacttgaacaactgttctagaaatgctggggatttgagcaaagccatatataaaa

SEQ ID NO: 56797 - DNA, 389 bp, Zea mays
  Clone ID: LIB3068-021-E12-E5P1-A
cccacgcgtccgcccacgcgtccgcggacgcgtgggatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttttttcaactgaaacccacccgccactttttgaacccccacccc

SEQ ID NO: 56798 - DNA, 616 bp, Zea mays
  Clone ID: LIB3068-021-E12-F1P1-A
tacagcggccgccaccgcggtgaacacaaaccaaagtccacgctacttgttgagaaactactgccagctcaggcgccctatatcctccatggcttgcttgctacacccagctgatcatcgttgcttccatttccatgctgtctcaaaacgaaaaagcataaggagatgacaatgtagcaaaacacaagcagcagtcccttcagataatgtgatgatccatcctggagcgtgaaggccgttactaatattgcaagaaacaaacaaccagtctcaagcaagttgaaatcaagatccatcgggactcccatgatccatgctacaaggacactcaatggcaccacaaacatggaaatctgcgtagcggaccccaaagatactccgagggtgatgtccagattgtttttaaacgcaaatatcactgcaccagcatgctctgctgcattaccaactattggaatcaagatgacgctaatgaaactgacagatagctcccaagattccgatgctgcctcaattgtgctcacaacaaactctgataggagtgctgtcatcagggtcatgactcccagccaaatcattgcactggaaaaatccagtactgcctcgtcttgagaga

SEQ ID NO: 56799 - DNA, 311 bp, Zea mays
  Clone ID: LIB3068-021-E12-F6P1-A
agttatacagcggccgccaccgcggtgaacaatttccatgtttgtggtgccattgagtgtccttgtagcatggatcatgggagtcctgatggatcttgatttcaacttgctggagactggttgtttgtttcttgcaatattagtaacggccttcacgctccaggatggatcatcacattatctgacgggactgctgctggtgcttggctgcattggcatctacttatgctctctcgactacagacaccatggaaatgtaagcaacgatgatcagctgggtgtcgcatgcgatccatggaggatttagggcg

SEQ ID NO: 56800 - DNA, 188 bp, Zea mays
  unsure at all n locations
  Clone ID: LIB3068-021-E12-G2P1-A
ntttntttttttttttttttttttttttttttttttttttttttttttttaaaaaggataaaggctctgttaaatccagttggaaaatagtatgacctggcactgatttatacaggagacaatttcaacagctcaaccgaattttagccattggttggggggaagaacaagaaaaaccccccccaatt

SEQ ID NO: 56801 - DNA, 392 bp, Zea mays
  Clone ID: LIB3068-021-E12-G4P1-A
agttctacagcggccgccaccgcggtgaacagttttcagttggaagaaaaggtaggctacataggcaaggagcatgacaatgctgcatgctcgggacagctccagtcctgaatcccaagaggattctgcgtgctccccggagctcacagcatatctcagcatcagtggcagagagtggcatagcacaccaagaatcagaagtcctgtgctgacatctacttgcattttgtcgtatagctgctcagttccaaggttagccaggccaccaaagaaaagggaggttccaaggacaagcaacaggttggacaagactgagcctagcagggagcatttcaccaccactaccttgccttgatcccacgcgtccgcggacgcgtgggcggacgcgtggg

SEQ ID NO: 56802 - DNA, 284 bp, Zea mays
  Clone ID: LIB3068-021-E12-G6P1-A
acagagatgacaatgtcgcaaaacacaagcagcagtcccttcagataatgggatgattcttcctggggcgggtggtgtgtggcttatattgcaggaaacaagcggccatgatgcagcgagtatttgtgatcttcgatcggatctcccatgatccatgctacaagggcgctgggtgggaccacatgcacgggaatccgcgtatcggacccaaaggcttctacgcgggagttgctcaaagggcagggaagcgcctggtgcttgacgattatgctctgttgcacgac

SEQ ID NO: 56803 - DNA, 133 bp, Zea mays
  Clone ID: LIB3068-021-E12-H4P1-A
aaaaaggataaaggctctgttaaatccagttggaaaatagtatgacatgtcactgatttatacaggagacaattttaacagctcaaccgaattttatccattggttgggggaaagaaccaggaaaaccccccc

SEQ ID NO: 56804 - DNA, 592 bp, Zea mays
  unsure at all n locations
  Clone ID: LIB3068-035-Q1-K1-H11-F4E
aagttctctattgatgcaaacgctgtacctagaggatagggatagaggaagagggaaaaatcgaaatgaaataaataaagaataaagttttttaaaataagtcgaagatagaagagcccagattcaaaatgaagaaatggaaactcgaaaaggatccttctgattctaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagtgccagagtacaataacctctggattgaaatactgctatatactgtatgccatantacagacatctgagatag

SEQ ID NO: 56805 - DNA, 568 bp, Zea mays
  unsure at all n locations
  Clone ID: LIB3068-035-Q1-K1-H11-F4F
aagttctctattgatgcaaacgctgcacctagaggatagggatagaggaagagggaaaaatcgaaatgaaataaataaagaataaagcataaaaaataagtcgaagatagaagagcgcagattcaaaatgaagaaatggaaacgcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttaggcttcgggacggagtggaagaagggcggagactctcgaacgaggaaaaggatcccttcgaaagaattgaacgaggagccgtatgaggtgaaaatctcatgtacggttctgtagagggacagtaaggatgacttatctggcgactnttccactgtcaaccccaaaaaacccaactctgccttacggaaagttgccagagtacgattaacctctggatttgaaatcactgcttatatacc

SEQ ID NO: 56806 - DNA, 665 bp, Zea mays
  Clone ID: LIB3068-035-Q1-K1-H11-R4C
taagggctaaaaacgaatcacttatttttttggctttttggccccatatttagaacgcccttgttgacgattctttactgcgatattatctagggttcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcatccttactgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcattttgaatctgggctcttctatcttcgactta

SEQ ID NO: 56807 - DNA, 563 bp, Zea mays
  unsure at all n locations
  Clone ID: LIB3068-035-Q1-K1-H11-R4D
agggctaaaaacgaatcacttatttttttggctttttggccccatatttagaacgcccttgttgacgattctttactgcgactgtatctagggttcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagncgacagataagtnatncttactgtncctctacagaaccgtacatgagattttcacctcatacggctcctcgttcaattctttcgaagggatccttttcctcgttcgagagtctcccgccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctc

SEQ ID NO: 56808 - DNA, 483 bp, Zea mays
  unsure at all n locations
  Clone ID: LIB3068-036-Q1-K1-E2-F4C
aaaagctgccccgggaggagaggcatacaggcagagggaaaaatctaaaggaaataactaaagcancacggctttttacacgacgaagagagaagaggcgggaatcaatacgaacaagcgggggcgccacccccaccccccgagtcacaagaccgaggggcaaggggaccgaccccgagaaagagcccgacggacaacccgacgcgacaaagagccgcaacaagattgggaacaccaacagagcccctgccttaagaagaaaggcaaagcgcgcacaggccacacgaaaacgtgactcaaacgagaaaaaatagtctggcccacggagtgaggtgaagccaagacacgcccacgaagcaaaggatccctgcgaaagaccccaacgacgagccccccgaggagccaaacacacgcacggggcacaggagggacagaccggacgccgtatacagccaaccccgccccaaccaaccccgaaaaacc

SEQ ID NO: 56809 - DNA, 328 bp, Zea mays
  unsure at all n locations
  Clone ID: LIB3068-036-Q1-K1-E2-R4B
agactgtccacataaagagtgtcaggataagcngtgnnctcgacaccggnggangcccacaggaaccttttttnaaggcaccttgggggccaacgcctcccactgggccagagaatttcttctggtagagccgatttgctagtatggcctgcgctactgcagcctttcctctcaaggcaagggcctcaggtgttccaatcttgtcaagcattatgtcaataaggggggccactcggctgacaaagaaggatgcaacgctagtaactcgggataagtcactcaagccagaagcctctagcccatcgaggtaagcatcaatcacagcctc

SEQ ID NO: 56810 - DNA, 449 bp, Zea mays
  unsure at all n locations
  Clone ID: LIB3068-036-Q1-K1-E2-R4C
gggaccgnggacgcacagagagactgtccacataaagagtgtcaggatgagangtgntctcgacaccggnggatgcccacgggaaccattgtttctaggcacctggaggcggccaacgcctaccacctcggccagagaatttctacaggaagagccgaaccgctagtatggcctgcgctactgcagccatacctctaaaggaaagggcctaaggtgctccaagctgggcaagcattttggcaagaaggggggccactcggctgacaaagaaggatgcaacgctacgaactcgggataagtcacgcaagccagaagcctctagcccatcgaggtaagcatcaatcacagcctcatatctcgcaatggagaaaataagcgtgacgtcgacgctaatgccattagcgataactccctggagggaaggaacacatgctgcagtagctgggatc

SEQ ID NO: 56811 - DNA, 403 bp, Zea mays
  unsure at all n locations
  Clone ID: LIB3068-036-Q1-K1-E2-R5B
gaaaatcgtngggtggctggtgactccacggacgccgctggcgataatgggcagcaattttgtgacagggcggcataggggggcggaccacggatgacaggcccgggagcgcgcacagacatgaagncgcagcccttggtcggtgcaccgcttccttcctgggccgaagccatcgcaatgatggggctcctggctcgcccggcgacggaaacgcggactcggcgcggggaaggggcgaaggcgagggcggcggtgcggagggacgccggccggagcggcggtgccgccggacggggcgccgccagcttggacaccgtgccggtcatcgccgctcgtcggggttggtgggaggcgcgaagaggggcgtgtgtttggtcgcgtccctcacggtggggggttgttg

SEQ ID NO: 56812 - DNA, 485 bp, Zea mays
  Clone ID: LIB3069-005-Q1-K1-C12.F4
ctcagtgctttcatccattgctgcagcattgtagcttatctctttcaaccgaaggacactgcatactggatctggtgacaggatactctcaaggtctgatgacgatggtacttgtattgaaaccattgctcttggcaccatatgacaacaacggcggtagcaaactggtgcttcctgcatcagattcatcatgcaataaggtgattttcatgatttcagcgttctcccctgatactccagcagtgcatcacaacacgcagcgcgctcgcgtaccgcctatgactctatggctgagcacaacaccctgtcctagctcctaaccttgctccggcaaaggccagaaagaatcacagaaacgactacgaacaacgaggaagaggcagcaatgaggcaagcaagctagcaaggctcaagaagcaagaagcctcactcgtggttcgtcccgcgtaattccccacctgtaactccaggcatcccacctttcc

SEQ ID NO: 56813 - DNA, 175 bp, Zea mays
  Clone ID: LIB3069-005-Q1-K1-C12.R4
tcggttctaggttgggtactatgtgagcccacaccgcacgcttctgtttgtggtccgtatccgagcaatcaatgccataccaccccaagaccgtggtatcatgcagctcctgcgtttgaggaaaatcttaaatggtgtctttctgcaggttaacagggcaactattatcatgcta

SEQ ID NO: 56814 - DNA, 631 bp, Zea mays
  unsure at all n locations
  Clone ID: LIB3069-006-Q1-K1-E1.F3
ttgtgcagctcagcgtgaggctcggttngagggtgggttctatgtgagcccagnagccaagcttctgtttgtggtccgcatccgtggtatcaatgccatgcaccccaagacccgcaagatcttgcagctcctgcgtttgaggcagatcttcaatggtgtctttctcaaggttaacaaggcaactattaacatgctacggagggtggagccatatgttgcgtatggatacccgaacctgaagagtgttagggaattgatctacaaaagaggttatgggaagctgaacaagcagaggattccgcttagcaacaacaatgtcatcgaggagggccttgggaagcataatatcatctgcatcgaggaccttgttcacgagatcatgacggttggcccacacttcaaagaggccaacaacttcctctggccattcaagctgaaagcgcccttggtggcctcaagaagaagaggaaccactatgtggagggtggcgacgctggcaaccgtgagaactacatcaacgagctcatcaagaggatgaactaggctctcttgtatcctgtgagaatgctttcgatgtcggcatggatatgcaaatttgttccatgggctgtcatacgtcacgacttcacta

SEQ ID NO: 56815 - DNA, 252 bp, Zea mays
  Clone ID: LIB3069-006-Q1-K1-E1.R4
cgcctccttcctgtctgcggggccttctccttcttgtccgctgcccctgctcctcccgcttgcgcttgcgcagcacagactccgggaccgccttcgccgcggccttcgcctccgccgacgacatctcgatgacctgcgagtccgtgaagagaagaggccggccgccgagaaagggtgatacggcggggcggcgagacgtgagtagtttttgggagggcgagggttttgcggacgcgtgggcggacgcgtggg

SEQ ID NO: 56816 - DNA, 453 bp, Zea mays
  unsure at all n locations
  Clone ID: LIB3069-006-Q1-K1-F3.F4
gctattgttaagacgttgcaggncccccagcatggactccagnagcaaatttaaaagcaaagtttggttgaaccaaatgcataactgcagacatgcttgcagggctcatacagtccaaaccgaaggccaccatagacaacagctctcgccaacgctggtgcaagtcccaggtagagtgaccgagtcccttccctttcaaccatttgtgtaaatattgttccctaacatatttcacaatacacatataactaggaaatgaatttaacatcagaagaagtgtgaaatatgaaacctgtaggtgctgtgactttaagtaccattccaactaagtttcctctttgcccagcaagctgcatttgaagcctgactttgataacatctgcaggacgaaaatagtggtaggcctatataaagagtaacttaccaaaccccacgcgtccgcccacgcgtncg

SEQ ID NO: 56817 - DNA, 603 bp, Zea mays
  Clone ID: LIB3069-006-Q1-K1-F3.R4
aagttatagcgcacgagggtttaagcactttggaaggagtcggcccagcaatgacaagagcaggttgccttactgcatcacaaatggcgacttacgatgaggccaaacaggccttaatgaagtggacaccacttgaagaaggttttcagttacatctcatgtacagtgaattctctatttctctattatgatgtgtatcctttaatgagatgaatggatggctaatctttatctgcttggaagctcgagtttcatagctggaacagctggtactcttgtgacctcacctgtagacatgatcaaaacacggttaatgctgcaacaggagtccaaaggcgccagagtatacaggaacggattccattgtgcttcccaggttgtggtgacagagggtgtgaaatcactttataaaggtggatttgccacattcgcgagagtaggccctcagacaacgattacctttatcgtgtgcgagaaactgcgcgaacttgcaggaatgactgccatctagtgcgaccccaaattgcataatgtgtggggtccaacggttgaacagcatactctacccagagtttcacaccattctttattcaccattcatga

SEQ ID NO: 56818 - DNA, 435 bp, Zea mays
  unsure at all n locations
  Clone ID: LIB3069-008-Q1-K1-E12.F4
tttgccgtgcgctctccgtanacggcatccatatcgtgcagatttcaaaggatacaggatctatagctcgtcatggtagtcgtagtgcctatgacgcttatatctatccttgtatcggtccctgccgcggtccctatccctctcccgccttcgtctctccccttcctcccgtgccctccgtgcttcctcttcttctctagccttcctcttcttttcagctccttcaaaggcctccttttcagcctccttatttgcagcaaaagtttcatctacaacatgtcttgcatagtctgggtcatcgcaaatcaaaatgttgtcaaaaactgaaccagctttgacctgccatacttcaatccccacatactgcaaaggtttcagaacatataggtctgggtcatcctcaaactctggattgacaatccatggnggtcttcc

SEQ ID NO: 56819 - DNA, 446 bp, Zea mays
  unsure at all n locations
  Clone ID: LIB3069-008-Q1-K1-E12.R4
tttggcgatgggtagaaaatggncatcgcgtctgtaataaattccagttgcgatgcaatatgagctgtagtactgtcctcgcacttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgtttttagagagaacccaagtttacgaacccgggcatgcaacgtaaaagtttttttatagggccaccaaaattaaattaactggccggggtttaaaaacgtgggaactggaaaaaccctggggttacccaattaaatcgctttgaagaaaatccccttttcgccagttggggaaaaaagcaaaaaggcccgaaccgatcgcctttccaaaaagttgcccaccctgaatggcaaagggaacccc

SEQ ID NO: 56820 - DNA, 254 bp, Zea mays
  unsure at all n locations
  Clone ID: LIB3069-009-Q1-K1-A9.F3
tctgtgcagtgtgntatgtatgcaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaacactcatcgttgaggtgggagggcttaagtgaataaaaagcactaatcgttggattaag

SEQ ID NO: 56821 - DNA, 581 bp, Zea mays
  unsure at all n locations
  Clone ID: LIB3069-009-Q1-K1-A9.F4
agtcctcgtcgtcgtcgtcaggcacctccatccgtgacttcttgaacaggcgcgccccgttcgccttgtagaacccggcgttactcactggctgcggcgaggcgaagaactccgccatggcagttttagctggcgaatgggcgtggaacaggtcgatgtcctcgaaccactccagctccttgagcccaagagacgagtctttcttgtcgctggattcgtagtccgacagctcgaggaggtcctcgacggcccaaccggacggtggcaggaacggcgaggacggcacctcctgcggcagcgcgtccttgaccgtccttgttttggtggtcgtcccggcagctggcgcgctgatgacggccgcgggcttggagctgcccttgggcggcgccggcgggaggccctcggcgctggcgccgcagacggagctgaagccgacgcggatgccggtggcgaggtagcgctggtggttgccggagagcgtgccggngacgtggatgggctcgtcgcagtcgcggcagaggagcgccctgtcctcgacgcagaagatgaaggccggcctctcctggcacacgtcgcancgc

SEQ ID NO: 56822 - DNA, 265 bp, Zea mays
  Clone ID: LIB3069-009-Q1-K1-A9.R3
gccgcggcgtcgcccggacgggaccgctggtgcttgctggcgagcttgttggcggcgtggatctccacgtcgcagcgcgcgcacagcgccgcctcgtcggcgcagcacaccaccgtggccgccgcggcctcgcacgcgtcgcactggatcctcatgccgcccgcccctttcctacgtaatccggagcttccagtggagacaggcaggccagcagccgcctaaaaaaatccggacgcgtgggcggacgcgtgggcggacgcgtggg

SEQ ID NO: 56823 - DNA, 654 bp, Zea mays
  unsure at all n locations
  Clone ID: LIB3069-009-Q1-K1-A9.R4
cggccttcatcttctgcgtcgggccgggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaaggcagctccaagcccgcggccgtcatcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggnagtggttcgaggacatcgacctgttccacgcccattcgccagctaaaactgccatggcggagttcttcgcctcgccgcagccagtgagtaacgccgggttctacaaggcgaacggggcgcgcctgttcaagaagtacggatgggaggtgcctgacgacgacgacgaggactacttcatcgttcctgatcttggctgagatgagagatctctgcatgattctccagtcatgtgatgtgnggtatgtatgcaaaatatgtatgtataccatcat

SEQ ID NO: 56824 - DNA, 246 bp, Zea mays
  unsure at all n locations
  Clone ID: LIB3069-029-Q1-K1-E10.F3
gagcagtctctanaanatctttgcctctgaacggttagtttgctggtaaaaacacatctcctcgaataagcacagtgtccttggtctcagcaaactctgtgtaatgagtgactgtgtagtaaggacttgcttgtgtgcctcgtgctttatagtcttcaagtcctgtaaataccatgtatggcatctggacttgcatgaacatagtagtgtatccactttgttattccgttgtggaagggaagtgga

SEQ ID NO: 56825 - DNA, 268 bp, Zea mays
  unsure at all n locations
  Clone ID: LIB3069-029-Q1-K1-E10.R3
ctcaatttagcacgggngaatgctttcttgcatcatcagnagcagtaagatggagccactggatatcatcctgccttcgctcattgagcattccgtgtggattttgttgcactgattacaccatagacaattttgctgttttttaagcagttgatgattttcagggatttgagacataagttatattttttgctatatcattgtacccattaggtccataatgacattttgtaccatcttgatgtatttcccctgaatatttttgtgg

SEQ ID NO: 56826 - DNA, 220 bp, Zea mays
  Clone ID: LIB3069-030-Q1-K1-G11.F3
ggccgttgcccaggatcgtcccgcttgctgcttgcgcagcacaggatccgggaccggcttctccgcgggcttcgcctccgcccacgacatatagctgaacctgcccagcccgttgaagagagacgccggccgcctaaaagggtgatacggcggggcgactaggacgtgagtagttttcgggagggcgagggctttggcgacgcctgagccgacgcgtgga

SEQ ID NO: 56827 - DNA, 161 bp, Zea mays
  Clone ID: LIB3069-031-Q1-K1-B5.F3
cgtcggcacaaagctgtaacaccagaagttgccttcccctcagccatatcctcgtcccgtttatcatccatgggtgttcaatgcctcccagaccaaattcttcggagcgccgccgccgccgcctgtggcgctcctggcctgcaatgcggatgccctgagtg

SEQ ID NO: 56828 - DNA, 335 bp, Zea mays
  unsure at all n locations
  Clone ID: LIB3069-031-Q1-K1-B5.F4
agccagggtccgctggtgnagtaggacctatgttgccgaacgcttgggggagacagcgaagagcggcatgtgctggaggtccgggtcatggtccaggctgttgcaggcgatgtggtgcgtgttgtggttgcatttccaccaggcgatgctgaggccagtgaggcagtttccggagagcacctgcacgacgcggtccaggagcggatggcccgtgatgcggtggtggcccgagtcgtggcccatccagccggactggatccagacgaagccgatgagccccccagcgagcatgtgcgccgcccacgcgtccgcggacgcgtgggcggacgcgtggg

SEQ ID NO: 56829 - DNA, 323 bp, Zea mays
  unsure at all n locations
  Clone ID: LIB3069-031-Q1-K1-B5.R3
tttgtgttggaagtgaccgtctatccgttngagnattcatgcttcaattgtctgggttgttcgtcggctgttctattctgttcctcctatatcatggtaacgatatcgtgatccttgctctaagtcatggacctctgttttattaaggttatgtccattcgatttctcgctggcattgccaggattgtggatgcttttttatgttcatgatgttgtaagcttaatgaacggctggtaatgttatatgtagtaccaccaccccctgtaatctcagttgctgtggcagctttgactctctttggaatactagtatgtactccgta

SEQ ID NO: 56830 - DNA, 500 bp, Zea mays
  unsure at all n locations
  Clone ID: LIB3069-031-Q1-K1-B5.R4
ttctggcgcagtccgctgtcttcgtcctgaccganaagaggtgccgcagcggctgcttgagatcgccggtgtcgccgcgttctgggcttggtacccgttgctggtggcgtgcctgccgaattggtgggagagggtggcgttcgtgcttctcagctttaccatctgcgggatccagcacgtccaattctgcctgaaccacttctcgtccgatgtgtacgtcgggccacccaagggcaacgactggttcgagaagcagacggcaggcacgctcgacatcctgtgccctccttggatggattggttccatggcggcctgcagttccagattgagcaccatctgttcccccgcctgcctcggtgccaccttcggaaggttgcgccggcggtgcgtgacctttgcaagaagcatgggctgacctattccgcagcctccttctgggacgcaaatgtgcttacatggcaagacactcagggtctgccgcattgcagcccaggagcgc

SEQ ID NO: 56831 - DNA, 319 bp, Zea mays
  Clone ID: LIB3069-031-Q1-K1-F1.F4
ggtgtttgtgtacacagcaccacgcccaggatacacacggttcatggatgaagtttcgtggaggaggcctgaactccgtcggttgaacaccgaattttcacctgtatgactcgacgttgcgtttgggcttgctttggaccaccgcctcgatcctgtcgacgacctccggcgtcagcagtgggatgacatctagggccttcatgttctccacaatctggctttctttggtggctccagtgatcacagacgagacattggggttcgacgcgcacccacgcgtccgcccacgcgtccgcccacgcgtccgcccacgcgtccg

SEQ ID NO: 56832 - DNA, 114 bp, Zea mays
  Clone ID: LIB3069-031-Q1-K1-F1.R4
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggcccgttttaag

SEQ ID NO: 56833 - DNA, 413 bp, Zea mays
  unsure at all n locations
  Clone ID: LIB3069-039-Q1-K1-B8.F3
acttaaaaaaaaaaaaaaaaaaaaaaaaaaaaaaaaaaaaaaaaaaaaacaacacaaaaaaaaaaaaaaaaaaaancaaaaaaaaaaaaaaaaaaaaaaaaaaaaaaaaaacaaaaaaaaaaaaaaaaaaanaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaaaaaaaaaaaaaaaaaaaaaaaaaaaacataaaaaaaaacaaacaaaaaaaaactaaaaaacacataaataaaaaacaacaaaataaaatataaataataaataaaaaaaaaaaataaaaaaaaattaaaaacaaccaaaaacaaaaacaaaaaacaaatacaaaaacaaaacatcaaataacaacac

SEQ ID NO: 56834 - DNA, 436 bp, Zea mays
  unsure at all n locations
  Clone ID: LIB3069-039-Q1-K1-B8.R3
tgtgtngatgctccttgnatgctgtggctgactactcgnaaggctcagngggttacacatataactactatgaggacctcactccaaacgagttgttgagattgttgagatgcttagaagaggtgaaacaccccctcgaggtacacagcacccagagcgaaaaactgtggccctgccggggggaacaccaccttgcacggagagccgaaacctcctccatgcagggatctggatgcctgctaggtttgcttcggagcattacgagcacgcgcataacttggctcgtactgtaaggtgtgcaaactgcacacagcggaggctgtgttatttgtattctgaagctttcttgtgtttcgtcaagaaagcttctctaacttttatcctgcactatcagataaacggtaaattgatagacaataagatgttttcccagctc

SEQ ID NO: 56835 - DNA, 331 bp, Zea mays
  unsure at all n locations
  Clone ID: LIB3069-039-Q1-K1-E1.F3
cgggcttaccagggaggnagggcaggnctggntccaacgtcatctttcgaatgatatctgtcgccaagctgtgagccagcagttcatctccctcttggattcaaagattgccgccgccgaagctgaagaagagctcagtgattgatgaaaagaaaaagactggttgcgtaaatgctcgtgtgttccaacttcaaccaaatgctgtagaaatcttcaggaatttggttccatttttatgttattattagtagnagnaaacaccgaggatttggatcctgggaacgaacgacgtcgcgttggctttggctgggctcacaggaacgaatactga

SEQ ID NO: 56836 - DNA, 384 bp, Zea mays
  unsure at all n locations
  Clone ID: LIB3069-039-Q1-K1-E1.R4
acttcctctgnagtggcatcaacgatgtagtggccgacccaccttggttaatgtaataataataggcacaccggatgtgtcaaactgcagaaattcctcatcacttacatcaacttcaggttcctcatcagatgcagcactaacagaaacattaacttttggtatacctgtatcactcaaagcaacctttatcgcaacagctagcgcatctagcaaattaccatcagaactgaccacaagcccatcaatgtacagatcccagcagacctttccatcaacaacaattagggatgacagatcaattgcagcaccagcaccacttttaccacccaacaagcatctttgcagggaaacagagagctcagcagacaattcttcagagcc

SEQ ID NO: 56837 - DNA, 246 bp, Zea mays
  Clone ID: LIB3069-040-Q1-K1-F10.F3
gtgttacatcaggagaaaacttcctttcactcgctggtgggctggtggacggcccagcgttgtttcccagggcttcaaatcatccagagagaacatgacatcgttgcgactttgaaaggaatttgtatactcaaatcgcatacctgatgcctagaacagcaacagcaacttccgacttaactctatcactttcttccttcttggatatctaataacaataaaaaaaaaaaaacaaaacaaaacaaa

SEQ ID NO: 56838 - DNA, 79 bp, Zea mays
  unsure at all n locations
  Clone ID: LIB3069-041-Q1-K1-F8.F3
aaaaagaaaaaaaaaaaaaaaaaaaaaaaaaaaaaaaaaaaaaaaaaaaaaaaaaaaaaaaaannaaaanaaaaaaaaa

SEQ ID NO: 56839 - DNA, 366 bp, Zea mays
  unsure at all n locations
  Clone ID: LIB3069-041-Q1-K1-F8.R3
ctactagccgntctaacacttaatcaaacgaattcacacagcggatcagctgccatccacagcttatctggagctagacagagaggccaagagcggctcggtgcgttcgtcggagttagaagtgcgttggaaaggtttcagagctgggtcacagtaagctgttacaagattactgaagaactccgccatatctggtttgctctgttcttctctatctttctttagcaaagactcggtagagtatgcttcaaagataggcagaaatctgttccggcagaattcgttgaacagaagggtcagcggtggtagggggaagtagcaaactggacgcaggggaagcttctttacccaaatactcccatagca

SEQ ID NO: 56840 - DNA, 542 bp, Zea mays
  Clone ID: LIB3069-031-G7-F4A
ggctatgcgctacccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaag

SEQ ID NO: 56841 - DNA, 604 bp, Zea mays
  Clone ID: LIB3069-031-G7-R3B
gcgcgcatgacgccgtcgacgagctgcggcatgcagaggtcggccccgccggcggcgccgcacccggcgcgcacgcccacgctcgccatgtaccgctgcacctccgtgcggatcagctcctgcatcgcctccatgaacacggggctgaacgggtacgccgaggtcggacccgccggcggcggaggcggggagggcgagggcggcgacgccgggagctcctggaactggctgtgggcgcggtcgtggtggaaccgctggtccgtgccgggaagcgagaggctgagggaggtgagcgggtcctccttttcctcctcctcttcctccagcggacggctcatcgcgcagtccgccggctcgaacccaccggaccgcgccacggggcggtaaacctggccggcgccgtggctcaggtcgctacggtcggacccggacccggacccggaccctgaccccgaccccgacgggctgtcgggcgagaggctgacgcgcttggtcgggcgcgcgtcgacgtcggaggaacccgccggggcggacgcggcggcgagcttgcgcttgagggagcagttccagtggttcttgacggcgttgtcggtgcgggccggga

SEQ ID NO: 56842 - DNA, 439 bp, Zea mays
  Clone ID: LIB3069-045-Q1-K1-C4
catcccgtcgcatcccatcccactaccacctatcttttcgtccgccgattcgatccggttgttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatacgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgagtcgtgatggccaatgattgcattggtgaagaagttgagaagttggctgccgctttgccagaaggtggagttctgctcctagagaat

SEQ ID NO: 56843 - DNA, 426 bp, Zea mays
  Clone ID: LIB3069-042-Q1-K1-E10
cggacgcgtgggcggacgcgtgggcacatatgaaacggtggagcgtgctatcgaacacagggtggaggccaaagccaagatcttcgggcaagaggtgaacattggtgctaaggacaacggcagcccaccggtctacaaaatcaggccgagcttggtcgccgagctgtacagctacagaatcatgccgctaaccaaggaggttgaggtcgcgtacttgcttaagaggctggattgagtgtgtttacgtagctgtaaaactgccagatccgaactcctggtattaaaccataacatcggtaagtacccatttctgtgaagaggatgatccgaactcctgtcattaaaccagaacatcagtaagtacccagttttggggaaaggatggaaaatataccatgtgtggcaagcaacatgcataatatcatc

SEQ ID NO: 56844 - DNA, 436 bp, Zea mays
  unsure at all n locations
  Clone ID: LIB3069-045-Q1-K1-D11
cccacgcgtccgggagtgtttgttttcgttaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatggacttttggggataggcttgccaccgtgttttgctagatgagtcgtggaataagcttttacttnctcgctgctgtgggtgaag

SEQ ID NO: 56845 - DNA, 369 bp, Zea mays
  unsure at all n locations
  Clone ID: LIB3069-027-Q1-K1-E11
cacatgttgtgggttggtgagcgcactcgttaactcgatggagcgcatgttgaattccttggtggtgtggccaatcctcttggcataaaggtgagcgacaaaatgaaccccagtgacttggtgaagctgattgagattctgaacccttcaaacaaacctggaaggatcaccataattacaaggatgggggcagagaacatgagagtgaagttgcctcatcttatccgtgctgttcgcaatgctggattaattgtcacatggattactgatcctatgcatggaaacaccatcaaggccccttgtggccctgagactcgtncatttgactcaattctggctgaagtgcgcgcattcttcgatgtgcatgat

SEQ ID NO: 56846 - DNA, 405 bp, Zea mays
  Clone ID: LIB3069-001-Q1-K1-E2
cccacgcgttcgcccacgcgtccgcccacgcgtccgcccacgcgtccggcaaggtgataggtaccgtgaattggcccatagggtggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgagcgcactcgacaactcgatggagctcatgttgaattcctccgtggtgttgccaaccctctgggcataaaggtgagcgacaaaatgaaccccagtgagttggtgaagctgattgatattctgaacccttcaaacaaacc

SEQ ID NO: 56847 - DNA, 258 bp, Zea mays
  Clone ID: LIB3069-002-Q1-K1-D6
tcgcccacgcgtacgcccacgcgtacgcccacgcgtccgtccacgcgtccggcaaggtgataagtaccgggaattggcccatacggtggatgatgctcttgggttcatgactgcatcggggcttacaggcgaacaaccggttatgaccactactgacttctggaccttggaccaatggcttttcttaccctacgagcaggctcttacccgtgaggattccaccagtggccttttctatgaatggtcgggccacaatgt

SEQ ID NO: 56848 - DNA, 441 bp, Zea mays
  unsure at all n locations
  Clone ID: LIB3069-045-Q1-K1-A5
cgcctgcttcggcgcggccttcattatgcttcacccgaccaagtacgccgccatgctcgccgagaagatgcagaagtacggcgccacagggtggctcgtcaacaccggctggtctggcggcaggtacggtgtgggcaagaggatccggcttccctacaccaggaagatcatcgacgccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggngacgacagcaacctgaccgacgagatcctcgccgcaggccccaacttctgaactaa

SEQ ID NO: 56849 - DNA, 333 bp, Zea mays
  Clone ID: LIB3069-036-Q1-K1-C10
cccacgcgtccgcccacgcgtccgtttgtttccttcatgtcagagagggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagctgcccaagcagtcggcactgcgccagatgcatactacgcaaaacgcctactggaagccactggaatcgtcgtcgtccccggttctgggtttggacaggtccctggaacgtggcacttcaggtgcacgatactgccgcaggag

SEQ ID NO: 56850 - DNA, 399 bp, Zea mays
  Clone ID: LIB3069-056-Q1-K1-C9
cggacgcgtgggagaagttgtgaactttgcatcagcatgaggtctggagtctagacacagcgtggcaaactgaggtttaatcatcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatttgtacagtggatccaagtattctataaagcatgcatcctccaatttcccacaagcgagaatggcatgatatgatggatgaaatggctgttgcggtcaattgtctttcaaggatcaattgtctttcaagaaccacactttgtattggtttgtgtgcagttcaagctctac

SEQ ID NO: 56851 - DNA, 379 bp, Zea mays
  Clone ID: LIB3069-044-Q1-K1-F2
ggatgccggtcgtttctctgctgcttggcttctttacaaggctcaagaggagctcattaatgtcgctaagctgtatggggttaagctaaccatgttccacggacgaggcggaactgtgggaagaggtgggggccctacccatcttgctatactgtcacagcctccagaaaccatccatggatcacttagggtaaccgttcaaggcgaagtgattgagcaatctttcggagaggagcatttgtgctttaggacactgcagcgtttcacggctgcgacccttgaacatggtatgcacccttcaatttcgccgaaaccagaatggcgtgctttgatggatgagatggctatcgtcgccacaaaggaataccggtcaatcgta

SEQ ID NO: 56852 - DNA, 346 bp, Zea mays
  unsure at all n locations
  Clone ID: LIB3069-036-Q1-K1-G3
cccacgcgtccgatttgtatcgcatgaattaactcagagcatctcaatgttaaaactgtaaaggggcagacctggtgccagaggctcccacatgagtgggttctagggaagggataatccgaagcaagccttccccctgcaaatgcagagatgcggctttgaacccgtgacctggtgactaagtgagacacctctcaccactgcaacaggcctgtccttcctcatcgntaaaactgagcatattaattcttcttcttaagcaatatgggagctaattgctgcattgctgcaaaggagaggacacagncgtgcattactcctatagaagtatcggcatacaggaatg

SEQ ID NO: 56853 - DNA, 441 bp, Zea mays
  Clone ID: LIB3069-044-Q1-K1-D6
attcagcggaatgtttacccttgctgtttttatgggtttgcagtttcctgttggacaaactaatattgatgggatacttcaccttcgggagaacgaattgaaacgacatgctggggagaaatctacggcaatagaagcatattgtgcctatgttgctgaagggttcgaaaacctgctggactggaatgatgttatgaagttccaagcgaagaatggatccttgtttaactctccttctgcaactgctgccgctttggtcgccaactatgacgacaaagcgctacagtatctaaatttgcttgtcacacaatttggcagtgcagtaccaacagtgttcccacaaaatattcactatcagctttcaatggtggacacgctcgaaagtgttggaatatcacggcatttttctgtggagaaaaaggctgtcctggacatgatata

SEQ ID NO: 56854 - DNA, 351 bp, Zea mays
  Clone ID: LIB3069-043-Q1-K1-A1
gtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactga

SEQ ID NO: 56855 - DNA, 292 bp, Zea mays
  Clone ID: LIB3069-025-Q1-K1-F9
ataggtttgacttgtttgggatttaaactctccctatcccactcaatccacatggattgagagctgaccgaacaagcccacacatgtctagttggttcaactgtaccattactagcaggtgatggaccattgggtttatgacaaatggtgacaaatatcatatacacgctctcgcgctcgaaggtcagatcatttttgttgatcttatctagcgaagtgatggcttatatgttcaggatcatgagctcgttgagatgtattgagaggtctctgaatgcttaagttcagacaa

SEQ ID NO: 56856 - DNA, 458 bp, Zea mays
  Clone ID: LIB3069-026-Q1-K1-D10
gctgcagcgcctccgtcgccgctgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctgg

SEQ ID NO: 56857 - DNA, 435 bp, Zea mays
  Clone ID: LIB3069-008-Q1-K1-F4
cagactcctgctgcagcgcctccgccgcttttgtttcatctaacgcagttccctccgcgggagggtgaggcaagatggttctccagaacgacattgatctgctcaacccgccggcagaactcgagaagctcaagcacaagaaaaagagactcgttcagtcgcccaactccttcttcatggatgttaagtgccaggggtgcttcagcataaccactgttttcagccactcgcagactgttgttgtgtgccctggctgccaaactgtcctctgccaacccacacgaggaaaggcaaggctcactgatggctgttctttccgcaggaaaggagactagagcggatgtggtcttcaagttttgctctatgccagatactaagcgtatgaactgcctttagctaaaattttccataagttggtcttgaacagctatgtgt

SEQ ID NO: 56858 - DNA, 417 bp, Zea mays
  Clone ID: LIB3069-052-Q1-K1-F8
cccacgcgtccgcggacgcgtgggttttgttttgccgaggccattggtgccatgcggccagcccttttcttctccatggttcccatcgatgtgtttttgttcggttctctcgtcagatctgtataaataggcgcctaccttctccgccattcctcggtcctgtgaagcgtttcagttcatcgattgagttcttggatgcctctagttgtattgtgtgtttcttctttctggtctatgtactaggactatagtaccaggatctgagtcgtttttttttgggtcttgctcctgtctgccgtttctttccccccttccagagttaggttctgttggtttcttgcctgcaatatagtttcgtggcgcaccgtcaagggtgtgtctagactttaaagactggttgttggcagttgggtttat

SEQ ID NO: 56859 - DNA, 413 bp, Zea mays
  Clone ID: LIB3069-041-Q1-K1-G12
ggcaacccttccaaggacaaggaggagcatgccgagttcaagaagatgtttgacctcatggagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccatggcgggctccagcgtatcgagga

SEQ ID NO: 56860 - DNA, 251 bp, Zea mays
  Clone ID: LIB3069-029-Q1-K1-B2
acttcccgtacaccgagtcgcacaagaggttgacctcccttcactcggagattgaggagcgtcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaaccc

SEQ ID NO: 56861 - DNA, 394 bp, Zea mays
  Clone ID: LIB3069-008-Q1-K1-C1
actgcgacctctactggaagaagtttgagttatcacttccacttctcgtgccagttcaccggtgacggtgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctactttccgtacaccgagtcgcacaagaggctgaccttccttcacccggagattgaagagcttctgtacagccaaaccgagaacacggagcacaagttccgttctgaacgacaggaacaagccaatcattttttc

SEQ ID NO: 56862 - DNA, 443 bp, Zea mays
  Clone ID: LIB3069-041-Q1-K1-E7
caaacaacagtatgaggaggtttccattccaccacatttgatggtcgggacttccatgggactatttgatttcattgctgctgcattggctaaatttgtcggtactgaaggtgaagatttccaactcccagagggtagacagagagaacttggtttcactttttccttcccggtgaaccaaacatcaatatcatcaggaacactcatcaagtggacaaagggcttttccatcaatggcacggttggtgaagatgttgattctgagttgagcagggccatggagaggcaggggctagatatgaaagttacggcattagtcaatgatacagtcggcacattggctggtgggagatatatggataccgatgtagttgcagctgtaatattgggcactggtacaaatgcagcatatgtggagcatgcatatgcaattcctaaatggg

SEQ ID NO: 56863 - DNA, 451 bp, Zea mays
  unsure at all n locations
  Clone ID: LIB3069-045-Q1-K1-F6
cgacgagttcgggcacatgttggtgaacatcctgaagcagaacattgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccaaggtgttccactacggctccatctcgctcatctccgagccgtgccgctcggcgcacatggccgccatgcgcgcagccaaggccgcgggcgtgctctgctcctacgaccccaacgtgcgccttccgctctggccgtcgcccgacgccgcacgcgagggcatcctcagcatctggaaggaggccgacttcatcaaggtcagcgacgacgaggtggccttcctcacgcgcggngacgccaacgac

SEQ ID NO: 56864 - DNA, 403 bp, Zea mays
  Clone ID: LIB3069-045-Q1-K1-F2
tcgaccccttttgctgaacatgcttaagcctatcaataagtactcggaggggtgcctgtacgacaggcgcgctttgacggcgctgggggtcctgactctcaagcacgacggggagcgcgagttcatgttctacaggaacccgagcgcggacatgctgctgacggaggcggagctggacctgggcctggtgcggcgcgccaaggtgttccactacggctccatctcgctcatctccgagccgtgccgctcggcgcacatggccgccatgcgcgcagccaaagccgtgggcgtgctctgcttctacgaccccaacgtgcgccttccgctctggccgtcgaccgacgccgcacgcgagggcatactcagcatctggaaagaggccgacttcatcaaggtcagcgac

SEQ ID NO: 56865 - DNA, 359 bp, Zea mays
  Clone ID: LIB3069-012-Q1-K1-F2
ggcctgaagggagttgccaggagcatgccttcatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctttcaagaataaggacaaccttggaggagataagcttgtcacttgtgaagatattgtccgtcagcactgggccacatatggtcgccattactacacacgctatgactattaaaatgttgatgcacgggc

SEQ ID NO: 56866 - DNA, 447 bp, Zea mays
  unsure at all n locations
  Clone ID: LIB3069-020-Q1-K1-E12
cacagttcccatataggcagccatcggctacacagcctcgcctccgtaagcagagtgtgtcgttgcggaggcaggaagagagacgacggcggccatggcgacctccttccaggggacgaccaccaagtgcaccgtctgcgacaagacggtgtaccttgtggacaagctcaccgncgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctttgctggcaccagagagaaatgtgttggatgcagcangacagtcta

SEQ ID NO: 56867 - DNA, 136 bp, Zea mays
  Clone ID: LIB3069-025-Q1-K1-B6
gatccggtctgatgtttctgaagtagttgttgctgacgagtttgagtacaaggatgctgtggatggctctgtgtccaagcaccagggcatccgatacctctttggagatggttcacgactggtgttccgcctctct

SEQ ID NO: 56868 - DNA, 396 bp, Zea mays
  unsure at all n locations
  Clone ID: LIB3069-043-Q1-K1-D5
cccacgcgtccgcccacgcgtccgggaaatcactccagaattttgaaaaggtgacggaaatagtgaggagcggagaacaccggaatgatccatcctctcgtgctatccctgccctcccccgctataatatcgcgccctcgtcgccatcgtcaccacaccaccactccctcactgccctctcactcccgatccctgcaccactaccgcctcctccgcgtcacccctctcgtcgcctcttgcggcgaccggcggcggatcgtccgctgcgcaagcgcaaccatggggctcttcaccgtgacgaagaaggccatcacccccttcgaaagccagaagcccggtacctnctgcctncgcaagaaggttactgtattccagcagcctcattatctgcagaac

SEQ ID NO: 56869 - DNA, 477 bp, Zea mays
  unsure at all n locations
  Clone ID: LIB3069-025-Q1-K1-E9
attcggttcttcgacaaagcgattggaattaatgttccccgctcaaggtttctcccagtggaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactnctactgagctctatattttg

SEQ ID NO: 56870 - DNA, 450 bp, Zea mays
  Clone ID: LIB3069-026-Q1-K1-E11
ggaaattattccaaaccccaaggaagttgttggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagcttgatttgaaaacaaggatgtcaatgg

SEQ ID NO: 56871 - DNA, 394 bp, Zea mays
  Clone ID: LIB3069-023-Q1-K1-H5
cggcggaggaagtgtggaaggagatcactggcggaggtggcagtggggaagccgtggctcccgtggcggctcaagttgtcgctcccgatggtggcgccggcacaagcggcccggaggtgacgctggaggacttcctggccagggagagcgcggtgaaggaggatgaggttaagatttctgtcccccccgcgccggtcatggggttaccgggcggagcggagggcgtgagtgtgcctggcggcggaggcgggagggaacggaagcggcagcttgtgagtacagaggatcgcgctcgctctgctatccagcgagagaaacgaatgataaaaaaccgcgagtctgctgccaggtcacgggagaggaagcaagcctatatcgccgagctagaatacat

SEQ ID NO: 56872 - DNA, 338 bp, Zea mays
  Clone ID: LIB3069-035-Q1-K1-E11
catggtaccaccttatgggactccaccattaccttatgtgatgtatccacctggagcagtatatgcccatccctctacacctcctactatgcatccgtttagtcattaccctatgccaacaaatggacatgctgaaactcctggaaccgcgccaagtgctccagaaatgaatgggaaaagtgagcctggcagaacatctgctccatctgccaatgggattacctcgcacagtgagagtggaagtgagagtgagagtgaaggaagtgatgccaattatgaaaatgattcacattcaaaggacaatgatggaaaggaagatggcaattctcagaatagca

SEQ ID NO: 56873 - DNA, 443 bp, Zea mays
  Clone ID: LIB3069-017-Q1-K1-C7
tcgcccacgcgtccgctgcagatgtaaatgacatgatttctgaaaagttgatggtccaaataagggttaacgaaggcattgaagaagatatcccaccgagccaatatgccaggtgtgaagagaaaataactatgactccagctgccatctcaagggaagctggtcttccaggatatggtcctggtcctggagaaaactttcttcaggtcagttcaaggaatactagctgtgagcagagtgtgatactggctcctaccgctatcgcaagagaagttggtccaccaggatatgcgactggagaaaaccagcgcaatggggctccatggaatacaagttatgagcgaagactatttatgaatcctgtgaccagctcaagagcagtcagtcctccaggatatgggcctgaagaaagccgaggcagtggcatttcctggaatacaagc

SEQ ID NO: 56874 - DNA, 417 bp, Zea mays
  Clone ID: LIB3069-022-Q1-K1-B3
cggacgcgtgggatgatgctcattcaggatgggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattaaaactagacgacgcatcttccagatacacacatcgaaaatgacattagctgatgatgtgaacttggaagagtttgttatgaccaaagacgagttttcgggtgctgatattaaggcaatctgcacagaggctggattgcttgccttaagagaacgcagaatgaaggtgacccatgcagatttcaagaaagcaaaagagaaggtgatgtacaaga

SEQ ID NO: 56875 - DNA, 363 bp, Zea mays
  Clone ID: LIB3069-031-Q1-K1-G7
cttacggtcttctcttctccactaccacccgcccgcccgccttctcctccaccactgcgccgtcgtggaataggggcaagttcaggcatctcgcttctgtcctggtcgaggggatcggagaagaatgggctcggaagcggactgcgacaggatcaggggcccgtggagccccgaggaggacgacgcgctgcggcggctcgtggagcggcacggcgcgcgcaactggacggcgatcgggcgcgagatcccggagcggtcgggcaagtcgtgccgcctgcggtggtgcaaccagctgtcgccgcaagtggagcgccggcccttcacggcggaagaggacgcggccatcgtccgcgcccacgcgcg

SEQ ID NO: 56876 - DNA, 453 bp, Zea mays
  Clone ID: LIB3069-033-Q1-K1-G4
cccacgcgtccgcccacgcgtccgcccacgcgtccgcacttagcatgaaggagctcgagcagctggaggaccaaatagagatatctctgaagcatatcagctcaagaaagaatcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcaggtcgggtaccatcatcaagcctacatggatcagctgaacaacgaggacctggtggacccgaatgagcatggtcgatctggatggatatgaaatgctctgatgacccaaaataaagttgatgcacagc

SEQ ID NO: 56877 - DNA, 442 bp, Zea mays
  Clone ID: LIB3069-006-Q1-K1-F8
cgcacgcgtccgaggtcattgagcttttaatcaaacatccggaactgtgggagagcgttggaattgcacaaccaaagggtgtccttctttatggacctccgggcacaggaaagacattgttggcacgtgcggttgctcatcacactgactgcaccttcatcagggtgtctggttctgagttggttcagaagtatattggtgagggctcccagatggttagggaactctttgttatggccagggaacatgcaccatccattatatttatggatgaaattgactctatcggatctgctagaatggagtctggaactggcaacggtgacagtgaagttcagcgtactatgcttgaactttctaaccagcttgatggttttgaaacatcaaacaaaattaaggttttgatggcaacgaacagaatagacattttggatcaagccct

SEQ ID NO: 56878 - DNA, 429 bp, Zea mays
  unsure at all n locations
  Clone ID: LIB3069-051-Q1-K1-B3
agaacatacacaaaggattatgtcagcaacttgacagtgcagcaggatattgagcgagtggaagctgatgcggatggcctgtcaaagagactcgaagcacttgaagcttacaaaaggaaacttttgggtgagaggttggaagactgctccattgaagagctgcatagtttggaagtcaagcttgagaagagcctgcattgcatcaggggaagaaagactcagctgctggaggagcaagtccgtaagctgaagcagaaggagatgagtctgcgcaagagcaacgaagatttgcgtgaaaagtgcaagaagcagccgcctatgacgatggctccgccgncgactcgtgcgccggcagtcgacaccgtggaggacgatcaccgggagccgaaagacgacggaatggacgtggagacggagctgtacatagga

SEQ ID NO: 56879 - DNA, 382 bp, Zea mays
  Clone ID: LIB3069-029-Q1-K1-H10
agcagcagctggagagttcactgaaacattttacaacaaggaagagccagcttatgggcgaggcaatttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaagcgggacggtggtggaaggggcagcagcgcatccgcaggctcgcgttggactgccaccatggatgcgtagccatctgagctgctgaagcttgccctcaccgtcgcgatgtgatag

SEQ ID NO: 56880 - DNA, 450 bp, Zea mays
  Clone ID: LIB3069-033-Q1-K1-F11
aaggaatctttcagctcacacctccctatccctccttcccttctcctcctactgctactgctcgccaggtcccctcgctcgctcgctcgtcgtcttcaacctcacacaattatttgtgctcccgctccttccgtccgtccttcctccccccttcccctctccctcttccaaccgccgctcctgctgccttgcctctcagcccagggacgccaaggtctctgccaggatggtgtaggccgtgcctctcgcgcattatgaggtgtggtggtgagggatgggcgatggcctttgcagatgaaggagcgacagcgctggcggcctgaggaagacgccgtcctgcgcgcctacgtccggcagtacggcccccgcgagtggcacctggtgtcgcagcgcatgaacgtggccctcgaccgcgacgccaagtcgtgcctggagcgcttgaagaactac

SEQ ID NO: 56881 - DNA, 457 bp, Zea mays
  Clone ID: LIB3069-050-Q1-K1-G8
ctcaaggtgggttcggttctttttggctgtttcttcctgtatgatatcttctgggtgtttagctccaagagatggtttcatgagagcgtgatgattgtggttgcgcgtggcgacaagaccgacgaggatggtgtgcccatgctgctaaaaatcccgcgcatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctctggacttctaatcacatatgttgcgctgaacctgatggatgggcatggacaacctgcccttttgtacatcgtgcccttcactcttggcaccttgatcgcgcttggatggaagagaggggagctgcagaacctgtgggcgaggggag

SEQ ID NO: 56882 - DNA, 325 bp, Zea mays
  unsure at all n locations
  Clone ID: LIB3069-020-Q1-K1-H6
cccacgcgtccgcccacgcgtccgtttgaatgcagcagaatcgctgagggatcgtcgatccggagaggcaaacaagtcgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgnctctaccaggtctcatcctcctacaatctgcttaagactctaaagcggtaccagaggtacatctatgc

SEQ ID NO: 56883 - DNA, 297 bp, Zea mays
  unsure at all n locations
  Clone ID: LIB3069-031-Q1-K1-H4
aaaaactccactggacactgaaattaaataccaggattatctcaagttgaggacaaggggtgaattccttcaaactacacaaagaaatattcttggggaggatctgggtccacttagcatgaaggagctcgagcagctggaggaccaaatagagatatctctgaagcatatcagctcaagaaagaatcaaatgctacttgatcagctctntgacctcaaaagcaaggaacaagaattgctggatctcaataaagacctaaggaagcaactgcaagagacaaggccagagaacgcgct

SEQ ID NO: 56884 - DNA, 455 bp, Zea mays
  Clone ID: LIB3069-039-Q1-K1-G10
ggcacatctatgcttcagctgatgctgcagtgccatctagcgatgagatgcagaataactatcaagaatatgtgaagctgaaagcacgagttgaggttttacaacactcgcaaaggaatcttcttggtgaagaactggctccacttagcccaagtgaacttgaccagcttgagagtcaagtagacaagaccttgaagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgacccttcacagccagaacacttcttcgtggctctggagagcaacgcgcctctgcaacctacataccatactatggacatg

SEQ ID NO: 56885 - DNA, 329 bp, Zea mays
  Clone ID: LIB3069-036-Q1-K1-H9
ctcgagaggcacctgatctttccttcccgtgttcctcccacacgtccccatcaccattgctgcgacgagagtgagcgggagagggtaggtggcgaggcggcggacatggggcggctgccggtgcagctgcgccggatcgagaacaagatcaaccggctggtgaccttctccaagcgcctgaacgggctgctgaagaatgcccacgagatcttcgtgctctgcgacgcagatgtcgggctcatcgtcttctgcactaacgtgaagctctacgagtactctaggcattccagcatggatggcattctcgagcgttaccaacgttactcatt

SEQ ID NO: 56886 - DNA, 423 bp, Zea mays
  Clone ID: LIB3069-026-Q1-K1-G11
cccacgcgtccgcccacgcgtccgcggactcgtgggcttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgat

SEQ ID NO: 56887 - DNA, 375 bp, Zea mays
  Clone ID: LIB3069-042-Q1-K1-D6
cagagtcacttcgccacgaacaaatgcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagacc

SEQ ID NO: 56888 - DNA, 352 bp, Zea mays
  Clone ID: LIB3069-036-Q1-K1-A5
cggacgcgtgggctgtcggtgagatcgcttgtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaaggcggccaaggcggccaagggcgccggcatggcggacggcagctacaccatcatgcacctggacctggccttcctcgacagcgtgcggcagttcgtggacagcttccggcgcgccggcatgccgctcgactcgctcg

SEQ ID NO: 56889 - DNA, 373 bp, Zea mays
  Clone ID: LIB3069-025-Q1-K1-F6
actgtttacacactcaatcaatctgggatttgagcggatcaggacacccgtgaaaattagctctccaggttggaagtattctcactgggaaatgaaaggtgttccattgagaattgagattggtccaaaagatctggcaaacaaacaggtacgcattgtccgccgggacaacggtgcaaaggttgacattccggtgaccaatttggttgaagatgttaaagtgttattggatgagattcaaaaaaatctgttcaaaacagctcaagaaaggagagatgcatgtgttcaggtcgtcaactcttgggatgaattcacaactgctctgaataacaaaaggttgatcttggctccttggtgcgatgaggaggaagtt

SEQ ID NO: 56890 - DNA, 436 bp, Zea mays
  Clone ID: LIB3069-040-Q1-K1-F9
ggttctcccagcagaattgttaacgttaattcaatcatgcacagtgtaggttttgttgatgctgaagatttgaacttgagaaaacataaatatagaagttggttggcgtattcaaatagcaagttggcacaggtaaaatttagtagcatgcttcataagagaattcctgcagaagctggcatcagcataatttgtgcttctcctggaattgtcgacacgaatgttacaagagaccttcctaagattgttgtagctgcataccattttcttccctacttcatattcgatggtcaagaaggttctaggagtgcactgtttgcagcatgtgacccccaagttccagagtactgtgagatgctcaagtcggaagactggccagtctgtgcttgcattaactacgactgtaatccgatgaacgcgtctgaagaagcgcaca

SEQ ID NO: 56891 - DNA, 407 bp, Zea mays
  Clone ID: LIB3069-027-Q1-K1-G9
agccaagtcgtcgcctccccgacccaacgttttgacccccttgcccgtccgcgagcgctgcagcacctgggatcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggaggaggcctcgcccgggacggcggaagagccgctgctggtgagcgcaatcagagggaggaaggtcgagaggccacccgtctggctcatgaggcaagccgggaggtacatgaagagctaccaattgctctgcgagcggtatccttcgttccgtgaaagatcagaaaatgtcgacctagttgttgagatctctttgc

SEQ ID NO: 56892 - DNA, 380 bp, Zea mays
  Clone ID: LIB3069-031-Q1-K1-E6
cggacgcgtgggctgctgaattggaagattggcttggcgatcttaacccacactcgaaagaggtgataaaggatgcttatgctgtaccatcacttgccactgcggttctgggtgacaagttccagtttgagcggcttggttacttcgccgtggatactgactccacacctgagaaactcgtgttcaacagaactgttaccctccgtgattcgttcgggaaagctggacccaagtgactgttcagtgtaatttagggagggcgctggttttgatcggttgcagaagcgcacctgaactatacaagttgtgaagaaaatggtcgtctaatacagaacagtttaaagggccttactctttataaaatttagggttttttaaaa

SEQ ID NO: 56893 - DNA, 435 bp, Zea mays
  Clone ID: LIB3069-047-Q1-K1-C4
ggtttgcaggcgttgtcttccggattttggtccactacactggtcagcctcttcttggagctaaagttgtagcctccatgctgatgtttgcgacggtcgctgggattctcatggcactcttcttgaacactgctggcggcgcctgggataatgcacagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccaaccactcatcaagcttgctattaaccctgcggagatgtacctatgcgaccaggtagatgaggtgtgtgtgtgtgtgtgttacctgcatgtgatgatgta

SEQ ID NO: 56894 - DNA, 322 bp, Zea mays
  Clone ID: LIB3069-006-Q1-K1-F4
cggacgcgtgcgctcacgtggttgagtctcctatttgcagcaaggttaagtacgacggcgacagggcatctggtctgatcaaggtggaccgtgttctttattcctctgttgtttacccacataactatggcttcattccactgcacactctgtgaggataacgaccccctggatgtcctcatactgatgcaggaacaagttgtccctgtgtgattcctgcgagctcgtgctattgggctcatgcctatgatcgatcaggtctagtgtcttcgtcacctgatcgcatagtgcttgctatgtttaccttaggccatatattttt

SEQ ID NO: 56895 - DNA, 450 bp, Zea mays
  Clone ID: LIB3069-016-Q1-K1-D9
atttagaagcgcccctcctcctctcccccttccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgcttagaactgctgggtgaataagggaggtgcattcactggtgaaattagtgctgaaatgctcgtcaaccttggcgttccctgggtcattcttggacactctgaaaggagagctctgctgggagaatcaaatgagtttgttggagacaaggttggctttgctctgtctaagggactaaaggtcattgcatgtgttggtg

SEQ ID NO: 56896 - DNA, 267 bp, Zea mays
  Clone ID: LIB3069-046-Q1-K1-C4
tcggccacgccgttcgccacgcgttcgcttggacactcttaaaggagagctcttcttggagaatcaaatgaatttgttggagacaaagttgcgtatgccctgtctcagggactaaaggtcattgcatgtgttggtgagacacttgagcagaaggaggctgggtctaccatggaggttggtgctgcacaaacaaaagcaattgctgagaagatcaaggactggagcaacgtagttgttgcctatgaaccagtttgggctattggaact

SEQ ID NO: 56897 - DNA, 434 bp, Zea mays
  unsure at all n locations
  Clone ID: LIB3069-057-Q1-K1-H6
cggactctttcgcccacgcgttcgcccactcgtncgcacggaccgcgcccggatcaacgtcatcaatgacgagctgttccggcttcttcaacacgcggacctggatggcgcggtggtcctggtgttcgcgaataagcatgacctgaaggacgccatggcacccgcggagatcaccgatgccctctcgctccacagcataaaggaccacgactggcacatccaggcctcgtgtgccatcaccggcgatggcctctacgacggcctgggctggatcgcgcagaaagtcgccggcaaggcgaccgcgagctgacgtgcangagagcagtggttgtgtgttcatgaacggattggatttgttgaaaggtatgggtggtggcagggcgggtttgtttcttcctcggcgtcacgcccaatgcttatttatggttttttaa

SEQ ID NO: 56898 - DNA, 186 bp, Zea mays
  Clone ID: LIB3069-057-Q1-K1-H7
accaaatctttaaaggtaaaccgataattctttctttgaagaagaagggggggacaacaagaagaaggtagaggtaactcaataaatctactgctgtccggggaattaattcaaagcttatttgctgcaccttggctttctttaaaaatagcttcatcttgtgtatccccatctgggtacaaaaac

SEQ ID NO: 56899 - DNA, 333 bp, Zea mays
  unsure at all n locations
  Clone ID: LIB3069-057-Q1-K1-H9
ttccaaatcaccgccggctcggctcttcatcttcgcgccaacaccgggtcttcgaggcccgcacgaagcaaacggctcncaaatcgactggcggcaaggcgccccgcaagcagctggccaccaatgcggcgcgcaagtcggcgccggcaaccggtggcgtgaagaagcctcaccgctttcgccccggcaccgtcgcgctccgggagattcgcaagtaccagaagagcacggagctgctcatccgcaagctgcccttccagcgcctcgtccgtgagatcgcgcaagatttcaagaccgacctccgctttcagtcctccgctgtcgccgcgcttc

SEQ ID NO: 56900 - DNA, 377 bp, Zea mays
  unsure at all n locations
  Clone ID: LIB3069-057-Q1-K1-H5
cagattcnttccgtccaggcaaggaagaaatcgagcagccaaggaaaggagaagatgggtcgtacgaagcagaccgcccgcaattccaccggatgcaatgccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacac

SEQ ID NO: 56901 - DNA, 439 bp, Zea mays
  Clone ID: LIB3069-012-Q1-K1-A5
acagaggaaagcctttctgcagtatgtgaaagagtgcttgatagatgcctggctccatcgaccatgggtggcgagggatgcgataacatgacgatgatcttggtgcagttcaagaagccatttgctcaggtaaaggatgccagtgatgcggaacaactaactggagatgcgggatgctctgagacccatggggccgaggagaatggctctgacaagcagatatagcgaagacatggactcttttggagtcttggtacatggcctgacgctgaacctgggtaaaacaggagtacgatgttgcaatgtacataccaaccatgcgctgagttggcgtgaaagatatattcattgttccactgttgtctttaaccaaacgtgcttgtttcttccggttgtgatttttggtgatctgacaatatctaattatacatttgggtgg

SEQ ID NO: 56902 - DNA, 324 bp, Zea mays
  Clone ID: LIB3069-012-Q1-K1-A6
acccacgcgtacgtcctattattcccccactcccccgggttataatcgccaccaccagaccacaccacagcagccgtttattacactggagccgcgcccacaacaaccgccaaaaccgctagtatcatgccgcccacaaccaaaagccataccagctacagaagacaccgccctcgacgccaccgtatgcctcaatagcaatcaagacgaagagaaacccaccgaacccgccctgctccagaaacccaaacttcctaagctcaagtcgtaatagcatcagctacacaactcctagcaacacacaagcccactgtacacctacgt

SEQ ID NO: 56903 - DNA, 75 bp, Zea mays
  Clone ID: LIB3069-012-Q1-K1-A7
ggcccggacgaaccgccccgacccacccacgcgttcgtccactcatacaaaaaaaaaaacaatttaatattcaac

SEQ ID NO: 56904 - DNA, 70 bp, Zea mays
  Clone ID: LIB3069-012-Q1-K1-A8
ccgggaaggaatggccggacccacgcgtccgcggacgcgtgggcggacgcgtgggctagttctatatcgc

SEQ ID NO: 56905 - DNA, 297 bp, Zea mays
  Clone ID: LIB3069-012-Q1-K1-A9
gcgagtggagcttcatcctctcggcgccggtcatgggctcgtacgtggcggtcggcttctcgggcaagggcgccatggtggggagcagcgccgtcgtcgggtgggtggccaacggcaggggcaccgtcaagcagtactacctcggcgggaagagccccgaggagtgcgcccccaacaggggcctcctcaagctcgtcaggaacaggaccgccgtcgcctcgcgctccggccgcctctacctcgccttccagctcagcaccgactacccgcagccgtacctgatctacgccgtcgggc

SEQ ID NO: 56906 - DNA, 284 bp, Zea mays
  unsure at all n locations
  Clone ID: LIB3069-012-Q1-K1-B1
cccacgcgtccgaagtaaccacagaaaatggcgtcacttctccgccctctcgtcctcgtgctcctgatcgcctcctgcgcagcgcagcagtcaccgccggcgcagcccccgccaacgccgaacgcgccaccggccaactctgccgcccaggcgcctncagccggaaacccggcgccggcgccccaggcgccgtcgggaggcaagaccgcacctgcgcccaccggcacttcaccttcgggcccgaccacttcggcccccgccccgaccacaacctccccgggttc

SEQ ID NO: 56907 - DNA, 446 bp, Zea mays
  Clone ID: LIB3069-012-Q1-K1-B10
cccacgcgtccgcccacgcgtccgcccacgtgttcgcccacgcgtccgggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcaaactgaagcatgatatagctctttatatgattggggtttcctgtagttgctcttgtcaggcatgttgtgggggccttatctagtggaaatgtggaatcactgtactggcttgttttgacgagacaatgctccttatatttggtttatgctct

SEQ ID NO: 56908 - DNA, 437 bp, Zea mays
  Clone ID: LIB3069-012-Q1-K1-B11
gccagtggtcgtaccacaggtatcgtgctcgactcgggaagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggata

SEQ ID NO: 56909 - DNA, 430 bp, Zea mays
  unsure at all n locations
  Clone ID: LIB3069-012-Q1-K1-B12
attgattcatatagcatcttcacacctacatgccatgcatcttttgcctcctcaaagaacaaagtgatgaaaaggctacattctgctggaaaaatgggagaacagtatgatccatgcactgagaagcattcaactgtatacttcaatctagctgaggttcagaaggcacttcatgttaatacagtcattggaaaatcaaaatgggagacttgcagtgaagctgttaatactcattggggagattgcgaaagatctgtgctgcatatctatcatgaacttatacagtatggcctccgtatatgggtgttcagtggagatacagatgcagtgattccagtgacttcaactagatacagcatcgatgctctcaagcttccaacaataactccatggcatgcttggtacgacgatgacngtgaggtcggtggat

SEQ ID NO: 56910 - DNA, 337 bp, Zea mays
  Clone ID: LIB3069-012-Q1-K1-B2
cggacgcgtgggatctctcaaagctacgtgtgtttcatgctgatgaaactccactggaagtaccgcccaaagaagttgtaaagctaggggctcaggagctggttaattatatgaagaatatggttgctgcaagggaagtgagccagaatcaaacagataagaggagcttctggacctggctccgctcactgtttggttgttacaaaaagaatcaaggattgggaccagttccagcctagctgaaccatatcgtccgcatgtattgtcatgaattattcagttttgctccatctctcaagtcagcgacgaaatgaggcatgactactattattatttc

SEQ ID NO: 56911 - DNA, 244 bp, Zea mays
  Clone ID: LIB3069-012-Q1-K1-B3
cccacgcgtccgcccacgcgtccgcccacgcgtccgcccacgcgtccgtgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagc

SEQ ID NO: 56912 - DNA, 400 bp, Zea mays
  Clone ID: LIB3069-012-Q1-K1-B4
gacgactacaagttcaacggtctgggctggctcttcctgggtgttccaacgagcagctcgttgctctacaaggaggagttcgggaagatgaaggagagagcgccggagaacttccgggtcgactacgccgtcagccgggagcagacgaacgcggcgggggagaggatgtacatccagacccgtatggcggagtacaaagaggagctgggggagctcctgaagaaggacaacacctacgtctacatgtgtgggttgaaaggcatggagaatggtatcgatgacattatggtgtcactggctgaaaaagacggaatcgactggttcgactacaagaagcagctgaagaggggagatcaatggaatgtggaggtctactaaccgctgaattttgcagctgaca

SEQ ID NO: 56913 - DNA, 410 bp, Zea mays
  Clone ID: LIB3069-012-Q1-K1-B5
gatcgggccatcggggaagcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacagggtcacaatcttgactgacaagtttggac

SEQ ID NO: 56914 - DNA, 336 bp, Zea mays
  Clone ID: LIB3069-012-Q1-K1-B6
cggacgcgtgggcggacgcgtgggcggacgcgtggggtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtacc

SEQ ID NO: 56915 - DNA, 176 bp, Zea mays
  Clone ID: LIB3069-012-Q1-K1-B7
gctgggtgtcagcagtcacaccattgtcgaggggtgtgatgttctttttcttgaatggttggtacctggggttacagcagttcacctgtgtttgatacatctgccttgtgacatttttgtgttgagttgtcggaacacatctattatcatctctaccataaaattgttgtggccct

SEQ ID NO: 56916 - DNA, 394 bp, Zea mays
  Clone ID: LIB3069-012-Q1-K1-B8
atacctatttacataacaaatcctatggttggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaagggctgagaaaactcgcaagaaaagttccaaccgatcgtctacttaaattcgaacgggttttcaaagcacaaaaacgcatacatatgtcttgtttcaaagcacaaagagttctagatgagattcgctggcgttacta

SEQ ID NO: 56917 - DNA, 441 bp, Zea mays
  Clone ID: LIB3069-012-Q1-K1-B9
cggacgcgtgggcggacgcgtgggcggactcgtgggccacaagaaggaggatgagcaccagaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgggctattataatcaaaaagaaaaaagaaa

SEQ ID NO: 56918 - DNA, 413 bp, Zea mays
  Clone ID: LIB3069-012-Q1-K1-C1
tctaaatcatgttagaggtgcatactcatttgaggatttaagaacattgggtgacatcacatgctcaactttcagagaagcatgcgaaaaaagaggactcatagaggttgacatgtcacttgatgactgcttgagtgaggctgcaacctttcaaatgccaactgctctgcgaaggttatttgcaacaattcttgtattttgtgaggccactaatgtacgtggactgtgggacaaacacaatgactcaatgtctgaagattataaccgagacaatcctaaatcgacatgcgtacaacaaatggtccttaaagacattcgggagttggttcggtcgatggggaaggatatcaaatcttatgatcttcctgagattaatgatacaggtgaattttgcaatgatataatgagagagc

SEQ ID NO: 56919 - DNA, 413 bp, Zea mays
  Clone ID: LIB3069-012-Q1-K1-C10
attgaccaactagcagagatgttcggtgtatcaacagttgatgtttggacttcatatgttgctggagaaagtgaggaaccaacatatggtaatttggacatgggtgaggaggaggatgaagtagatattaggagtccattgagcagcagtagtaagaagaggactggcagcaatactgatacagccagtagtcctcctaggaagcataaaagtccaatgattgaatgcgaagctttgatagacaccctacaatctttaaactccaaagacttggatgtggccaaacagatacaagaagaccacatagctaaaaataagaagttagaacaggaaaaagagaataaggagatagataaatgtttcgaactggccaaagaatgtggagcaactgaagagacagaggagttctatgt

SEQ ID NO: 56920 - DNA, 389 bp, Zea mays
  unsure at all n locations
  Clone ID: LIB3069-034-Q1-K1-F4
cggacgcgtgggcggacgcgtggggaaaggtttcaggagaaactggcgtgcacagaatcagcagttgctgaagccaaccacgctgtgcaggaggcaaaggccgagaaggagaggcttcaagagaagcttgcacacacggaatcagaggttgctgtggccaacatggctgcacatgaatctaagattgagttcgacaggcttcaagagaaacttacatacacagagttggtggttgctgaagccaacaaggctgtgcaggaggcaaaggctgagagttcgcatctgaaggagcggttacttgacaaagagaatgcattgcagagcataacccangagaatgatgaattcaagatgcgagaagctgacgccatgaagaaaatagacgagct

SEQ ID NO: 56921 - DNA, 422 bp, Zea mays
  unsure at all n locations
  Clone ID: LIB3069-034-Q1-K1-F5
catcacgagcatatcattcaagggaatccatgggcagggtgttcgggtgcctgtccgagctcatggcagcgacgtcatccccatcaaggacatcagcttccaggacatgtcggtaggcatcagctacaagaagaagcacatcttccagtgctcctaccttgaggggcgtgtcgtcaggcccgtgttcccgaaaccatgtgagaacctggacgtctatgatgagcaagggcagcttgtgaagcgggcagtggccctgaacagcacagaacttgactacgatatatgaggtgcacatatcataccacagctttgatagttgtagtggaaattggtgctctctaccctcagaaatcaattntctccgattgtccatggctntttgggtctagaattgtagatagagaagagattctcctcttgat

SEQ ID NO: 56922 - DNA, 335 bp, Zea mays
  Clone ID: LIB3069-034-Q1-K1-F6
tcgcccacgcgtccgcccacgcgtccgcggacgcgtgggcagcagagagattactacgatccaacagttctagagcaagagagaggaagacacactcgagagttagcaggctaataacttgcatgagcagcaggaatggctgcgacgcgttgtctctcttgctttctcctcgccgtgcttctggcaggagtggcctgtgtcaccgactttgacgaagcggctgctgccggcttcgggcttggccacggcgcgcgtttcgcgcgcaagcatggacttgctgccgatgagatgccccagccggagccacaacctataactaaaccggagccccatat

SEQ ID NO: 56923 - DNA, 373 bp, Zea mays
  Clone ID: LIB3069-034-Q1-K1-F7
cggacgcgtgggagcagctgaagtttgtaaacatgctaaagaatcagctggtggaccaaaaccagaagcctgcttaaataaatgccagtaccagagtgggcgattccttaagagaaggatacccattatgatggtatgaatgagttgccgtatgtggcgttatcttgtagtaactagccgtctgtgaacatgtgagaactatgttgttctagcctgttaaacgaaatgatctgtactgtcttctatagggtcttggtacacaagagttgtacaacataagatctgtctgtgcagtccagggagcagcgtgtcgctactgctgtaatcgccggcaaacgatcctgtgatcctgcgccaaagtttgtttcttggt

SEQ ID NO: 56924 - DNA, 202 bp, Zea mays
  Clone ID: LIB3069-034-Q1-K1-F9
cccacgcatacgaaaaaaaaaaaataaattttaaaaaaaaaaaaaaaaaaaaaaagaaagtgtaaattttaataataaataaataaatatattaaaataaaaaattattaattttttaaaatagatataaaataatatatttaaaaaaataaaattatatatataatatattttaaatatatattttaaaattaattttatt

SEQ ID NO: 56925 - DNA, 262 bp, Zea mays
  Clone ID: LIB3069-034-Q1-K1-G1
acgcgagactcgcagctagctgacacggccgagaagcagcttgcattgcaggcgtattacggacccagcagcagctagcactagcagtccatcggagcgacgatggtgagaaggactgtgctggcggcgctgctggtggccgccgaactcgtcggcggcgcgcgggcgcagctcaaggaggggttctacgactacttctggccacatgcggagaagatcgtcaaggactacgtgaaagcgcacatgccccacgcgcccgacg

SEQ ID NO: 56926 - DNA, 321 bp, Zea mays
  Clone ID: LIB3069-034-Q1-K1-G10
ccaacgaaaagtgcacgcacacgcgcatcccggcagtcagtagcgcagctgcctctcctctctttggcccccggagccggagcaagagcgccgccaacagcccgctaccggcgccgtgtcatggcggggccaggagacaaggtggactacgtcttcaaggtggtgctgatcggcgactcggcggttggcaagtcgcagatcctcgcgcgcttcgcccgcaacgagttcagcctcgactccaaggccaccatcggcgtcgagttccagacccgcaccctcgtcatcgaccacaggagcgtcaaggcccagatctgggacacc

SEQ ID NO: 56927 - DNA, 414 bp, Zea mays
  Clone ID: LIB3069-034-Q1-K1-G11
caaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctggccgccgccgaactgacgctggcccagttgctcgtcaacctcgctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggttggcaagagtggcaaagcccttcactacaagggaagtaagttccacagaatcatccccagcttcatgc

SEQ ID NO: 56928 - DNA, 452 bp, Zea mays
  Clone ID: LIB3069-034-Q1-K1-G12
cggacgcgtgggcgggttttgggttgtcttccttcccagttttgttttaccagtggagacacggagattggaggacagaagggcgcagcacaggactacagcgaggtgggaaggccagatcaagcaggagacaacaagaggatgtgataaatggtgatctctgcgagcagtatccctccctcccagctgatatgtagaggaagattgctgatcatctggatagaacttcgacgcctgcagcactgcttggtgaggattgccaaggaggaagactagaacagacaagagcagcgctaatcagtgacagagcatgatgccatccagatgggacaagataaggcatgttatggtgttctctggtttctcatcgagaatagctctttctctttcgtcaagggtttcaccaatggcttgtaacaactggatgtaaaacatttttggtttttaatcga

SEQ ID NO: 56929 - DNA, 54 bp, Zea mays
  Clone ID: LIB3069-034-Q1-K1-G2
cggacgcgtgggcacaagttgggttctgaatggcattgactgtgtttgctgatc

SEQ ID NO: 56930 - DNA, 110 bp, Zea mays
  Clone ID: LIB3069-034-Q1-K1-G3
ccaaaaaaaaaaaaaaaaaaaaaaaaacataaaaaaaaaaatgaaacaaaaaaatgaagaggccagagaaaattataaaaaaaggaaaaaaataacatagagacagtgga

SEQ ID NO: 56931 - DNA, 408 bp, Zea mays
  Clone ID: LIB3069-034-Q1-K1-G4
acggcccaaagatcttcccacagaaaaaggctgggttgctgacgccgctgaggaacctgctgggcctggtgcggggccccaagtacgacggcgtgttcctgcacgacaagatcaagagcctgacgcacgacgtcagggtggcggacacggtgaccaacgtcatcgtgccggcgttcgacgtcaagtacctgcagcccatcatcttctcgacgtacgaggccaagaccgacgccctcaagaacgcgcacctctccgacatctgcatcagcacgtcggcggcgcccacctacttcccggcgcacttcttcaagaccgaagccaccgacggccggcccccccgcgagtaccacctcgtggacggcggcgtcgcgggcaaacaccccaccatggtcgccatgtccatgctca

SEQ ID NO: 56932 - DNA, 439 bp, Zea mays
  Clone ID: LIB3069-034-Q1-K1-G5
ggggaagagagagagagagacggaaagggggagatgagccggagcctggggatcccggtgaagttgctccatgaggcagcgggtcacgtggtgacggtggagctcaagaccggcgaagtgtaccgggggtccatggtcgagtgcgaagataactggaattgccagctcgagaacattaccttcaccgtcaaggatgggaaggtttcgcagctggagcacgtcttcatcagaggaagcagagtgagatttatgattatacctgatatgctcaagaacgcttccatgttcaagcgcttggaagcgagaattaagggcaaaggatcagctattggagttgggcgtggacgtgcaagtgcaatgcgtgctcgggctgcttctggtcgtggtggtggtccttgttgggccatggcaacgcgccttctgtgaggaggtaggattt

SEQ ID NO: 56933 - DNA, 435 bp, Zea mays
  Clone ID: LIB3069-034-Q1-K1-G6
ctagttgatgttgttgagggaaaagtaatggaagtattcaaggaggatcaagctgtggaggttatcaagttcaatccaagcaaccccgatctcttcctatctggtgggtccaagggttcccttaaactctgggatattcgatgtggtctggtaacaaaagaatttcagagaagccttggaaccatccttgacattgacttcagtgctgatggaagacaatttatctcttcaactgacacaaccagaagcaatattagtgagaacactataattgtttgggatgtcctgcgacaagttcctttatctaaccaggtttataccgaagcattcacatgcccgtgtgtaaggtaccacccacgtgaagcatcatttgttgcacagtccaatgggaactacattgctatgttttcagcaaggccaccctttaagctgaac

SEQ ID NO: 56934 - DNA, 418 bp, Zea mays
  Clone ID: LIB3069-034-Q1-K1-G7
atccaggctagccacgtcgaggtcggcatccgcggcaacccgccatacctcaaccatgacctgacacacccagtgaagactgactcgtcgttctggacaatagaagacggtgagatgcatataacactgcaaaaaaagagagaaggggaaaacatggtcatctccaatacaagggcaagggattttggatccatatgctgcagatcaagagcaaaagcggcttatgctccaaaggtttcaggaagagaaccctgggttcgacttttcacaggctcagttcagtggaacctggcctgacccaagaaccttcatgggagggatacgctccgagtgaagcaccctacctgcctatgtacgtttctactatatcctcggcatcttgatagatgcagcaggcgtgcttattatggctgaaaat

SEQ ID NO: 56935 - DNA, 435 bp, Zea mays
  Clone ID: LIB3069-034-Q1-K1-F3
gaaggtcccggcgctctcatccggtgaaaataaagaggggaaacggacaggagccgcctgaaatggacagcggaagcgattccgacggcgctcccgaggagctcactgctgtgcagggtgttgcgaagcacgaagagaccagtaaagtcgagaaagacagtgttctcagagtaacacgggaaggaaaggaacggaggaaacgttgggcccaacgaagaacatcctctaaaccagataagaaggcgccaaaggaagtagaagatgaagatactaaaaaaagtgaggagcatgaggagacaaatactatgcctggcatgctccccactagtgtaattgaaattctagcagctcgtgagaagcaaaccttcgcatcagattccgaggaagaaaatgtaaagcagaatgtccagaggagaaagaagagaatggaaactg

SEQ ID NO: 56936 - DNA, 314 bp, Zea mays
  unsure at all n locations
  Clone ID: LIB3069-034-Q1-K1-G8
acgcaggttcttctacctgcaagagaggatttgttcagttctgctacgagccaatcaagcggatcatcaaaacctgcatgaatgaccaaaaggagaaattgtggtccatgttgcaaaagcttaatgttaccatgaaggctgatgagaaggagttgattggcaaagctttgatgaagcgtgttatgcaaacgtggctaccagccagcactgcacttcttgagatgatgatattccaccttacttacnccgcaaaggctcaaaagtatcgtgtggagaacttgtatgagggaccccttgatgatggttatgcaact

SEQ ID NO: 56937 - DNA, 225 bp, Zea mays
  Clone ID: LIB3069-034-Q1-K1-G9
ctggatctgctgcgacttatgcgagacatggttccacggcaagtgtgtcaagatcaccccaaataaagcggagcacattaagcagtataagtgcccctcgtgcacaggaagcaagaagggccaaggctggatccaatcaatcaacaagttagatttgaatggcggccaatgttccaggaacggaggagcctttaacaaagagtggagaatgaattttccgggtgg

SEQ ID NO: 56938 - DNA, 426 bp, Zea mays
  unsure at all n locations
  Clone ID: LIB3069-034-Q1-K1-H1
gttntgcttgatggcacctggagcaattctgctgcactgtacagaaggttgaaggagagatggactgcagtatggggagatgaagctctaccttgtattgcactatctacacttagtgcctcagtgatgcataaactacgaccgcagcctgcctgggatcgtacctgcactgcagcagctgcagctggcctcctctgggagttgagctcgcggcctgagctcatctcatttgggttggaaaagcaagccgaagcggtggaatgctcgttagacaacttgctggatgctctcactgccaggcggcttcgtctgggccgatcgataactcggaaacagagacataataagaactgcatatagggaaagaagaaactcacagtaacagaggagcatggtgtgccaatcagtggaaagctgatttcattc

SEQ ID NO: 56939 - DNA, 359 bp, Zea mays
  unsure at all n locations
  Clone ID: LIB3069-034-Q1-K1-E10
cggacgcgtgggcgggaacgcagaggcgggggcaacaagaaggccgggcgagaagacaagaggaagccaaaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgtagcaccaacaaaagcagccttggcgccacaggcctctgctgcgccgncaactacag

SEQ ID NO: 56940 - DNA, 446 bp, Zea mays
  Clone ID: LIB3069-034-Q1-K1-E11
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtgg

SEQ ID NO: 56941 - DNA, 447 bp, Zea mays
  Clone ID: LIB3069-034-Q1-K1-E12
cacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggggcatatccaaaagcttagggctcaaaaagtgtctcattcgctctctgatcttgctgactccagttcagatctgcaagcattctcgcagggtctttctacgctattagataagatggatccctctcagagagcgaagtttgttcaggaagtcaagaaagtccttgattgatgataccaacacatccaacacaatgtgtgcatgtcacatctttttggtctagtacatacat

SEQ ID NO: 56942 - DNA, 432 bp, Zea mays
  unsure at all n locations
  Clone ID: LIB3069-034-Q1-K1-E2
ccgtccgcgtgaccgccgtgggctnacgccaccanctcgagtaccctccatcttcccttctcaaggtaccgaaagttccgnaatctgttcgagtacctcngnntcgccgcccgtctggttttggccccccttttccacagccccgtcgcttgtctgtcagcagggtacctcnnccagagctcttcatnnctccatttcnncacggctcagggtgaatccaactggagttccatttcnncacgctgnngcctctattggcgttcgttctccttccaccagaaaaggatgcnnaccgccagaaattgggagtccccccagaacctggattgaccaagctcttgattgggccctcgccggaaaatgggagtccccccaaggcgccaactcaaccttaatcccttctcaacgagataagttgtcgacantcaatgg

SEQ ID NO: 56943 - DNA, 439 bp, Zea mays
  Clone ID: LIB3069-034-Q1-K1-E3
cccacgcgtccgatcagcagtttatattgtgttttgtacgtattaaaaatgcaagaatcatagcaaaacgagcaaaatttgaatccatcagctgtttatattgtaataaagtatgacaagctctctgaaaaaaaaatcagttgcgtaatctgtccaatgttgcatttgagctattgcgctagttaatccttttattttcggtatgacttgcagtgcctctagagatggagattctatgctaagggtttaggagctgcatggtggatggtacattgtgctttctgcgccgtgcttcctgaaagtctatctgaagttagtttaaagtatggtttatgcaagtgttcccgatatttcccacgatggattcgagccttgtgctgaacttgtgctagcctagcctgttataagatctatggtaacgatgactgcaatttatcta

SEQ ID NO: 56944 - DNA, 346 bp, Zea mays
  Clone ID: LIB3069-034-Q1-K1-E5
atcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgaga

SEQ ID NO: 56945 - DNA, 444 bp, Zea mays
  unsure at all n locations
  Clone ID: LIB3069-034-Q1-K1-E6
cacgacttccgtccgagtctgagctcatctccacgcgccgccgccgccgctcgacgcccaccgcgcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatcntcccatgcttncgtgtgaaggaggcgaccatgtcatc

SEQ ID NO: 56946 - DNA, 455 bp, Zea mays
  Clone ID: LIB3069-034-Q1-K1-E7
ctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaccgcctcgcgggggagctcacccaggtgcgcgccctcctctcccgcatcgacacctggcagcagcagggcccgccgcccgcggggctccgcggcgaggtgcggaagcggtgcgggcagatccttaccaggctgcgcaaggacaaagcgagcgtgtggttcaacggcgccg

SEQ ID NO: 56947 - DNA, 372 bp, Zea mays
  Clone ID: LIB3069-034-Q1-K1-E8
cggacgcgtgggtccgcgaccagcgaggagtgcactgtcgcttggggtgtctgggatcatgcttttcacttccactgcatcagcaggtggcttaagactcgccaagtgtgcccattagataacagggagtgggagttccagaaatatggccactagttcctgggcaccgtcatgtggtgttgggactttgctgccactcaagtgtttttgtctgccaaacagctccatctcttactgctttcgatgcttgcatctatcacccgtcaattataactagctagcagtacgtacacctgggactgtatttggactatccattgagaggatagtaggcccattttatcaatgggatgtggatcttcataagtgagc

SEQ ID NO: 56948 - DNA, 445 bp, Zea mays
  Clone ID: LIB3069-034-Q1-K1-E9
aatctatgcgcagggctgagctgactcagtttcaaaagcaagttgaggagcaatatctctcaaatgtggagaggcaattggagaggatccagaatgcccggaacgctcggaaggcgaacgggcctggtaacatgcaagaaatggacaaggagctggacacccacagggcggagcatggtccaaagcctcggcgagttcccgaggagggcggcaatgatgacgacgaagatgcagatgacatggctgtggaagacgagctgatggatgaagttttgggcatcaacgatggaatcaatgaggacccatccaagccgtccgaagaagctactactgaaggtcagccagcacccgaggaagcacaataggattctttgttcacacaaggtaagcgtaccattccggcattccgtatgcttagttgccgtcttgttgggtgctgcctgtg

SEQ ID NO: 56949 - DNA, 387 bp, Zea mays
  Clone ID: LIB3069-034-Q1-K1-F1
cccacgcgtccgctccgctgggccaccagctttgaccgccgcctcccttcccctccgcgactgctcctcctcaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtga

SEQ ID NO: 56950 - DNA, 411 bp, Zea mays
  Clone ID: LIB3069-034-Q1-K1-F10
aaacacacatttggaagcaccaaggagaagaaagcacgggttcagcgaatttttgctgcgggaaagtcactgcttaactttgttcagattgatcagttgagaatttattttgattcatcatcgaagaagtttgttatggccaagaaccctcctgtttctaaaactaacacccctcttcacgaatctcctgatgcacttaaaacaagtggcactgaaatggattatgaggctgctagaagatttgattcagtttcttctaatatgggcacactgcagtctaaagtgcagttttgtcctgatggtgacgatgatgaagaaattgttttcaagccaacagcttccgaaaagtttccgaaagctccttcagatctgttggttaatggatacactcatcctgtacctatgtctact

SEQ ID NO: 56951 - DNA, 387 bp, Zea mays
  Clone ID: LIB3069-034-Q1-K1-F11
tgatccagcacatgcagataaagtgaaaaataccttcatattcaacacatttgttctctgccaggtgttcaacgaattcaattcgcgtaaaccagatgagctgaatatattcaagggcatttcagggaaccatctgtttattggcatcatagctataacagttgtactccaggcgcttatagttgagttccttggcaagtttgcctcaacggtaaggctaagttggcagctgtggttggtatctataggtcttgctttcttcggctggccgctggcattcgtggggaagcttattcctgttcctaaacgtccattgggagaattctttgcatgctgctgtatctgcaaagggagcaaacaagcccctgacgacgcaacctctaatga

SEQ ID NO: 56952 - DNA, 363 bp, Zea mays
  Clone ID: LIB3069-034-Q1-K1-F2
cccacgcgtccgcgaaaaactctccgtcagaggataaagaagaatcagaaaagcatatggaggaactatgctccaaaatcaaggtgggtgatagatgtgaagttgagcctggtgccaagaggggcactgtaaaatttgttggtagagctgaagcccttggacgtggattctgggttggagtgcaatatgatgagccacttgggaagcatgacggcatggtgaaaggcattcgcttctttgagtgccctcaaagtcatggggcaattgtgaagccagagaaaagtaaagttggcgactttccggagagagacccatttgaagacgaggacgatgacgagatttgagtgcgtgtgcgtttggaaa

SEQ ID NO: 56953 - DNA, 365 bp, Zea mays
  Clone ID: LIB3069-034-Q1-K1-E1
ggccaatcccgagcagtggtgcgaaacctcgagcgctcgcgccggtgaccataacaaagaggaagccgcggtagcactggtagcggcagcagtaagggggagatgtcgtcggcgttcagcggcgatgagaccgcccctttcttcggcttccttggcgcctccgctgcgctcgtcttctcatgcatgggggcggcgtacgggacagccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatacta

SEQ ID NO: 56954 - DNA, 345 bp, Zea mays
  Clone ID: LIB3069-034-Q1-K1-C4
cggacgcgtgggtcctccccgagcgccgcgtcgtcgcctcctctgatccgtcgcctccccgagatctgctctcgtccttccgggggcttgcggcggaggtctggacgtacatccgggtcgtcgagcgctccgggctcgagggctcggatgagtcggagtactcctcggatgaggatgactcggacggcggcagcaaggacgaggacgacgacgacgaaagcggtggcggcggtgacggtgacggcagcggcaggggcggcagcggcggcagcaaggatggtgacggcggctgcagcaggggcggcaacggcggtggtggcagcagcagaggtagcaccaggggcg

SEQ ID NO: 56955 - DNA, 70 bp, Zea mays
  Clone ID: LIB3069-034-Q1-K1-C6
acgcccacgcgtccgaaaaaaaaaataaaaaaaaaaaaaaaaaaaaaaaaaaactagttctagatcgcga

SEQ ID NO: 56956 - DNA, 373 bp, Zea mays
  Clone ID: LIB3069-034-Q1-K1-C8
gaattgccgggtccgaccacgcgtacgcccacgcgtccgctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctggccttaagcaggctggtgcccgtgtcattgtgaccgagatcgacccca

SEQ ID NO: 56957 - DNA, 451 bp, Zea mays
  Clone ID: LIB3069-034-Q1-K1-C9
gctccagatcgaccctcgagcctgtcgaacgatcctttaattccaaccgatcgaaaagttgcagcggcagtgttgaggccaaggccaccgacccacctctctcatagcactagcagcaatggaggtggagatcctcgagtcctgcatggtgaaacccagcgacgacatagggacgccgccgccgcccatgcacgtggtctggctctccaacctcgatctactcgtggccaggagccacacgcccaccgtatacgtgtaccggcccagccctgacccggacttcttctcgccgggcgtcctcagtgctgccctgtccaaggcgctcgtccgcttctaccccctcgccggccggctcgcgcaggacggcgccggccgcccgcagatccactgcaccggagaaggcgcgctcctcgtcaccgcgcgcgccgacgctacccttcaggacatcccc

SEQ ID NO: 56958 - DNA, 293 bp, Zea mays
  Clone ID: LIB3069-034-Q1-K1-D1
cggacgcgtgggcactttttgactaggactttatttatgtaaccgtttgacaacaaagcctatctgccgtgaattgtcacactgcggaggccttatagaaagccacttacgcaattaaagattcaggaaatgacatcgaagggttagcagagcgcagatggcgtgaatctgtaccactgcagccaaacacttcacagcagattttgtagctattgttgttggtagagggtttccgcttctcttgtgtaactgaaagctcgtctttatttcaatcactatacctttcttgacag

SEQ ID NO: 56959 - DNA, 411 bp, Zea mays
  Clone ID: LIB3069-034-Q1-K1-D10
agagtttttcgcgtcaaaacttcacttttctcgcctccaatggtctgctaatcatttcggcattttttcagcttcccgtaaagacgatgatgcatcccgcatatatgcgtgagcgaaactctccccaattcttcccgagcgcgcgcaatccagtagcttccgacgtcttttttccagccgcgcacgcagttttgttcgaggaaaggagggcaagagcgggagacacaccatcgtcgttggaggagccagccaaggcgttggagtgtgagatgatacattcgggatatgaaccagtcgggcgcgacgatctaaacctatcgaggcaagcacgtcgggataacaacgtcggcttgcagcgtccttcggcgagggccattcatcctttggacctccggcaaatgggtctatttt

SEQ ID NO: 56960 - DNA, 372 bp, Zea mays
  Clone ID: LIB3069-034-Q1-K1-D11
cggggctcgccgtccgcggcgagggccgcgtggtggggtgccgcagcgcctgcgccgcctacggcgcgccgcagtattgctgcacggggcagttcgggagcccccagcagtgcaagcccacggcctactcgcgcctcttcaagtcggcgtgccccaaggcttactcctacgcctacgacgacccgacgtccatcctcacctgctccgccggcgcctcctacgtcgtcaccttctgcccgcaccgccgctgaacttttatttttttaaggtcttcggccgcgtgttgttagttatcctctgcctgcgtttgcgttttgatgttctggcgtgcgttcgtttcacttgcctccgtcacgcgtcttcggaatctcc

SEQ ID NO: 56961 - DNA, 415 bp, Zea mays
  Clone ID: LIB3069-034-Q1-K1-D12
gaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctggggattgggtttgcattgcatcgtgttcttgccggtctagcaagtgactataagaataatggaataaacgatgacccagtgtgtgtatgatttccattctgaagaacaacacatcccttgcaggattgttgttcagtagattttacttgtaccgcggctttggagttccccaaaggactttgttcaagaacttcttctctcacaggaaataacatgagtgcagtccgtgcttttatcaaaaaaaaaaaaaggaaaa

SEQ ID NO: 56962 - DNA, 320 bp, Zea mays
  Clone ID: LIB3069-034-Q1-K1-D2
acgccgtgggagcggctgcagcacgaggcagagcagagcgagggcaagcttatgggggtccgtacgggaccaccaagctgcacatcccaccatccgccgcccgccgacccacgttcctgccattcgtggccgtcctcctcctctgctctgcctcctatctcatcggcgtctggcagcacggcggcttcgccactccatccgacaaacccgacgacgtctccaccgctacggccgtcgcctgcaccaacgtcgccgtcgtcccgaagaggaggacccggtccggcgccagcttcccgggcctcgacttctccgcgcgccac

SEQ ID NO: 56963 - DNA, 419 bp, Zea mays
  unsure at all n locations
  Clone ID: LIB3069-034-Q1-K1-D3
gctgctgttcttgtttccccgctctccaagatgtcgtccccgagcaagcgccgcgagatggaccttatgaagctgatgatgagcgactacaaggtggagatggtgaacgatgggatgcaggaattcttcgtcgaattcaaggggccggccgaaagtatctaccaaggcggtgtctggaaggttagggtagaactgcctgatgcatatccttacaaatccccgtccatcggcttcatcaacaagatttatcaccctaatgttgatgagatgtctggctctgtatgtttagatgtcataaaccaaacatggagcccaatgtttgatctagtaaatgtttttgaagtattcctttcacagctgttactatatccaaatccttctgatccattaaatggggaggctgcancacttatgatgcg

SEQ ID NO: 56964 - DNA, 54 bp, Zea mays
  Clone ID: LIB3069-034-Q1-K1-D4
agtacatgcccaaacgcctagttgtccataacgtactgcacggtcaagcacctc

SEQ ID NO: 56965 - DNA, 398 bp, Zea mays
  Clone ID: LIB3069-034-Q1-K1-D5
gctgtgctcgcggatgacatattgaaaaatgtggaatatgatgctctaagggttattttcaacaagttccattctgtcatatcgtttaagcccacaatggtaacgatactgtcccctgaggttgcagaaaaagaagcagaagctggtgggaagatgggtgacctagattcttatgagattgaaggcggtgagacaaaagcagagatattgcaaaacctagctgagttccagttttcttgtgtcatgtacaatggtgccctagagaatgcatgcagtgagcttggagcccgtatgtctgccatggacagctctagcagaaatgctggcgatatgcttgatcgtctcacgcttacttacaacaggacacgccaagcattcatcaccacagagcttactga

SEQ ID NO: 56966 - DNA, 414 bp, Zea mays
  Clone ID: LIB3069-034-Q1-K1-D7
cccacgcgtccggaaaagtagatccgggttagggttttagacggcgatgggtgcggcgggcgacgagaaggctgcgatggctgcgtccgctgcagccgcgggtgccggtgccgccgagggcgagggcgcggtggactccaaggaccttcagcagcagagcaaggcgctcgacaagctcactgatcatgtcgaggaccggcagctcgattcatcccgtgtccaatccgccatggcagcacttgcttcatccaaggaggctgactggaacgcgatgaggctgagggagaaagaattggctgctgtgaagatcaaccctgccgatgtcgaaattatcgctactgagcttgagctggacaagaagatcgcggagagaacgctccgtgagcacaagggtgatgccgtggctgcggttcg

SEQ ID NO: 56967 - DNA, 410 bp, Zea mays
  Clone ID: LIB3069-034-Q1-K1-D8
ctgttgtattgcaggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaacaaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggtctgtccaaagag

SEQ ID NO: 56968 - DNA, 447 bp, Zea mays
  Clone ID: LIB3069-034-Q1-K1-D9
gccagccagccatcgtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaagccgagactgagtccaaggaggtcgaggtcgaggccgaggccgtagctgaggctgagccgaccgaggcagagcccaaggaagcagagcccgaggccgtcgcgccggcagcagagacggaggctgctgctgccccggt

SEQ ID NO: 56969 - DNA, 437 bp, Zea mays
  Clone ID: LIB3069-034-Q1-K1-C3
ggacaatgaaagatatcttaagttggaaaggcaattcgttaaattctaatcgaaaactcggcctgaatcgaacagctggatcatcaagtactgttgatgctaatgtggatcctactgtattgccacttgaacctaaaggtggccaactgcctttgttcagcagtggtgattggatgtcagacattgattctggatatgaggcagcagaaattgcagcttctactcaaacctcttcgggtgtcacaccatatctgtgttctgctggaagtgtttttggcagttcatggatgctggttaatcatgaccaatcagatggaccatcaacttctgctggtacatcatcgcagcagaaagttgtacctcaaagcgagcatcagcggaattaaacccgcttcagatctgcaggaaattccagagtcaaaaacctttttgctgac

SEQ ID NO: 56970 - DNA, 375 bp, Zea mays
  unsure at all n locations
  Clone ID: LIB3069-011-Q1-K1-H10
tttgggctggtttatgtgcttggacttggctcgacgccctcgaagcagccgccgtcgatgagcccgagcataaggacttcgccgacggtctcgcgcttaagtattagggtacttgacattctcccggagacggcctatgatcggcgccttgttctctcggaattggcctcgccggcgttattacttgcgctcatactgagtagcatgagagggatcttctcaagattggtagggacctataggatgtttccgtcttgtcggccgacgccgtgtctaagtctcttaagacgtaagagcatatcggatgtctcgtttttattgctactatacanaccccgaagagcgccccagaacgagccgaggtgtccatataaa

SEQ ID NO: 56971 - DNA, 369 bp, Zea mays
  Clone ID: LIB3069-011-Q1-K1-H11
tggctctggacctttgggctggtttatgtgcttgtttatgtgcttgtacttacttatttatttatctagatttagtcgtatttctctgtcttcccagcgtgttattgttggttacggtcgttcgtttattgcttctttttattatacggttagcttagtgtatagacacagtagtaactatccaacgtcagtcttctctttttgcgagttgcagtcctatctcgtacgtatcttggttacgggtttacggtcacacaagttgtcgagtcgtgacgttatagtattgtgtggttctaagtagtcttccctcctagtagtatagtcagtcagttacggggagtaagggggcggtgtctgtgtcgtcgtctc

SEQ ID NO: 56972 - DNA, 349 bp, Zea mays
  Clone ID: LIB3069-011-Q1-K1-H12
tttgggctgatttagtgcttggagggccacactacgcaacctctcaatacccgtcagaacaggaccgaaggcccacgaggtcgccgggcgctacgcctagatggaatacaaaaaaaagggtggttgtctcagaggacttaagtccatgcatgtgcgtacgtgatgctacagtctcctcacagcgctattcaaacctaacctatcggttgatgccccataatgctacgatcgggaaaatttcggtgccatttaatccaacagttccgtactatacttattccctgttagtcggtgcaacagtgaagaggtttgtattgactgtttcctttaatagccgtgtaattcgaac

SEQ ID NO: 56973 - DNA, 341 bp, Zea mays
  Clone ID: LIB3069-011-Q1-K1-H4
gagacctggaacttgttgccaaaagtatctagtcttcagacctcaacttctcacgttacggggacaccttttatgaggtggtgcttggtggaaggcgcactcatccaagcactgtaatacctgaataaagagaccgacacccttattcggtgttagattgtgcgtcacaccgtgaagcaatattgcctttcgtactctatatccagaaaacattgcgcaggaggcctttcttaataaagaatcttgaaaatgttatgcgtaaattcctgcaatccttggagttctttgaggaaaatgagaggaagaaactcgccatattcacagcccttgcattttctcag

SEQ ID NO: 56974 - DNA, 291 bp, Zea mays
  Clone ID: LIB3069-011-Q1-K1-H5
tccggactagctttagatcacacggggtgccattgactctaggtcgcgaaggggagggctctcaaaacactatctgcctgcaaccgactatgaacaccttcaagctgagatttcaccgtgctcagcgatcaagccaattacagatactcgacaagcttcgcacatctactagacataccactcacgcgcctcagtaaccagactaatagacgctccctggtgtcagtattctacaccgacttatgcatagcttcctgctacgacctaaccggtgacatcgtatgactgcgc

SEQ ID NO: 56975 - DNA, 281 bp, Zea mays
  Clone ID: LIB3069-011-Q1-K1-H6
gctgaaatgtagtaatggctgtggctgactctactgctccatttccctattaatggagctggttgtgctttactgaccaaaggtttcgagtgtaacaagattttgttcgctagcaacttgctgcaactgcaaccaaactcctttctgatatgagataattaggacaaaacaacagagctaagttgcttttttttggggtcatgttaaacaatgtatgcagtattgctagtgcccctcttgaaaacagttactgacaaccatatgctgtgaaaaataaattc

SEQ ID NO: 56976 - DNA, 455 bp, Zea mays
  unsure at all n locations
  Clone ID: LIB3069-011-Q1-K1-H7
gaaaggggaagcccgccgccgcccctgcctttagcaaccagcagatcgggacctctgggctgcgcaatccatccatggcggaggaatcaggccgtcccttgccaaagtttggtgaatgggatgtcaacgatccggcttccgcagactgatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacagccagccctacgcaatcctgaggaaggcaattgcatgcgctggaaatactgcccctttaattttctatacatactatccattagacactgtanaggtacccatggctctctggcttccagatgggtgtctcataaaactctggcgtgcatgtatgtatg

SEQ ID NO: 56977 - DNA, 312 bp, Zea mays
  unsure at all n locations
  Clone ID: LIB3069-011-Q1-K1-H8
gccatgccatctcatatgcgacaagcgaatcatagcactggcatgagcatggaccggatggggcggcgttacatgtgcttgatgatcgatctggctcttctggccgccgcggcgtcggtggactcgtggctgtacgagaagttcacgacttgagggaacttgcgcgcggactacaacgtcgcagggcagcacgtgacgtctctgatcctgacgcagcagtccggcggcgccttcagctcgcggcagaagtacctgtacggngagttcagcatccagatgaagctgatcccgggcaactacgcgggcaccgtg

SEQ ID NO: 56978 - DNA, 471 bp, Zea mays
  Clone ID: LIB3069-011-Q1-K1-H9
tttgggctggattatgtgcttgtttatgtgcttgggtttgtgattggatctccgttctggtaagtcttataagttcgagctacgcatgtcgtaagtatataaaggagataaaaccaaggcctatcactgcgggatatcgatcgacggactagcccctgacctcagtcacgatagaggcgatttgcccgaacctatttccggaaacggttaagcgacaaaaggccgggattaaggaccgtctggcacgcgtgcgggcgaaaagaggaagtcaaagacattcgtaaagacgggccacggcgagtgaggtcttttattaaagaccttaggcggagtaatctcgactccttatatggagtccactgttgctaatgggaagatacttggtggcgtaaaggtagagagcgacagcgagtctcgacataacgtaccggagagccttaaagtctgagaggagcagcagtagtgctgtac

SEQ ID NO: 56979 - DNA, 285 bp, Zea mays
  Clone ID: LIB3069-012-Q1-K1-A1
cccacgcgtccgggtgggttggcttctccttcccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgc

SEQ ID NO: 56980 - DNA, 405 bp, Zea mays
  Clone ID: LIB3069-012-Q1-K1-A10
cccacgcgtccgagaacccccagtcgcccaccatatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaagtgtgaaggttgaatcctcagcagttccttcagccccaactccagatgttgctgaagcacaggccccagctgctgaggaagaggacgatgatgatgttgacctttttggtgaggaga

SEQ ID NO: 56981 - DNA, 484 bp, Zea mays
  unsure at all n locations
  Clone ID: LIB3069-012-Q1-K1-A11
cgggccgaccgacgcgtccgcccaggcgttctataactttcagncgcctaatagatcactcgacaaaccccgnccangggggagcgctgtttctaacgcaagcggaacacctaagcacgactcaaaaagctcgatgagtaccttctcactcgcagctacatcactggctaccaagcttacaaggacgacttggctaggtacacttcgcatacgtctgctccctcgaccaagtatatcaacgtagaaaggtggttcaatcacactgatgcgcacgagaggctgagcagaattactgcagagggccacggtgtgaaggttgaatcctcagcactaccttcagccccaactccaaaatgtgcttgaagcacaggccccagctgctgaggaggaagacgaggatgatggcgacccttttggtgaggagaccgaagatgagaagaaggctgcttaaaagcgtgctgcaactggcaaggcttctggcaag

SEQ ID NO: 56982 - DNA, 409 bp, Zea mays
  Clone ID: LIB3069-012-Q1-K1-A12
ctgagctccaaagaatctagcagctaggagcaggccgtgtatacgccatccaccacggcaacatgtgctccggctcctggtcctggagcagcagcagcagcaagaagcgcccgtctcttgttgtcgtcaacctcaagcggcagcagctgcagaagacgccgccgccgacgccgcctcgtgcctcagttgctatcaggaggaagaggtacccagctaacccgccctgctcgagtttcccaagcttcctctgctcaagtttcagcagcatcagcgacagtttcctgcaatcacacaagtacactgtacacgtacgtacgcaggctgaggctgaggaagttgcgagccggagcagaggccatggagatggtgaacctgaagctctacctggagaaccggtgcatcatcgcgg

SEQ ID NO: 56983 - DNA, 197 bp, Zea mays
  Clone ID: LIB3069-012-Q1-K1-A2
gccaccgacccacctctctcatagcactagcagcaatggaggtggagatcctcgagtcctgcatggtgaaacccagcgacgacatagggacgccgccgccgcccatgcacgtggtctggctctccaacctcgatctactcgtggccaggagccacacgcccaccgtatacgtgtaccggcccagccctgacccggac

SEQ ID NO: 56984 - DNA, 105 bp, Zea mays
  Clone ID: LIB3069-012-Q1-K1-A3
cccacgcgtccgcccacgcgtccgcctactcgtccgaaaaaaaaaaaaaaaaaaaaggggggattattaaaatagattggggggttaataaatttaagatgggtg

SEQ ID NO: 56985 - DNA, 464 bp, Zea mays
  Clone ID: LIB3069-012-Q1-K1-A4
gaggaagcaaaggcacatgaccgtcgtcttcgggtgggacgacgagtccgtcctcctcgatgcgatggtcgttgaggccacgcccgtctgtgagtcccgtcgcaagaggcgagcctccacctgctccaacaatgacggcgccggatccaacaccaaatacggtgatacggttgacaggtgcgtttgttagctgttgtggcatgctgggctgattttaggccaccgcctggtttcaactttcaagtcatggaatcggtgctcagggctcctctcttccaccctgcgaaggtgacttatagcaatggtgcaaacagatgggggacaccacatcatgcccatccgtgagatcttggcctcaacgtcgattgagaagatgacgttgcaaatatttcagacttgtcaagataagaagagacgaaggaagaacaatcaaatgagaaaccttttcagtcagtatagaatga

SEQ ID NO: 56986 - DNA, 481 bp, Zea mays
  Clone ID: LIB3069-011-Q1-K1-H1
cggacgcgtgggcggacgcgtgggcggactcgtgggcagggcaaagcttgatgacaatgctggacgacttgacttcacccagaagcttgaggctgcctgcgttggagccgtcgagtctgggaagatgaccaaggaccttgcccttctcgttcacggatcttcaaatatcacgaggagccattacctgaacacggaggagttcattgacgctgttgctgacgagctcagatcaaggctggcggccaactcgaacctttgaaatccttgccgaagttgtggtgctttcctgcgcgacgctttcgaaccgtttttattatgtcgccattttctttccctgtgccaccaccctgaatgaagaaggcctgagctaggcgaacatctgcaggccgcagcagtatgccaaatcattatcattaccgttgccattaccaattggagattgccgtagattccgcgattatgggaactcatttacctgatt

SEQ ID NO: 56987 - DNA, 315 bp, Zea mays
  Clone ID: LIB3069-011-Q1-K1-F4
aactaactttccttgtgaaaatggaaattatcttcggtaagccatgggattgagttggatggttagagaggattttagttccaaactagccctcaatcctatggattctaggagaggattcgagtttccaaactagctgcggtaatccaagggatctagtcagattttcggagaggatttgggtttcgaaactagccctcaatcccatggattctgggagatgattgcagttaaaaatctagctcttacatgatttattacctgcatttggtctttacatgctacagactagagtatatggattttgtagggcat

SEQ ID NO: 56988 - DNA, 431 bp, Zea mays
  Clone ID: LIB3069-011-Q1-K1-F5
cggacgcgtggggcgagatggcggttgccttcggggacatggcggaggaggcctacgggaagaccagggcgcgccgcccgcccggccccggctccggccctggtcccgccctcgtctcgcgccgcgagcacgtgtccatgcgcgacggggccggcggcggacaccggacctgcgtcgtcgtgcgcggcagggagcgggagatcgcggtggatctcgtctcgcgcgcgcagggccagggccaggggcgggagcgggacagggccgaggtcggcatgtcggtctccgtcgacggcgatcgcgtgctccacgtccgccgcctgcgctggaagttccgcggcaccgagaagctggacctcggcgccggcgaccgcgtactcgtctcctgggaccttcacgactggctctttcccgcgcgcgaagcctctccaccc

SEQ ID NO: 56989 - DNA, 306 bp, Zea mays
  Clone ID: LIB3069-011-Q1-K1-F6
cccaccatcacctcccgcagagatccagacttccgtgcgcctcgtgctcaccggcgagctcggcaagcacgccgtctctgagggcaccaaggcctgcaccaatttcacctcctcctatgcttgcacgctcgaccttgcaagctcttctggtgctgatgttcacactgagttgaagttagatgtcgctggtttctctgtcagagctgctctatttctgtaggaactccttaatgtaacccaccagggcctggttaattgggaattattaacactttggtggtgatcacttatggttcaaattcttaa

SEQ ID NO: 56990 - DNA, 471 bp, Zea mays
  Clone ID: LIB3069-011-Q1-K1-F7
agttcctgaggttcaagcccgagccggtggtgatctacgccttcactaggaacgaggagcggaagcaacgcatcatatacgagacgtcatgggggagcatcacgttcaacgacgccatcgtgcactatggcctggacagcatcccgttcggtggcatggggcacagcgggttcggccagtaccacggcaagtactcgtttgacatgttcagccacaagaaggccgtgctcaagaggagcttcctggtcgagttcatgttccgctacccgccgtgtgacgagaccaagatcggaatgctcaagcgcgtgtaccgcttcgactacgtcttgctcttcctcgcgctcatcggtctcaggagatgaagcagccggcggagagtgcgtgaacaatcgagccaacagaatttgcactcacaccgaacacacagttgctagtggtcaattgtcggtcatactgatcgaagaatatgta

SEQ ID NO: 56991 - DNA, 475 bp, Zea mays
  Clone ID: LIB3069-011-Q1-K1-F8
gcatgaacgaggggagattggatgatccgtccagcgacgctgatgatgtggtcactggttgggaagacacggatggtgactggatgctggtcggcgacgtaccgtgggagatgttcgtcgagtcatgcaagcgtctgaggatcatgaagagttctgaagccataggtcttgcaccaagaacgaacgacaagtgcacgaacaagagctgaagaagatgcagtgttaaagatgttgcccattgtatcacaagaatggtccccttgcagtgcgctgccgatttgttcttcctactagaaatataacgcgttttaattactagttgcagggagacctgtcttgctcaactcgttcatggaccagaagcaataatatatccgtgtgtagctggattggcgttatgtcatgtcccctaccgtgactaccagaatctacttggtgattttatcccagtgctgctcaataagtttatgcgatt

SEQ ID NO: 56992 - DNA, 164 bp, Zea mays
  Clone ID: LIB3069-011-Q1-K1-F9
tctaataattctaatgagaaggctatgaatgaacagccgaagagactgtcccacgtttcgcgtctgtatcacggaacgacatctgacgcggcggtttcgaaaatgtataaatcgagaaggtatgtacgggcggcgcccactgagaccataatcgtcattaacgt

SEQ ID NO: 56993 - DNA, 453 bp, Zea mays
  Clone ID: LIB3069-011-Q1-K1-G10
ggacctttgggctggtttatgtgcttgttctgagtatggtactgagttccacggtatcacgtttagcgacattatggccggtgctgtagacgaggttcctaatatgcctcctagtgagattggcctcggtaagtacgcgttgagggttactcctgctgattccgagtttatcgctaccgacgaggcctgtatcggtctgcattgttaatctccttatttagagtagtctactctgggtaaggaagatgtagtcaataatcccgtttgcggttatcatatcgccgggaaggagaccgctgactcacgttcggattgcgcgtgtaagtccgtagataatcgtatcgggtcgtagggacctccggcgcctaacgtcgccggcggcgggatcggtctcggatccgggctatccccaccggagtgttccctagccgaccacggtaagaaacttaagtc

SEQ ID NO: 56994 - DNA, 167 bp, Zea mays
  Clone ID: LIB3069-011-Q1-K1-G11
gagggatactccagatgattccgagtttatcgctatcgacgaggcctgtatcgctctgcattgttaatctccttatttatactagtctactccggattacgaagatgtattcaataatcccgattgtggttgtcatatcgccgtcaatgagaccgttgactcacgtt

SEQ ID NO: 56995 - DNA, 457 bp, Zea mays
  Clone ID: LIB3069-011-Q1-K1-G12
gacctttgggctagattcagtgcatgagaagataaccatctacacaaatcacacacgatataaagagaagataaccatctacgcctagcaagccgtcccgactacagataagggcagacatacgctgtaccgaggtagttacgggaactataaggcgcaaatctctatgacctaaggtattcgattataaatcgaagacaaccactacgtggcgcctagacacggcgcaaatctctatgacgtaacccgatctcccgcatatcgtaaacacataaccactacgtgcgcctagacacggagtagcccgcgtatcgtcttatactatactcataatcgctcagaagaaaaaaaaagcgtctaatcaacaagtggcctccttaaacagaaagacaatcgtccaacccatcagatatacgctgacttttgctcgaattagtttttaagctcccagtcccgc

SEQ ID NO: 56996 - DNA, 409 bp, Zea mays
  Clone ID: LIB3069-011-Q1-K1-G2
tcgcccacgcgtgcgtctgtctgtcgctctcgctcttagacgactgggccgccgacgcttggtgctgaggctttcgttggtctcttcggcggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactggtgtcatggtagggatgggacagaaggatgcatatgttggcgatgaggcacagtccacgagaggtattctcacgctcaagtacccgattgagcacggtattgtgagcaactgggatgacatggagaaaatctggcatcatactttctacaacgagct

SEQ ID NO: 56997 - DNA, 416 bp, Zea mays
  Clone ID: LIB3069-011-Q1-K1-G3
cggacgcgtgcgcggacgcgtggggcacggtggactactatcgcgatctaccacacttggaggagatgctgaacttgcaacgttccaccgatgtaccagatcaaggtctactgtgtgacttactttggtcagatccacgaaaagatgttcaagggtgacgcatgaatgatagaggggtctgatatacctttggtgcccactaggcttcagacttcctgcaaaagcatgatcttgatcttatttgacgcgctcatcatgttgtcgaggatgcgtatgaatgctttgctgacagacagcttgtcaccatattctgggatcccaactattgaggtgaatttgataatgctggctcaatgatgagtgttgaccaaactttgatgcgtgccttacacattctgcaacctgcttagagaaaa

SEQ ID NO: 56998 - DNA, 293 bp, Zea mays
  Clone ID: LIB3069-011-Q1-K1-G4
cagacgtgcaatacagtgacctgaccaccatgcgtatccaccacaactactccacatgatggagaacctaagatcctgcagaggagaggaagaggagcatgaagaggagatggtcggcaccgttggcaagaggccagtagcgctagcaacggactgatcggagggtagccgagcggtcctgtatacctctgctgccaacctgctacgagacatcgaccaccagctgctgctgcacgtcatcaatgagcccgactacgagcagaacgaggccattctatgggaatccaccggat

SEQ ID NO: 56999 - DNA, 366 bp, Zea mays
  unsure at all n locations
  Clone ID: LIB3069-011-Q1-K1-G5
cccacgcgtccgcggacgcgtgggcaaattgtcccatcccgtgctccttcccgatcgcatcgggtgctcctncccgatcccatgcctccgctccagatccgcacgccgncaccggatccgcagccagcgcggccggcatggaagagacgccgccggggcagcgcccgcagccgccgccggcgcacgcgtctnnctcgttcgcctcggcgcccttcacaccgncgncgcgcgtcttctctccaggcctcgccgccgcgcggggcacgcccagccccggctcggggcccggccacgcgctgccgcacctcagcacgccacccggcccggccgtcttctcctcgccgctgcgccctgcggccgtgccct

SEQ ID NO: 57000 - DNA, 391 bp, Zea mays
  Clone ID: LIB3069-011-Q1-K1-G6
cccacgcgtccgcggacgcgtgggctggtctgcccggacgctcggatcgccgactagttcgacgtgattgccgggacgagcaccggcgccctgctcgcgtcgatgctggcggcgccggacgagaacaaccggccgctgttcgccgacaaggacctcaccacgttctacctcgagaacggcccaaagatcttcccacagaaaaaggctgggttgctgacgccgctgaggaacctgctgggcctggtgcggggccccaagtacgacggcgtgttcctgcacgacaagatcaagagcctgacgcacgacgtcagggtggcggacacggtgaccaacgtcatcgtgcctgcgttcgacgtcaagtacctgcagcccatcatcttctcgacgtacg

SEQ ID NO: 57001 - DNA, 469 bp, Zea mays
  Clone ID: LIB3069-011-Q1-K1-G8
cgacgcgtgcgccttgctcgctcgctcgtcgtctgccgtcgttctaggtttagaggcaggtgaccagcgctaggagggcgcgaagtcgagtagacggtcgggcctctcccgttctccacggacggctagcgctactggaggcgacgcctggacggcgaccccgcacactcacagccacaccctccacctgtgtgactattcaagggcttaggccgagccgcccggccaatcgccgtccgccggaccgctgaggaatttttctttctcgtcaaaagttactgcattcattttacagtaatggctatggggttgattaatgctaatcctataatccatgagaaaaaagagaggcgtgccagacaggcaccagagaccacagatgaaaatgcagcagagcccatagatcagctggaaatatttgatcacattagagatataaaggatccagagcacccgtactcacttggac

SEQ ID NO: 57002 - DNA, 449 bp, Zea mays
  Clone ID: LIB3069-011-Q1-K1-G9
gacctttgggctggtttcagtgcttgtgtcggtgtcgctactttagaggttcgtaccaagcctggtgtcaatcgcggtttcgaggtcgctcggcctaagattggtgtgtcgtcttcggatggtaatatttctaatcatcctggtaatagtacttttactaattcggcggcggttgcgactgtggaggctacttctgctggtggtgttgagcatcattggactattaatggatcggattccgaggataagtcgtattttggcgggtttcctgatttttcgggttcggttagtgattttgattaggttgctacttctaaggcgaaggagactaagaatggttggtcggttacgcctcttacgcctgttcctcctacttaggttcatgctattggtgaaggttttgcggagaattctgttaagtattctagtgattttcctggtaataattc

SEQ ID NO: 57003 - DNA, 271 bp, Zea mays
  Clone ID: LIB3069-011-Q1-K1-F3
gacaaacgtagatttcgatgaggaccattttgtgatttcagaagatggatcatatacaggggaggagattcatacattacgaggataccatgggaggcatgagccagtggtgccatatgttgaggcaattattgaggatgatgctgatgctgatgctgaaggggatgccagttcatcagggtctactatggacactgaaagtgcattagatgttcatgaagatgcaatcgagttcgaatcagccgacggccatgaatgctatcttgagaat

SEQ ID NO: 57004 - DNA, 430 bp, Zea mays
  Clone ID: LIB3069-011-Q1-K1-D8
gaaggcacttctgatgtctacatcataaattacctgaaatttaaggtcttggtccatgaatgggaaagaggcgaagtaaaggtagttgggactgcggaaggaatggaagtgatctcagagactgacaaagatgccaattctggatatgagattgtgggatttgaaattgttccatgcagcgtgaagcgtgatcctgaatccatattgaagcttaatatgtatgataaagtcgatcctgtgaactgccctgtggagttggaaaaatctcaattggttagggagaaagagaagattcactttacttatgaggttgaatttgtaacagtgatatcaggtggacattacggtgggatgcatacctgaagatggagggttcgaagattaactggttttcaataatgaactctttgatggtaattctatttttggt

SEQ ID NO: 57005 - DNA, 203 bp, Zea mays
  Clone ID: LIB3069-011-Q1-K1-D9
ctttggctgatttatgtgcttgaaaaaaaacaaaaaaaaaaacaaaaaaaacccaaccaaaaaaaaaaaaaaaaaaataaaaaagacaggcgcctataaggacatgagtatggttaagtaatactactactctttatacaccttgatgcaaatctaaccaaattgttgatgattatcaatcctctaatcgacaaaatattcat

SEQ ID NO: 57006 - DNA, 334 bp, Zea mays
  Clone ID: LIB3069-011-Q1-K1-E1
cccacgcgtccgggggcagggtgacagtcgcatgtttgaagaacttacaactcgttgctgggacgcagcccgctgctggagcaccaaccccatcacaggctaccccagtgccgcccgagcacgagaaggtgatcctgcaatttgcgaaggtggcttaagacatgttcaccatggactaccggtacccactgggagacttgcatgccttcgcgatctgcctgagcagcttcgacaccaagctggactgcgagagaaaccaccagacatggctcaaagtcaaggactatctgtctgctagacgaacaccgagggcccaaattacgctgagccacca

SEQ ID NO: 57007 - DNA, 498 bp, Zea mays
  Clone ID: LIB3069-011-Q1-K1-E10
ggttggacctttgggctgatttagtgcttgtagagtcgttgagagcgcgtcgcgtcccgtctactcattgattgactgactctggtacggtggatcgggggttggcgtcgactgggtcggcgtctcctacttcgtctcttttgggttcgtctccttagacttttggtaagggttggactactgagcctggtaatccttagattagtggttctcttacttctacttatgttgctactcatcctgtttcttctgttactccttcttctgttgctggtgcttatacccattctggtcagtctgctgttggtgggtcgagtgaggtcagttgtcgtcggtatgtggtggtttggtttggttcggtcgcacccgatactaactcgggcggtcggaccaggcatcgtgcggcgtggaggtacacatcatcacacatacccatacgcctactctgactcgtccgtcagtcgtacgccgacccacccagtcatcatcccactaatg

SEQ ID NO: 57008 - DNA, 443 bp, Zea mays
  Clone ID: LIB3069-011-Q1-K1-E11
gctctggacctttgggctgatttatgtgcttgcggtctcctaaaggagcgacgcccttacagcactgcggtcacgtctttaggccgacccgtgggtaccacgcgtaacggctttagcattctccaattagggggcttcttcggttccaccgtagtagtcagtatccgatacctataacgagatactatgaaaggcctaacggacgatagacgccgttacggtaactaatttagtagattagacgactgtggcctacgcgtggttcactcccgagtaagctcataattaatcggtttattagtggatatctttcattacgattgtagtagacggtattagtacttgcgcgactacgtacgcaaccaatctagcctcgtccagtcataagcgaccgcagtcatgtaatcgcgggaagcacggttcacctcactccgcacagagaa

SEQ ID NO: 57009 - DNA, 432 bp, Zea mays
  unsure at all n locations
  Clone ID: LIB3069-011-Q1-K1-E12
tttgggctggtttatgtgcttgtttatgtgcttgtttatgtgcttgtttatgtgcttgctctctcacctgccttttgttctattgtgagttagttgctctgtcagggccctgttgttgttgttgttgctgttgttgtcacgttctgttgtagtctaggaaggctcgttttatgtttagtcttttgcgtcgtcttagcgaggaatttgttatagttagtatgttaggtcttcttcttagtcttcgcctgagacggcggcggtcttacgcccggaggaaccgggcttattaccggtctaggcacggtgcccggtatgggcagcgttacggtattatagggtcgcgacgtcgcaccaggcttttggattacctagtacgagatcgccgttctagaagtcgtcgtcgtcgttttcgttttcntagcgacgaacgtc

SEQ ID NO: 57010 - DNA, 187 bp, Zea mays
  Clone ID: LIB3069-011-Q1-K1-E2
gtcatgctttccaaccacgcctactgaacgcatttcgtgaataggcggcgatgctcagatgggtggataggccttttaaccgtgagcgacggtgtccgctgtttatgtgaggtgcttgtttcgagtttatcgtctgtcaaaacatggactgtatttgactatctgttagcatgtcttttgagatctt

SEQ ID NO: 57011 - DNA, 67 bp, Zea mays
  Clone ID: LIB3069-011-Q1-K1-E3
aacaagcattccaaacatgcatacaaaaactttttttaaaaataataaagggctcctcgatatggat

SEQ ID NO: 57012 - DNA, 228 bp, Zea mays
  unsure at all n locations
  Clone ID: LIB3069-011-Q1-K1-E4
ggatcgtcaacggcgcccggccccagcggttgtttcgtgcgcggtctgagggtagctggaggcagcgaccgctgctccactaangcggtcgcgccgctntaagagcgcttatgccccaaagcgaagcgttacccgtcctcaatcgtgtgcttagtgccgctttttggaaccctgtttgatttttaatggagatacacttatttgaaatataattgatccccagatata

SEQ ID NO: 57013 - DNA, 427 bp, Zea mays
  Clone ID: LIB3069-011-Q1-K1-E6
ttcgaatgttctgtattattccatggcaattgttgaacatatacaacagcagtacagcacagctttggcgctcaatttacatgtcaagcaagcaccaagaggctagtcataataagcttacaaggcagatacaaagctgcatacacaagtgctaagcagcaatactttattaacattccagtgaaggttacattcacaaatcgagttgcacagaacatggaactgcattctgaacgagatacaaccttacttcagaatggtcctacttcgcacggcaatgagccaaccttcatgcctttcttctgagcgattgccttcaattcctccgacatagcgctctcctcgatgatcacatgattcaacctagcggcgcgctgggcaaagagctcaacattacctacagcaatgcccggacagcgggagatgt

SEQ ID NO: 57014 - DNA, 262 bp, Zea mays
  Clone ID: LIB3069-011-Q1-K1-E8
cccacgcgttcgcgcgtgcgaaccatgcttaccccagcagaagaagcgaagtcgtcgccggagcacgaggaagagcgagcagcgagatgtcgtggcaggcgtacgtcgatgaccacctgctgtgcgacatctaatgccagcacctcatcgccgccgtcatcgtcagccacgacggcagcgtctgggcacagatcgagaacgttcgcgagttaaagcctgatgaggttgctgggatgataaaggactttgatgaacctggaac

SEQ ID NO: 57015 - DNA, 468 bp, Zea mays
  Clone ID: LIB3069-011-Q1-K1-E9
gacctttgggctggtttatgtgcttggcatcttctcttcttttctcgtcgtagctcctcgcttgtcgtagactacggaggaggaagggcggtatgagcgctcgtacgggcttcgagagctgtgcgagtagtgaagtagcctatggacggccggacggagggtaacgattagtcgtcgagtcgtcgtcgtcttcatcggctgattactagcccgcacccgcttacgttctgagcagttggttgctcctccgtttcggtccgcttagccttggaaggtggctaagtttggcgaggtgcggatagagattggtaagctagagactggtaacagcgagtcttagtaggagttcatccgcatcttccactcatttgccccaaggcctttcctcctgcgtcgacttctgctccttcctgacctactccgatcgactttcatcgttttagaatcgcattggcgagagtagaagac

SEQ ID NO: 57016 - DNA, 349 bp, Zea mays
  Clone ID: LIB3069-011-Q1-K1-F1
cccacgcgtccgccctcttgcttcttcttcttcttgttcacacaagcgtgctccttctgcgcgtgtgctaagtagctagctcacaacagaagaggacgagaggaagcaaggcggcggaagcggctgcagcaacaacatacaccgctggccgtggcgacatgggcatcctggaccacatgtctcatgtgtgcagcatcacagagacgaaggacgcgctcaagctcaagaagaagcgaccgctgcaagtcatgcttgactgtaatcattatatatttaattgcctcccatgcatatgcatgcatgcctgatgagtgtagatgcatgggcagtggttgcagacagtgaacat

SEQ ID NO: 57017 - DNA, 482 bp, Zea mays
  unsure at all n locations
  Clone ID: LIB3069-011-Q1-K1-F10
ggacctttgggctgatttatgtgcttggtaaaactcgtatgagagatagatgatgagcacggctgagtggaggatgttgttgttgtgtgttgatgggttgttacaattgatcattgtaagaagtcgtctaatcgtagggagtctgagctgtgtgctggtattgcgagagaaagttccaaaaacgtaaagagggaccccattaagatcgaagatgatccgaaactctcgtagagtgcggggtaaacaaccggagaggcctcttgattctccgacaacgaatgtcccaccgcgaaggttagtagcggcttttgacacgcggctggccgttgaagcaaagcagataaggagaagccgatactcggaatctgcgccgcatccgatacgatgattccgataacaacgtgtatctccntatgggaggcggacttagcggcacacaatacgtactacgaagacttaggaaacgctagccatctcgtcgc

SEQ ID NO: 57018 - DNA, 374 bp, Zea mays
  Clone ID: LIB3069-011-Q1-K1-F11
cacggcccggcacctctgggctgatttagtgcttggttatgtacttggggtaagaaagaaggtcccctacacggagtgggaaatggagtgccaggtggtatgcctcgtcggcagggacctccactgcgacttccacaggggttaactgcgcggtttactcctcgaggttcgcctactgagtctgagactaagactgagactatgactctacctattacgttacgtcaggtgcacgacttcgggactaacgtccgaagtaagtaccggggtatgtagaacgtcctcacggtcgaacacacaatcgaacacggcgttattgacgtcattagcgaattgactctcctagggactctcttgatcctgatcgttacatt

SEQ ID NO: 57019 - DNA, 380 bp, Zea mays
  Clone ID: LIB3069-011-Q1-K1-D7
gcaccaagtcttacacctgaacatcaacttctacggcagcatttgccttgacattcgtagggaacagtcgcttccttgtttaactatgtcaaaggttctgctgtcattctggtgactgttcacggactcatactctgatgatcctcttgtgcctgagactgctcacatgtacaagaccgacaaggccaagtatgagtgcaccgtaagctgctggacacagaaatatgccacgggctgcaagcaaggctaaaagctggccaaactggttaatgtgacctaccccaaatcgatatcatctaaataaccagtcaagtctcaagtatgaatggacttttgaggaccattgtgctctgtttaactcatgtattaccttgcgaagt

SEQ ID NO: 57020 - DNA, 336 bp, Zea mays
  Clone ID: LIB3069-011-Q1-K1-F2
cggacgcgtgcggggcgagcccgttcgtgctccgggcgcgcatcgcgctcagcctcaaaggcctgagctacgcttactccgaggagaacctcgacgacaagagcgagcttgtcctcagctccaaccccgtgctcaagaaggtgcccgtgctcatccaccacggcaagcccgtctgcgagtcccagatcatcgtgcagtacgtcgacgaggctttccccgccgtcgcacctaatttccttccatccgacccctacgaccgcgccattgctcgcttctgggccttctacgtcgacgacaagttctacagcgcgtggatacccgtgttcaggggcagga

SEQ ID NO: 57021 - DNA, 140 bp, Zea mays
  Clone ID: LIB3069-034-Q1-K1-A9
ggctctttccagaaatattgaagggaaaagtttgagccagcaactggagttcgtgtttaagccagaactagttagcagcctaccatggcgaaagtaacatactcgaaccaatcttggaaagatcctgtcattcttgtgcc

SEQ ID NO: 57022 - DNA, 392 bp, Zea mays
  Clone ID: LIB3069-034-Q1-K1-B1
ggtttgcatgacgcagggcccgacgttcggcgccatgatgatctccggccagaaggcggcgcacctggcgctgaaggcactgggcaggcccaacgccgtggacgggaccatcccagaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgctgttggacgaatgaattcccttcgatcggttagctttaatctgtctcggtagtgtgtcgtgttcgtgtagcaccatgccacacaccagccgtgtgctctgtcacgtgggggccactcgt

SEQ ID NO: 57023 - DNA, 322 bp, Zea mays
  Clone ID: LIB3069-034-Q1-K1-B10
ccgctgggagcggcagccagcacgaggcaggagcagcgcgagggcaggcgccatgggggtccggtcggcggccacaaagctgcacatcccaccatccgccgcccgccgacccacgttcctgccattcgtggccgtcctcctcctctgctctgcctcctatctcatcggcgtctggcagcacggcggcttcgccactccatccgacaaacccgccgtcgtctccaccgctactgccgtcgcctgcaccaacgtcgccgtcgtcccgaagaggaggacccggttcggcgccagctcctcgtccctcgacttctccgcgcgccac

SEQ ID NO: 57024 - DNA, 344 bp, Zea mays
  Clone ID: LIB3069-034-Q1-K1-B11
attagatatagggaaacagtcatgattgttcatctactaaattgtaaacatatcattataccattcgttaatagtgttctatgatgaagctgcactgttctggatttcatgattggttttgtggctttgatattaatttcttctgattgcctcttttcactataatatattggagaagaaatgttctggatggtggacaaaaaggattattggccaatagaatttttgggcttttcggttgaagatccaattggacatttgggtttcaccccagaaatttaatcctggtttatacttaaccacttgggcattttcactttggttattcattcgatgtaacatgc

SEQ ID NO: 57025 - DNA, 284 bp, Zea mays
  Clone ID: LIB3069-034-Q1-K1-B12
cccacgcgtccgcccacgcgtccgcccacgcgtccgcccacgcgtccgcccacgcgtccgctctccggcccggtgagggatctcagtaagctgcctaagtgtaactacgatgattgcaacactggctatgacctcggcgagtacagatagtttatcttgtacatacaggccatctttaatgacccatttaggatgttcaacaacatgcttgagatgtgcgattgctacacgcgatccaacgagcctgaccacagtaacaatatgtacaacgccgttaaaatcta

SEQ ID NO: 57026 - DNA, 436 bp, Zea mays
  Clone ID: LIB3069-034-Q1-K1-B2
gcgaaatcgggaacgcgcaccaactgttcgtcgttgtgttcgacaccgacaggctcaagggctccacgctcgtcaccaatggcgtgataacggccgggtctgacgagtgggcgatctacggcggtaccggggtgtttgccatggcgaggggcgtcataaggagaaggtatctcgccgacagggccggcgggaacactgatgagctcaacatggatgtcttctgccggccgtttggctcacagtcacagctgcaagataagatgcaggtgcaggggcaggggcagggctctagcgtcaccaagattggactatggggtggaccgggagggtcggcacaggacatcacgggagagcggccaccgcagcgtcttcacagcgtcaccgttcgtgctggcgttgccggcgacttcatcgagttcacctatactgacagcgc

SEQ ID NO: 57027 - DNA, 359 bp, Zea mays
  Clone ID: LIB3069-034-Q1-K1-B3
gagctcgggaagcttccatcgctggagatttcgcttaacctcagctgtaaccgtctctccggggaaattccagcgcagttcggcgagctggataagcttggcagcctcgacatctcgtacaaccagctctctggcagccttgcgcccctcgcgaggctcgagaacctcgtcatgctcaacatctcgtacaacacgttctctggtgacctcccagacacgcccttcttccagaagcttccgctcagcgacatcgcgggcaaccacctgctcgtcgtgggcgccggcggcgacgaagcctcccggcacgcggccgtttcggcgctgaagctggccatgacgatccttgtcgtggtgagcgc

SEQ ID NO: 57028 - DNA, 384 bp, Zea mays
  Clone ID: LIB3069-034-Q1-K1-B5
cccacgcgtccgagaggcttcaccgcatgctggagaagtcaatcagtccttccaaagctgatgaattcatcgttaagaagaacattctttcgatattctcttcgtgaaggtgatgatccacagccacggcctgccagtgacttgaactgatagcgaaccaccactttacggaaaacagaacaaatcggatgatgtgagagaaaggtggtagtgaagtccagtagtggcagagctacttcgtgcacgtagatctcttttgcattttctggttccagggattgacttcgtactcacagtttacttcacacagaaggtttatgtagccatcctgtgataacatctactttctttttgatccaataaattggttattcagcttccgtg

SEQ ID NO: 57029 - DNA, 212 bp, Zea mays
  Clone ID: LIB3069-034-Q1-K1-B6
ggactcaatacccaggacatcatccagcaagagccgacgcataccggcctgctgatcaaccttccaagggttcccaacctgtgaaaatgcaaccgattgcagtccctgccattccttgggatgagcttaaggaggtgactaaaggttttggtgatgaaaccttgattggtgaaggctcctttggtagagtatacttaggtgttctaagaaat

SEQ ID NO: 57030 - DNA, 295 bp, Zea mays
  Clone ID: LIB3069-034-Q1-K1-B7
tccacgcgttcgaccacgcgtccgtccacgcgtccgaaaaaaaaaaaaaaaaagagaaaggaaataaaaaaaaaaaaaaaaaaaaaaaaaaaaaaaaaaaaaaaaaaaaatatagaaaaaaaaaaaaaaattaaaaaaataaaaaaaaaaaataaggttaaaaaaaaaaaaaaaaataaaggggggggtctttaaagagatccaggttttttaaaatggttttcctatttcaaaaattttttattggggaccataatgcaaaataacgtgctcgtttttaaaaacagtgggtatt

SEQ ID NO: 57031 - DNA, 419 bp, Zea mays
  Clone ID: LIB3069-034-Q1-K1-B8
cgttcttggagaatcaaccaaacagatattgcaatgaacctcgtacccgaaatgaggcagcagaagatgatagtggctgggaaactgtaagccaagttgaggagaatgggtcttgtaattcaccgggcggaagtgaaccgtctgtaaatggcttctgtggagaaaacgatgcttccgtaagtggaaccgactgggatgaaaactgtgacaatgatcaggcacacagtgagatcagtgaagtttgttcaacagcagcaggcaggtctcggaacaaaagatcattcgccggactatggagatcatcaaacaccgtggaccaaaagaagatgggatccaatacactcaacggtaggtcatcaaatgccaggatgtcaaatgccaccgaatctgctgacctgaagaatagcgaagtgtgtgac

SEQ ID NO: 57032 - DNA, 449 bp, Zea mays
  unsure at all n locations
  Clone ID: LIB3069-034-Q1-K1-B9
cggacgcgtgggctgctgctggccgccgaggtgggcttcgtcggcgccgtcgccgcgctggtgctcagcctggcgcacacgcacgagcgcaggtccatggtggtcggcatcctctgcgtcctcttcggcaccggcatgtacgccgccccgctctccgtcatgaaaatggtgatccagacaaagagcgtggagtacatgcccctgttcctgtcgctggcttccctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggngtggtcgtcgacggcggcaagaccaacaaccaagccggcgc

SEQ ID NO: 57033 - DNA, 398 bp, Zea mays
  Clone ID: LIB3069-034-Q1-K1-C1
agccttcgggctttacacttcttggcatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgcttggccatgctgggcgcgttgggctgcgt

SEQ ID NO: 57034 - DNA, 423 bp, Zea mays
  Clone ID: LIB3069-034-Q1-K1-C10
cccacgcgtccgcggacgcgtgggcggacgcgtggggcgccggcgcctccatggggttgggctcactgtctcctgcagctcatggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagcttgagaagaaattcagcggcaaggatgtggtaattgttgctacaccgaagattgtgaggccaccc

SEQ ID NO: 57035 - DNA, 445 bp, Zea mays
  Clone ID: LIB3069-034-Q1-K1-C11
cggacgcgtgggataagtttgatagtggtgatggcacttcatgcaagcgttgtagttgtaagaagtccaaatgcctgaaactttactgtgagtgttttgctgctggagtctattgttctgagccttgttcgtgtatcggctgtatgaacaaccagagtcatacggaaactgttctatctacgcggcaacagattgaatctcgcaatccattagcatttgctcctaaagtaattcatacatctgagcctggtctggaactaagggacttctccaataaaactcctgcttcagctcgtcacaaaaggggatgcaattgcaagaagtcgtcatgtctaaaaaaatactgtgaatgttttcagggtggtgtgggatgctccataagttgcagatgcgagggctgtaagaatgcttttggaaaacgggaaggggctgccgtgttaagcat

SEQ ID NO: 57036 - DNA, 415 bp, Zea mays
  Clone ID: LIB3069-034-Q1-K1-C12
cccacgcgtccgtgccttcagatgagctccgtaaacggtttgagcaagaaggaatatcacttgatcagcctcttgttacctcttgtggcactggtgtgacagcatgtgtattagccttgggccttcatcgacttggcaaaaccgatgtcgcaatttatgacggatcgtggaccgaatggggcgcccatcctgacactccagttgcaactgctgtttagtctcttcataataggacgcccgtgctcttcatagaggacctcttgattgtatttgccccgtgctgtgattctatggaggttggttggatgcttggatgtaaggctggggaagcgaagccttttggccttcactgtaaaagctgcaacagaaaaactgtcacatgcactgaattataagataactccccttgatctct

SEQ ID NO: 57037 - DNA, 381 bp, Zea mays
  unsure at all n locations
  Clone ID: LIB3069-034-Q1-K1-C2
catgaatcagcttgatagcagtaacaaatttgcttgacttctgacgagtaagaaattggcagcaagttcagcaggggccagactaataaatcagcttgatagcatccttgcagcggtgccttggactttggcggttagaagaagtttataattttatatgatgaaattatgtgcatcttcagttgtttttgcctcactgctctgtaaggacatataaaattggtatttgtactttctaaggttctccttggaatggtagagttttacagggaaccttccatcatcagttgctgacatagctcgaactcgacgtttcttcttcgccagttgcggctctggataaactcgaagctgacctatncaaggtcgacgacgggccct

SEQ ID NO: 57038 - DNA, 441 bp, Zea mays
  Clone ID: LIB3069-034-Q1-K1-A8
cccacgcgtccgcaagaacaactccaactcccatctctcactacggcaacactttgcgagctgagccatcaaagctcggggcggatggcggggcggcggcagatcaagaaggagtgggtgcaggcggcggcggacgcggcgtcgtggtgcgtggcgctgtcgctggtggcgatgctggtggtgctgtgcacgctgggcgccggggaaggcggcggcggcgcgccggtggtggtggtgcgcggcgcggcgctggcggcgcggccgtgcgaggagatctacgtggtggctgaaggcgagacgctgcacagcatcagcgacaagtgcggcgaccctctcatcctggagcggaacccgcacgtgcacgacccggacgacgtcttccccggactcgtcatccggatcacaccgttcaagcccaggtagatcgatggcgatccatcg

SEQ ID NO: 57039 - DNA, 440 bp, Zea mays
  Clone ID: LIB3069-033-Q1-K1-H3
cggacgcgtgggcggacgcgtggggaaccgcagaagtgcagcagaacgatcggatctagcagaattctctcaacctcatcggcggcggcgaagagcgtgcggatcggagatggcgacaagcgggtggaggaggagagcggcggcgcgggcctcctggagccacaccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgc

SEQ ID NO: 57040 - DNA, 443 bp, Zea mays
  unsure at all n locations
  Clone ID: LIB3069-033-Q1-K1-H4
cccacgcgtccgcccacgcgtccgcccacgcgtccgcccacgcgtccgcccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccaaggccgcacgctctacggcttcggcggctaagccgnctncccttctgatgctttgatgtg

SEQ ID NO: 57041 - DNA, 450 bp, Zea mays
  unsure at all n locations
  Clone ID: LIB3069-033-Q1-K1-H6
gactagttctagatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctctttcaccctgagcagctcatcag

SEQ ID NO: 57042 - DNA, 437 bp, Zea mays
  Clone ID: LIB3069-033-Q1-K1-H7
cggacgcgtgggtctctttgtcctttggtgcatgtgcaggcaaatgtcatggttgaacaaccccaatgatcagctatgagaagaaatgacacgtatctttcacacgcacataggagccatacgaagaacgtactaatgaaaagatcgatgaattatattgatatgatatgacgtgagtgttttgaaatgtttggtaggttctgtttatatggatttttgtatgtaagactgcattgttcttttgtatgaggcttcatatgacgaggcgatgtctagtcagcacggaccagactatgactggaggacctcacctattgatcctcaagctatgtatgtaagtggtggaaaagctcatagaaagtacacaatgtttgctaacgtcatcaactcgagccaggtgagggttcggcgtggaggttcgtcaaggtctgctactc

SEQ ID NO: 57043 - DNA, 453 bp, Zea mays
  unsure at all n locations
  Clone ID: LIB3069-033-Q1-K1-H8
ctccggcctcttccacggccgcctccgccgccgccgccgaccaccatagcaacagatatttcggagctcgcgccttacgcgcatggtttgctcgacgtgcaccgtaactaatcgactataagcgtggtgcctattgacgagatgatgccggtggaggaggcggcggcggatgactggtcggagtgcgcgttctcgctgacctgcgaggaagactgcgccgacctcggcgacggcgagctattcccgctctacagtgccggcgacgaggaggaagatgagtacttggagcagctggtgttcaaggagaccagcttctgctcctnctccgactcagctgccgactgcgacggcgatgaagaaggagacgaagaatactcttcgctcaccttaaaggagtggttccgtcaagctcgcctcgccgncgtcaagtggattcttgagacccgcgggtgc

SEQ ID NO: 57044 - DNA, 439 bp, Zea mays
  Clone ID: LIB3069-033-Q1-K1-H9
gccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtacaaccaggacaagatgatctgccgcaaatgctatgcacgactgcaccctagggctgtcaactgccgcaagaagaagtgtggtcacagcaaccagctgaaggccaagaagaagatcaagaact

SEQ ID NO: 57045 - DNA, 341 bp, Zea mays
  Clone ID: LIB3069-034-Q1-K1-A10
ccacgccacccgtctgtccacacatacattgacgcgtgggtatctgccactcgccgagtagatggggaacgggccagaccgtttaagctgtccctgctctgtaccattctactacgcctgcttttctgagactctgacacggatgttggcaagaccaccagcaccgtctttggtgactgctcaaactcctgaagtcggcatcttcattacagctcgcaacgtctcgggtgcacttgtcgccaaactttctggtaacaaaaacaagtgtggaggaagatcgaatgttcggcaacggaacattcaacctgtgaaaaggggctgtcgtccggagtggcgggcgc

SEQ ID NO: 57046 - DNA, 342 bp, Zea mays
  unsure at all n locations
  Clone ID: LIB3069-034-Q1-K1-A11
cggacgcgtgggcggacgcgtgggcccggcctgtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggcgatgacgctctcccccgccaccgnccgcattcccggcgtgtatgtcggcggcggcggcggcggctggcagagcgcgcacgccacgttctacggcggcagcgacgcttcgggcaccatgggcggcgcctgcgggta

SEQ ID NO: 57047 - DNA, 129 bp, Zea mays
  Clone ID: LIB3069-034-Q1-K1-A12
acgctgacgcgagtactgacacgtacaccggctttgatcccgcggccaaccgctggcgcacgcttctgcctagctgtgaccgcaacaccgacactgacagagaccggacagatttctgggcccataggc

SEQ ID NO: 57048 - DNA, 292 bp, Zea mays
  Clone ID: LIB3069-034-Q1-K1-A2
cccacgcgtccgcccacgcgtccgcccacgcgtccgcccacgcgtccgagatacggttgataaaataaaacccacttcgatgaaaaaggaatgatccgagtacagtacagagttcctacactccgggtatgaaaactctcctcatgacaagtacagtgttcaccgaagagcgaagtacccctctcactcaatcataactgactttcttacagactactggaacttaacacaaacacacagatagggacacttatcaccacagatcgatcgatcgccaccaaactttattcta

SEQ ID NO: 57049 - DNA, 331 bp, Zea mays
  Clone ID: LIB3069-034-Q1-K1-A3
tcgcacggcctcaaggacggctggtacgacggcgtcagcatcttcctcgccgtcttcctcgtcgccgccgtgtccgcggtcagcaaccacggccaggccaggcgcttcgacaggctcgccaccgagtccgacaacatcgccgtcgccgtcgtccggggcggcaggaggcaggagctctccatcttcgaagtcgtcgtgggcgacgtcgtggtgctcaacatcggcgacgccgtgcccgcggacggcgtcttcatgcagggccacgcgctgcaggtggacgagtccagcatgaccggcgagccgcaccctgtcgacatcgacgccgagaaga

SEQ ID NO: 57050 - DNA, 382 bp, Zea mays
  unsure at all n locations
  Clone ID: LIB3069-034-Q1-K1-A4
gttgtttatttacctatcaacttatttaagctggattatataatctagaaggtaagcaaacatggccttggagtgcagaatttcccagcatcatcatgcaaatgattttatcttacatattgatactagtagtaaatatttttggagtcgactattctgtcgctaattctggtacttcacaactaaaccatatatatctctgtcttggatttcagaaaagtccacaagtatggaaagagcacaaccggcgagaggtgggacttggtagtcgacgaggagacatactacgaggcggagccccattacggatgggccgatgtcgtcggagactcgacgcagctgctgtccatacagccccgtgagaggccaccncgcgtgttcc

SEQ ID NO: 57051 - DNA, 282 bp, Zea mays
  Clone ID: LIB3069-034-Q1-K1-A5
aaacaagatgtgctttgcatacacatctctagttatccatattagattgaatgcggaccatgtgtgctgaaaaatctagcttgcacggagcggtgatcataaacgatatcgtgcatccctacctcgacatcgtccttgtcatggaactagacattggcatgctgacacatatcaatatgcactgcacacatgactgtgttgatcctgattgggaccaaaaacatgtgcccgttcaaccaggaagtatctattatgcaggcactgcaagtgacccatccaacc

SEQ ID NO: 57052 - DNA, 434 bp, Zea mays
  unsure at all n locations
  Clone ID: LIB3069-034-Q1-K1-A6
ggtcgcgctccctcccgcacaacacggtttgcggggagatttggcaggagacgccgtgcgggaccggctggttctctcggcttgcgtgaaaaagcgcagggggagctaggcacgtggtttccctcgtcttctgccgcagacgcttcccgtgatcagaatccaagaaatggcgggtccaggtccagcgcgcaccgcgcggagcgttgctctcctgtgtttcctggtttcctgcgctgcgctcgtggacagccgtggcggagccagccggccgagccggcaggacctcgatgtcggcctcggcggcgggggcgtcggcatcggcatcggcatcggcggcggcagcccttcgtcgccttctccgacgccgncgtcgtcgcagccgcagccgtgcgacttcgagaacgagcggctgtacagggcgtacctcgtgatcc

SEQ ID NO: 57053 - DNA, 380 bp, Zea mays
  Clone ID: LIB3069-034-Q1-K1-A7
aaaagtacaccctcgactcgtcctccgcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgt

SEQ ID NO: 57054 - DNA, 458 bp, Zea mays
  Clone ID: LIB3069-033-Q1-K1-H2
gcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtcgagttaggcgccaactgggtggaaggcgtgaacggcggcaagatgaaccccatctggcccatcgtcaactccacccttaagctccgcaacttccgctccgacttcgactacctcgctcagaacgtctacaaggaggacggtggcgtgt

SEQ ID NO: 57055 - DNA, 455 bp, Zea mays
  unsure at all n locations
  Clone ID: LIB3069-033-Q1-K1-F6
cccacgcgtccgcagctcgctagcatagcagcaaccagcaatggactccaccaagttatccgcgctgctggcgctcgcggtgctcgcgctctcctcgtcgccgctcgctctcgcgtgggagaaggcgcagccggagtgccactcgtgcgagtccggctcgccgccctcaaccggcgtccccctgcccccaatcagcataccgtcagtccccctgcccccagtcagcataccgtcagtcccactgccccctgtcagtataccgtcggtccccatcccaccggtcacccagctgcccccagtcgtcggactgccgccggtgacccttcctcccattccgatcatcggaggaagcccgccgaagaagggccaccggaaggcgtgcccgccgncttcgtcttccccgacgcccacgcccacgcccacgccgttctcggacaagtgccccatcgacgcgc

SEQ ID NO: 57056 - DNA, 432 bp, Zea mays
  Clone ID: LIB3069-033-Q1-K1-F7
ggctatcatatggtaaactgtggtttgatactgttgaagatgttatccgaatacgttgacatcagtaaatgtttaccatcactatctttggaggtggtccaacgtgttgtggaaatattaaagcttttcaacactaggacttgccaacttgttctcggtgcaggagccatgcatgtgtctggacttaaatcaattacgtgcaagcatttagctttggcgagtcaaatcattagttttatgcattctttaattccagatatcaggcgagtacttttcctgaaaatacctgaagcgcgcaaacatctgttaatgtctgagctggatagagtagctcatgactacaagatccatcgagatgaaattcacaacaaacttgttcagataatgatagagaggttgcttgcaaatcttataaaattaccccaaattgtg

SEQ ID NO: 57057 - DNA, 139 bp, Zea mays
  Clone ID: LIB3069-033-Q1-K1-F8
cccacgcgtccgcgcagagtcccctgtgctgactctgtgtcatggatggtccattttatcttgtggtattatcagcctttacataactgctatgtttggatatgttcaattctgttgcaattttatgtggttgtttttt

SEQ ID NO: 57058 - DNA, 366 bp, Zea mays
  Clone ID: LIB3069-033-Q1-K1-F9
cacagctagctagcatacagacgaataatctcttcttcacctcactaacaccagctagcagctcttgctctcctgcaataatggccgctcgctcctcctcctcccagccgcagctggtcgcggcggcggcggtcctggcagcggcgctgctgctgctggcggcgggggccgggacggcgtcggcggcggtgagctgcgtcgaggtgacagtgacggtggcgccgtgcctggggtacgcgatgggcagcgcggcgtcgccctccgcggcttgctgcaacggtgtgcgctcgctcaaccgccgcgcagtcgactgcatgggaccggctagccacctgcaactgtgtaaagagcatgacagaacctctc

SEQ ID NO: 57059 - DNA, 445 bp, Zea mays
  Clone ID: LIB3069-033-Q1-K1-G1
cccacgcgtccgacaagctcaagctcggcgagatcgtcacaaccatccccaccatcgggttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgag

SEQ ID NO: 57060 - DNA, 344 bp, Zea mays
  Clone ID: LIB3069-033-Q1-K1-G10
gcaccaaacaccaccaccaaagaaggcgagaacgtactccgtccctcccctcccctccggtcccctgcccctcgaggctccaggaccgtctcctcgcctgctcatccgccgctgctccccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttggg

SEQ ID NO: 57061 - DNA, 455 bp, Zea mays
  Clone ID: LIB3069-033-Q1-K1-G12
ctcgacgcgcctctgaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgatt

SEQ ID NO: 57062 - DNA, 458 bp, Zea mays
  Clone ID: LIB3069-033-Q1-K1-G2
gagaaaagtagatccgggttagggttttagacggcgatgggtgcggcgggcgacgagaaggctgcgatggctgcgtccgctgcagccgcgggtgccggtgccgccgagggcgagggcgcggtggactccaaggaccttcagcagcagagcaaggcgctcgacaagctcactgatcatgtcgaggaccggcagctcgattcatcccgtgtccaatccgccatggcagcacttgcttcatccaaggaggctgactggaacgcgatgaggctgatggagaaagaattggctgctgtgaagatcaaccctgccgatgtcgaaattatcgctactgagcttgagctggacaagaagatcgcggagagaacgctccgtgagcacaagggtgatgccgtggctgcggttcgattcctgctgcgctagttccgagatttcgtcgccagcatcatatgttccccttc

SEQ ID NO: 57063 - DNA, 449 bp, Zea mays
  Clone ID: LIB3069-033-Q1-K1-G3
cccacgcgtccgcccacgcgtccgcccacgcgtccgcccacgcgttcggcgagccaataaaatgtttgtggactacaatgagcctccaacagagagaatatactcatcttatcttgagctgaaccttgatgaggtggagcctagcatgtctggcccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcatgggcagccagcagaaatcaagcatggtagtgttgttatagcagcaataactagctgcacaaacacctcaaatcctagtgctatgcttggtgctggtcttgtagctaagaaagcttgcgagatgggtcttgaggttaaaccatgggtgaagacaagcc

SEQ ID NO: 57064 - DNA, 244 bp, Zea mays
  Clone ID: LIB3069-033-Q1-K1-G5
aggccttgaagaattcaagaatgaggtcatacttattgcaaagttgcagcaccgcaatcttgtaagactactagggtgctgcatacagagggaagagaagatcctggtgtatgagtacatgcctaacaaaagtctagatgcattcctctttaatcctgaaaagcaacggcttctagactggaagaaacggtttgatataatcgaaggcattggtagaaggctgctatatcttcaccgggattcg

SEQ ID NO: 57065 - DNA, 437 bp, Zea mays
  unsure at all n locations
  Clone ID: LIB3069-033-Q1-K1-G6
cggacgcgtgggcacaaagcagagcaggcaacggcacagcccagcacaggtagagagagaaagagaagcgcggagtcaagaagcggagcaacaacagcaggccgaggaagagaagagaaggccaggaggcagcagccaggaggaagagcaagagcaagatgctgcgcgggggctcgagcgtgctggggatcatcaacttcatcaccttcctgatctcgatcccgatcctgggcggcggcatctggctggcgtcgcgggccaactccaccgactgcatccgcttcctgcagtggcccatcatcattgtggggctcgtcctcatggtcatctccctcatgggcttcgccggcgcctgctaccgncagacctggctgctccgnctctacctcttcgccatgttcttcgtcgtcctcgcgcttctcttcttcatcgtcttc

SEQ ID NO: 57066 - DNA, 408 bp, Zea mays
  Clone ID: LIB3069-033-Q1-K1-G7
cggacgcgtgggcaaatgtgcaaggctacttcgcttggtctctgctggacaactttgaatggttcgccggcttcaccgaacgttatggcattgtctacgtcgaccgcaacaataactgcacgcgctacatgaaggagtctgccaagtggttgaaacagttcaacgccgcgaagaagcccagcaagaagattcttacgccagcttagaaatcgggggcctcatgatgtgggtgcagcccataaaaaactggtgtgtggtttggaaccgaaaattttctgtttttttccgccacgagaagttctggaagcatactctccagcaccgtggctaataacgcattgttccaattcagtctggccttgtcatgcatgcaataaataaagtgatgggtttcccatgttcaatatc

SEQ ID NO: 57067 - DNA, 457 bp, Zea mays
  Clone ID: LIB3069-033-Q1-K1-G8
cccacgcgtccgcccacgcgtccgcccacgcgtccgtttttttttcatgaatcggtcaaaaggccgttctgacgagggtgaacacgatcaccggcgtggcatacaaggacgacccgacgatcatggcgtgggagctgatgaacgagccgcgttgccagtccgacgtgtcgggccacgccatccagtcgtggatcacggagatggcggcgcacgtgaagtccatcgacgggaaccacctgctggaggccggcctggagggcttctacggcgcgtcgtcggcccgcaggtccgcgaacccgtcggggtaccaggtgggcaccgacttcatcgcctggctcgacgcccacatcgccgacgcgcgggcggtgctgcgcaagccgctgctggtggccgagttcggcgagtcgcgccacgacccgggctacagcggcggccaacgcgacgcggtgttcggcac

SEQ ID NO: 57068 - DNA, 438 bp, Zea mays
  Clone ID: LIB3069-033-Q1-K1-G9
cccacgcgtccgcccacgcgtccgcccacgcgtccgcccacgcgtccgagcacctggcggtcctatcatggtgcgggcgctggagagcatcggcccccggccaggcacaggcgcgaggccccggcagtgcgagggcgcgcggccctggcggcacgcctgcccgatgcaggcaaggctcccccggcgcgcgtgggcgcgaggcgcggcggccaggccccgtcggcccctgcgtgggtgcggcagcgcggccccggcgctgacggcgtgggcgcggctgcacggcggctcggtgcaggccggctgcccggcctacgagggcggcatggcggtgcggcggccatggccccagccacgacgttggtgctgcggatccagccccgaccccggtgcgggagcgggcgtggcggcccggcccctgcgcacggcgcaactcgggcg

SEQ ID NO: 57069 - DNA, 392 bp, Zea mays
  Clone ID: LIB3069-033-Q1-K1-H10
gttgtcagagagcatgacccttctggaagagatgttgaacttttccgtaggcaccattattctgggggaaagggtccaacagtgaaaggtctgaaaggagcggagctggctgatgggcttgttatcaaagaaggggagtacaagttggtgaagactagatttagtgctttcttcgcaacacatcttgattctgtcctgaaaactgcaggaataaagaacttggttattgttggagttcagacaccaaattgcattcggcagactgtgttcgatgctatagcactggactatgagaaagttacggttctaattgatgcaacagctgctgcaagaccagaaatccatttgtccaatatcagggatatgaagaacatcggagtggacacgccaac

SEQ ID NO: 57070 - DNA, 294 bp, Zea mays
  Clone ID: LIB3069-033-Q1-K1-H12
ctctgaaacaaagcgttgcagtttttaaggaatctcctcctttgaaacaaagcatttcagtttttaaggaatctcctccactggaggaaactactcctaaagaagctgttatgctaagtgaccgagggcttttcaatgtgcagaatcatcaattatcccatgtaacagaagatgttcagaatatgaaatcaaagctcaacaatcttgaatcaaaattggaagaggctgaaaagatgataataaggctaagagaagagagcagaaataccacccaggagcgggatgagctacagc

SEQ ID NO: 57071 - DNA, 444 bp, Zea mays
  Clone ID: LIB3069-033-Q1-K1-F5
aacagtctagactccaaaatgtgagggccttggaaaccaagaggatgcactagatattttcaatgaacactttattgtttctgtttcattttatttcaaaacatggtatgtactccctgacttcacttgagaagcgagaattgtatccttgttttgatgggggtatggtgagtttgctcagaaaacaatatggctcttggttctccgttgcttatgattcttggtactcgagcactcctgctcatgtgagatactaatgttttgattttgatacagtgcaagtaccttagtgcagaggaagcctgtaggtggtgcttttcagaatgccaaagtatggagtatggactttgtcaaatcttgaccttaatgctgagtaaataggacaaactggccgacaaggtcaaggagtgcaaccaggcagcaccaatgacgatggatgcactc

SEQ ID NO: 57072 - DNA, 418 bp, Zea mays
  Clone ID: LIB3069-011-Q1-K1-C3
cggacgcgtgggctcgatccagacagcatgcagcttccatgtccaaggtcttcaccctcggcgcgggcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcaatgatggatgagtacttggtgggtgaaatcgacgcgtcgacgatcccttccaggacgaagtatgtccccccgaaacaacctcactacaaccaggacaagactcccgagtttgtcatcaagatcctccagtttttggttcccctggcaatcctgggcttggctgtagccgttaggatgta

SEQ ID NO: 57073 - DNA, 216 bp, Zea mays
  Clone ID: LIB3069-011-Q1-K1-C4
cccacgcgtgcgctaaatacaaacagcatttaaatatacatgtccaaagtattaacactaggggcgggctttaagcacaactgcaactaggattgatcactcatcatcataagtaaggtgtaatgaatgagacgaagttattggtttaccaaccaagatgtaatgatgttgctgtgaaatcaattggcttagattcgactgatgatttcgaagata

SEQ ID NO: 57074 - DNA, 419 bp, Zea mays
  unsure at all n locations
  Clone ID: LIB3069-011-Q1-K1-C5
tgcagattagaggcagagtggtgactgctatcgcttctggtggacgttcgaaatgtccttggtgacctatctttgaattggcattgccagaaatagctcaaaagattacacggttggagaatgaagataccttgcttgattcttctggtgagactagatctcgtcacatccaaccacgatggaaacaagtcctactagccgtaatggggcccgaacaacaccagcggccggtggatgggatcgctgcccgctcctgtcgtcgttgccccattggtggaggcccgaacagcacctgcaaccggtggatgggatcaccgcaccgtccctcgccgttgttgccccatctgtggagcacctcgtggccggngatgcctgccatggcgaccaaccagctcaccctctctttccatggcgagttt

SEQ ID NO: 57075 - DNA, 463 bp, Zea mays
  Clone ID: LIB3069-011-Q1-K1-C6
cccacgcgtccggccacgcgtccagtaggacgtccttctcgtgggcgacgacccttggcaggaattcgtgagcacggtgtcctgcataaagatcctctccccgcatgacgtgcagcagatggggaagcacggcctggagctcctgagctcggactccgagcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcattctcagcctcaaggtaggtaggggactgaagggttggtctgcgacttgatgacccacgagctcctcgttgcgcgctttattcgcctgcatgcgatggatagaagttcagcgcagaccaagccttactctgctagctatgtaccatctaataattctg

SEQ ID NO: 57076 - DNA, 341 bp, Zea mays
  Clone ID: LIB3069-011-Q1-K1-C7
cccacgcgtccgtatttttctagattagtactaagatgatccttgcacatattttcctccgggtgtgaatattctcggatggctgatggagggaggggaggcagggaaaggctgattagttgtgaggtttcagatgatggcatgccactggggaggtagaagggatggccagtcaaacacagacggatcaaaggagacatggtatgcgaccagaccatgcatgaggtgtctagacgtacatagcgtctgtgtagtgtacctgtgtgtagagtgcgcgcgcaggtagagcgtgaacaggctaccatgtctgagatccaagactggaagtaacatgactggat

SEQ ID NO: 57077 - DNA, 253 bp, Zea mays
  Clone ID: LIB3069-011-Q1-K1-C8
cccacgcgttcgcccacgcgtacgatcacgcgttcaccgactcgtatgacattattgatgaggagcttagcgttcgcggtcagagggcttacttcttgcaggagttagcacaccggtcctagaactgcgaacgcatggatgccaatgtctaagctcacagacttcgtctcatgcgctaactaccattcacttgagctgcatgatactcaggagaaccttacgcaatgtgctgacgaccttggcattccatttg

SEQ ID NO: 57078 - DNA, 411 bp, Zea mays
  Clone ID: LIB3069-011-Q1-K1-C9
tttggctgatttagtgctcgtttatgtgcctgtttatgtgcttgtttatctgcttgtggatgtgcgggctgacttttatagagttagggtgcgtaggtgggtgggtgggtgagtgagtgagaggaaaagttaaggtggtagtagcaggtagttattactaacaaagaaggcttaagtacgctgggggcgcgggcgccttggaatggtgcggcgaggtcggcggagaatttgatgctggggaatgtggtggtggtgttgggtaagtgtaaggtgtcgtcgtatatgttgcttggggaggcggctatgcttcatgttcagtcggagtgtaagtcggtggtgtctggtcgggagtgtcatcatgttggtggtcgagatggtcgtagtcttggttcgtcgtagcattataagtgt

SEQ ID NO: 57079 - DNA, 386 bp, Zea mays
  unsure at all n locations
  Clone ID: LIB3069-011-Q1-K1-D1
cttgctgccaaagcgaaggctggaaaggaggacggcagcagccgtgctgaagctcctccgggtctgggaagcaacgcctactgcttcggcgcgctcatgatcgagaccatatccgggagggttcctgacccgtatgatcacaaacccatatgcagctgggcttctgagcatctgaaagacaagaactacggcaagctcgtggacgcgtcgctgaaggagcacaaggaaagcgagctggaggccgtctgcgaggtgatccaagagtgcatcgaccctgacccgacgcggcggccgtcgatgagagacgtcgtgggcaagctgcgagacgctctncgcatctcgcccgaggcggcngcgccgcggctgtcgccgctctggtgggcgga

SEQ ID NO: 57080 - DNA, 379 bp, Zea mays
  Clone ID: LIB3069-011-Q1-K1-D10
gacctttgggctggtttatgtgcttggggccggtcctcttctttttcttggcctggccctgggcctgcgaggcctcttggggcctgggcctgcgggcgagtggactgagacggtggtgctggacgccgagcattgtcgtcctgctggtggttctgttcgggttatggatgattatctttcttataatgttcctagtattcatggtgaggcttctgagcttaagactacttctgactgggagatgtagaggctttgtggtcctggccctgctattcctcttatggaggaggtgacgtggaatgttactgagggtacgaatggtaaggagtcggatggttgtaatactattgctaatgaggtttagctttgtggtggttgc

SEQ ID NO: 57081 - DNA, 467 bp, Zea mays
  Clone ID: LIB3069-011-Q1-K1-D11
cggctctggacctttgggctggtttatgtgcttggttggatgttgagttttagatggttcctcctacgagtttaattcttgcgtctgacgtggtggtggttcctgcgttgggtatggatggtgttggtaagtgttgtttgttgcggtgggtgtgggataataatggctctgtggatgtgtcggatcgtagtgattattattagtagtagtagtagtaggagtggactgcttctgtggtgatgttgctgctgcgtctgtcggttagactgcgtctttcggattgctgtgctgagcctggtgctaagaataggagtctgcggtcgttttcttgtggtcgtgaggttatggtgttggtgttggttgatttgcgggagacagagttgctgctggaggatcatatgcgtgctactctttgtgggttcaatttgaggatggcgtatactcctggtgattgtgctgcggaaggt

SEQ ID NO: 57082 - DNA, 223 bp, Zea mays
  unsure at all n locations
  Clone ID: LIB3069-011-Q1-K1-D12
tcgcgttatggatgattatacctcatataatgttcctagtattcatggtgaggcttctgagcttaagactacttctgactgggagatgtagaggccttgtagtcctggccctggtattcctcgtatggacgaggtgacgtggaatgttactgagggtacgaatggtaaggagtcggatngttgtaatactattgctaatgaggtttacctttgtggtcgttgc

SEQ ID NO: 57083 - DNA, 190 bp, Zea mays
  Clone ID: LIB3069-011-Q1-K1-D2
cccacgcgtccggattgtcacttaagttaacatgtattttaaaacttataaatattttatacattgtaaattgtaattctatgtaatcattttcttttgtaatcactccgataattgtataatgtaaacttattgtaacacaaaaaaatatacaaatagacttataaacatatgaaagacaagaactacg

SEQ ID NO: 57084 - DNA, 407 bp, Zea mays
  Clone ID: LIB3069-011-Q1-K1-D3
gtggaagagatgaagacaacatcctggaggcgtctgctggacaagggaaggcagaagagaagctcggtgatgatatctacaaatctgagatatctgatcaagaaataacagcaaggacaggtgctactctggaaggtagcttcgaagaggatatttcatcggaccaagaggcaaatgatgatgatgaagatgagtgccatgtgaaatctgatggcgaatcagaggacactgaggagcaagatctggaggatcaacagagcatgccagatgatgtctctaaaatagagatttctgaggacaccgtctctggtgacggatgcaaagaggatttttctgaagaagtaacctcggcagctgtgttagcagatgatgtgtttgaacaatatgacaacactgtggatgatgtg

SEQ ID NO: 57085 - DNA, 363 bp, Zea mays
  Clone ID: LIB3069-011-Q1-K1-D4
atgataagcaacatgctggacttgatgtgactgctaaacttgacacttcaactgaaccacaggatggtattgcgcctgataggcttactgatcttctgcctgctaatgatcccaatcatactatggttcatatacaggcccagtctacagcacaatcacatgcatcagatggtggcaaagaccctgatgctcatgcaacctcatatttggtcaagaacactcacagcaacatggagcctgatgtgcagaacagtatctcgcagctgcatgacatcactgtggtaaaggccaagcaagggtacaggaaaagacatgtgtcagaagagataatttctgatgagaaagcaagtgcttcaataacca

SEQ ID NO: 57086 - DNA, 398 bp, Zea mays
  unsure at all n locations
  Clone ID: LIB3069-011-Q1-K1-D5
cttagccacacacacacacggctgctagtgtacacagaggcacagcagcaggaggatggccgtagtgccggctgcgccggtggttcttggagtggccatggtgctcgtcgtcctggtcgtcagcgccggcgcggtcgggcagctcaggatggggttctactccgagagctgcccggtcgtggagcgcgtggtgggcgacttcgtccggcagcacgtccgccgggtgcccaccggcgcgctcgcgttgctccggctgcacttccacgactgcttcgtcaggggctgcgacgactgcgtcctgctcaactccaccgcctgcagcgtggtcgagaaggacgcgccgncgaacctgacgctgcgcggcttcgacctcagcgaccgcgtcaaggcgctcgtcg

SEQ ID NO: 57087 - DNA, 383 bp, Zea mays
  unsure at all n locations
  Clone ID: LIB3069-011-Q1-K1-D6
cccacgcgtacgcaaacctccctgccaagccctcttttttccctcgccgcggcgcaggcagagcataggcactagcatgtcggcgttcgccgtccgcgtggccttcttggccgcgctgctgctcgccctcctgctcgcggcgccggcctaggccgtcaacttcacctgcgccacggtgggcaaaacgtgccagtcggcgatcgggtacgcggtgcccaacgcgaccacgtacggngagctggtggcgcggttcaacgccaccacgacgctggcggagctgctgtgcgccaacggcctccccgtcacgacgccggcctcgacgccgctggcggacaaggccacggtgcgcgtgccgttccggtgccggtgcgggagcaacggcg

SEQ ID NO: 57088 - DNA, 469 bp, Zea mays
  unsure at all n locations
  Clone ID: LIB3069-011-Q1-K1-C12
gacctttgggctggtctatgtgcttgtttatgtgcttgtttatgtgcttggtttgaacaagggttattggaaggtgcgtttgttgttcgtgctctttttgatgtttatgttgatgtttatgttgcttctggataagcgttttactgatgtgtcgaagtctggtgtgcgtgcggatacctctgggaatgaggcgtatactggtgatgttaatgctaagcgtcgtttgtctgcgaagggtactgttgggtctcttgtggtggtgcgttcgcgtattgttactaaggttaaggcgtcggatactcttgctcatgcgtttactgtgtcggaggcgtctgctaatcgtggtcgtgaggctttgttaggtcataaacgtatccaaatgatcttaccttaccctactttactctattacgtgcgtatagtgaggctcntccccgtttctttgaacgtanagcccgaaaggtctgct

SEQ ID NO: 57089 - DNA, 375 bp, Zea mays
  Clone ID: LIB3069-011-Q1-K1-A8
tggaagcagcaggggaagaagcattagattttagaagagtagtccactcacttaaggttggtcttgaaaatctttacaatggaatctcaaagaagctctctctttcgcgcaatgtcatctgctccaagtgcaaaggcaagggctcgaagtctggtgcttcaatgaagtgccctgggtgccaaggctcaagtatgaaagtcaccattcgtcaactggggccctccatgatacagcagatgcagcagccttgcaacgagtgcaaagagactggggagagcatcaacgagaaggaccgctgcccaaggtgtaagggtgagaatgtcgttcacgagaagaaggttcttgaggttcatgttgagaaaggaatgcaacaca

SEQ ID NO: 57090 - DNA, 416 bp, Zea mays
  Clone ID: LIB3069-011-Q1-K1-A9
tggctctggacctttgggctggtttatctgcttggattcttagagatataaaaggtaccaggagtcataccagtagtcggctcactcgatatttgctaggacgcctacgatagagtatcccctcatcataggtccccgtaacataacttcaacgcagtagaatgcgcagcaaatttctttaaataagtcgctctcgcacccgtagacatatagagtagcgaaattaaagactggacacccgacgagcctaatagctcactagccgcacactagaagttactccatacgcccatagacagggagtactgcgggttacccgaacatctagaggactccataagtccgatcgccggggtagaggacttagaaaacgcaaccctcgtttaaagacactaagaaaatgacaacgactcccc

SEQ ID NO: 57091 - DNA, 224 bp, Zea mays
  Clone ID: LIB3069-011-Q1-K1-B1
aaaaaacaaagcggccccactctatcatgatcccaacttacctaccccatcattccacctaaaaactattctatagcttcacctaaactccattcaatctccgtcatcttacaacactccttactcggaaaacccttgccttacccaacctaatcaccattcaacataatcccctttcttccacctgccttataaccaaaaaaccctcacccaacctcctttcc

SEQ ID NO: 57092 - DNA, 452 bp, Zea mays
  Clone ID: LIB3069-011-Q1-K1-B10
gacctttgggctgatttagtgcttgaatgttcttgtcgtaactagtttttgtggccagtccgtttcgttttcgatttcgagcgtcagcctctgttgccatgcaaggtcctccggttccgtgcttcttgctccctgccgtcgacatactgaggcaccaaagaagtcgttcgaccttgggcagtagaggctgttgttgttcgtagtaacggttgatcctcttcggtctatggcgtccggcccttcaccttctatacctaatctaggtacggtgacccactggcttaatggcgatgttggtcttgctgtccctgctgcggcactccactctgattcggcggtttcgcctgttcgtccgtgtcatcatgagtagccggactagtagtatctttaaaagtgtgtgagggctaaggtcggggcccggagttctatgatttcctccatcactacgccta

SEQ ID NO: 57093 - DNA, 467 bp, Zea mays
  Clone ID: LIB3069-011-Q1-K1-B11
gacctttgggctgatttagtgcttgtttatgtgcttgggaatcctttcaggcgtcaaaagagggccatcggccagaggaggcgacgccccagagtgcccggtcggaacagacatctccgcgtccgacaaaatagggatgtccatagaaggaaaattagcagcgatcctcaccgtcctctcggtacacgaggagatagaggcttcctgctccgtcgtcgtagcggagaaaatagtaccgtatttaaccgtaaacgtcacaacgaataaggtcgaatcatctaagccggacaccttgactataagcggctagtccatactgttcggacccggccgcccggtcgaagcagacgggagcccagccgtagcgggtatcccggaccgggcgtacgactgccccgaaatcaaagtactgttaatcgaatcgagagattccagaaattggtcggagcccacgccgctaagcgaag

SEQ ID NO: 57094 - DNA, 466 bp, Zea mays
  Clone ID: LIB3069-011-Q1-K1-B12
gacctttgggctggtttatgtgcttgtttatgtgcttgtttatgtgcttgattatctccttctttatgtgcttgattatgtgcgtggtgatgtgcttggctagtcacgaggaaggtgaatagcccgttaaggagtacggctcggcccccacggaggtactcgtcaaaatcgtataaaatgctgaggaggtacctaccaagattgtcggcataacacataagaaaacttaagacggtacacccgacgcactaaacgagcttaatgggactaaagccggtcacgtcgcctttaatctactcggaggcggcgtcggtctgcttctataggtcggcggtcgtcgtagccgagtggcggtagtaagctacataaccgtaagggcctcttttgtagcactccgacgcccgttcacagtcggttttggacgacccgactccctagttactatgccctaacttacgaataaatt

SEQ ID NO: 57095 - DNA, 397 bp, Zea mays
  unsure at all n locations
  Clone ID: LIB3069-011-Q1-K1-B2
gccgtgcgtgaagaagggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttccaggtcaccgtcagcgacggccgcaccgtcaccagcaacggcgccgtccccgctggctggcagttcagccagaccttcgagggcggccagttctgaggatgaacagctagcgcgcgcgcggctagctattggataattaattacggtactgtcgatttggtttttttgccttggttnttttttgcgcgacga

SEQ ID NO: 57096 - DNA, 275 bp, Zea mays
  Clone ID: LIB3069-011-Q1-K1-B3
gcgtgcgtgaagatatgcaccttgcaggtcaccgtgtactgtctctaatacatcaacatggaccggcactcaaagtgtcatggcgccactctctcacgctgctcgttgatgcttgcttccgctgcaatccggctgccgatgccgcttatacagtgctcagtctctctatagatcgcagctcgctgcactgcaaacagctgtaacagcagccgcttgcagccaaccgaacacgccctttcatacttattcaatatcacaagtctgtcctgagatct

SEQ ID NO: 57097 - DNA, 308 bp, Zea mays
  Clone ID: LIB3069-011-Q1-K1-B4
ctttagtagtgttaccaatgctgtgaataccggatagtgtgtgttcggtttaggatcacctgtgtgtagatagaagttgtttgacgttttgggctacaatttctaaattgttgctttggatttttccccatattatcttacatctgttattaatttgattccttagtattttgtctcacttatgaagattttaaaacaataatataagtccttttacctcttgtagtctcactatttcaagtttctgctttaaaatacctgataggtacccctttgcgaagacaatgcctctgatgtgtgctggattc

SEQ ID NO: 57098 - DNA, 63 bp, Zea mays
  Clone ID: LIB3069-011-Q1-K1-B5
gttttgtgtttctatgtggttaattggttaccctttggaatgaaaatccactgaatttgggtt

SEQ ID NO: 57099 - DNA, 365 bp, Zea mays
  Clone ID: LIB3069-011-Q1-K1-B6
gcgaggtctgtgcctgtgcctatgctccatctcccctgcccctgcgccccaagtccaggtcggccactcagcactcacgctgctcgctcgctcgctcgtacacgcgcacgcttcgcgcacggaaggaaccgtggtggagggagcggacagacatgatgcacgcccagccgaatctgacgtgacaggcttggcggcaacatcgccgccacggcagctaaaccgggccggagatccggccaccgccgctactaacttgcagagcccgtcgcgggagtcgcacgacggcggctacaagtcctcgtcaatgcagccaacgccggtctacaacagccccaacgagtcgccgtcgcaccccttatacggcc

SEQ ID NO: 57100 - DNA, 279 bp, Zea mays
  Clone ID: LIB3069-011-Q1-K1-B7
gtcaggtgtacgtcagtaacaccagttattatctcttgctcttgtgcaataatggcgggtggatcattctgctctcaggcggagctcttggtcgctggtacacgcgtgcgatcggcgcatgtaatgatcccagctggggccagcacacgcgacatgatgcagcgagatgctgagaggtgacgtgactagctgtggcgcgcgcctcgggtaccgcgatgggcagaagcggagtcggcgtcaccggcaatgctcggatactagtgcgcatagctcaacagc

SEQ ID NO: 57101 - DNA, 431 bp, Zea mays
  Clone ID: LIB3069-011-Q1-K1-B8
gccacgcgttcgaccacgcttccgataattatattcactggctaaccatacacaataaagggagaagtttaacattcgacataatgttgctgaacttaatggagtatatatggaatgttcctaagtcaccgaaacgcatggagacaaatagctaaagaggaggagaagggtgtatacttaaattttcttaactttctcataaatgatagcatctatcttcttgacgagagtttgaacaaaattcttgaactgaaagaaatagaggctgaaatggctaacatagttgagtgggagcgcagacctgctcaagaaagagaggagcggctgcgtgtatttcatcagtgggaaaatattgttcgttttgacatgaggctagccaatgaggatgttgggatgcttgcattcacctctgaacaaaatccagcaccttt

SEQ ID NO: 57102 - DNA, 442 bp, Zea mays
  Clone ID: LIB3069-011-Q1-K1-B9
ggacctttgggctgctttatgtgcttggaaactcctcaaagtcccacgcggacaccgaacctatcggtctttacatataaccccccgagaagcccaatacctgatacaacaccgtcgagtcctcggagcacccacgggacgccttcagctattgaaatgtacggagataaacagtcaaagaggaggagaagggcgcacatccaaacccctccaatccctctacaaacgacagtactcactcctccgatgagagcccgaataaaacctccgaatcgaaagaaacagaggtcgaaacggtcaatacagccgagcgggagtgtagattcgtctaagaaagagaggagtggtcgtgcgcaccctactagcgggaaaacaccgcctgccccgatacgaggtcagttaacgaggacgccgggacgtccgtacctattctcgaataaac

SEQ ID NO: 57103 - DNA, 166 bp, Zea mays
  Clone ID: LIB3069-011-Q1-K1-C1
cgattgccgatgcctgtgaaaacgttgcgctttgtttgtcacggtgaatgcttgtgttcctgtatgagctggatttgggaactgctcgtagaaaacaagtcaacaacaacaaaacttgtagggtccagtgggcctgacgagtccttaaaaaaatttgttcacttgc

SEQ ID NO: 57104 - DNA, 442 bp, Zea mays
  Clone ID: LIB3069-011-Q1-K1-C10
ggctctggacctttgggctgctttatgtgcttggccgaggtctttaagattgattcagatccccggaaagcttccgcattggccgtcgcggtatagataaccggttacgccgtcgtgatagcgagtacgctcaacgcggtagcgctacctatatatacatccaacagcgtagaattcgtacctatcgccccggtgctaaagccttcttccggggagatgcccttagccttagctcactcacctctcctccataactaccggcggtcgcgtctcagtcgtcgctatagagtcgaatccctacacggccggacccacgggcgtcacgatgcttaattccgtacctgccccttgtaatactcctctgaagaggggtacgaacgggaagcttgctagcggtacgaaccatcacgtccgttcgctaacaacgctgacggctacatcg

SEQ ID NO: 57105 - DNA, 453 bp, Zea mays
  Clone ID: LIB3069-011-Q1-K1-A7
cttttggaggaggtggtggaagcagcaggggaagaaggcaaaggatgggagaagatgtagtccactcacttaaagtgtctctggaagatctttacaatggaatctcaaagaagctctctctttcgcgcaatgtcatctgctccaagtgcaagggcaagggctcgaagtctggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccagggtgtaagggtgagaaggtcgttcaggagaagaaggttcttgaggttcatgttgagaagggaatgcaacacagccagaagatcaccttccctggtgaagctgatgaaacgcctgataccgttactggagaca

SEQ ID NO: 57106 - DNA, 293 bp, Zea mays
  Clone ID: LIB3069-011-Q1-K1-C11
ggacctttgggctgatttatgtgcttgactcccgcccagccgctcccgccatcgagacgaatctgaagtaagagactaacttaaaatgctaagcacccgtccatacttagatagaataagcccgacacagcactgaaggatataaatagataaagaaattatatagaataaaatcgttaagacaacgacattatataagagaaaaaatagtgaggctgggctcgaaattgtacgtacttacacatacattaggatttacgccggtctccacaccccagaaccaaataaatcca

SEQ ID NO: 57107 - DNA, 448 bp, Zea mays
  Clone ID: LIB3069-010-Q1-K1-H10
gcgttcggacgggacgcgcttgtaacactaacgcgctttgtttacctacatcagatattcgactaccagtgagtctttaacataccgggactactagcataccttgcctcactttccatctattctatgaaaacctgcgtactgaactaggactctagatactagctctcattactacattataccgctcaatatgcatggcctaatgacagttaaacaatcatgcaaacatcatactaactcacattctacatgatccaaacttacgaactcattcattctaaaacataattttaatatactgccactttagatgaacccactttacgtactcatacatcctacttactagcaaatccctggcgtcacccaacttaaatgcactgcacgacatactactatctccagactgcgaaatatctaacattacccaacttattgcccttgc

SEQ ID NO: 57108 - DNA, 440 bp, Zea mays
  Clone ID: LIB3069-010-Q1-K1-H11
gtgagcccagtaccgactccaacaagaatttcgttttagaagacaagaggaagccaaaaggagaacgagttcttaaggaagcggatggcaacggctctgctccagctattgctgtcactccttatcgtctcctgcgcctcacagtcgccgtacgcgtcgaatgctcctccgctcagcgcctcagcgccaagggttctctgtcgcgccaccgacatcagccgtctcagcgccgcaagcgtctgcacagccgccgacaacagtcgccgcgtctgggcctcatgcctctgccgtagcaccaacaaaagcatcttttactccttaagcctctgctgctccgtcaactacagctgcctctccgcatctggctaccacttttgccccagctttcttaccgtcactagctgctgctgcgccacctgccttcgctaccccttcaacca

SEQ ID NO: 57109 - DNA, 385 bp, Zea mays
  unsure at all n locations
  Clone ID: LIB3069-010-Q1-K1-H12
gtccgcccactcgtccgtgatctcagccgccgccgctgctcatctcacagcccggtataatactcctgctcctcgccgatcgatacgatggccgtcttctccgacctccacaccgtcgactgcctcaagtccctcgaggctcacctcgccggcaaaacctatgtgtctggtgactgcattactaangatgacattaacgtcttcgacccggtgccgtcgaagcctggcgctgagtttgctaatgccgtccgctgttacgagaccgtctctgcggctgtagcctcaagattccctgctaaggctgttggtgtaaatctgcctgctggatcagctcctgctgcagctgctcctgcggatgatgctgacgatgatgatgaccttgatc

SEQ ID NO: 57110 - DNA, 367 bp, Zea mays
  Clone ID: LIB3069-010-Q1-K1-H2
ttctgagggtgcatctaggagcatagggataggtggaccaactcaaaagacatgtgcattggcagctctatcatctgcattcaatccatcgatacaacaaaagctctctaatgagaggcttaaaagcacatgcgatggacccactcaacgcgcctcatcactggctgccctatctaatgcattcaatccatccttaaaacccaaaacaccacttccatctcgctcaggtcaaggttcccaaagagcagctgccgtagctgcactatcctctgtgctgactgctgagcattctggatcttcagaaaatctacgagccaaagctagcagcacaggatataagactgatgtcgaatggcctgtcataact

SEQ ID NO: 57111 - DNA, 343 bp, Zea mays
  Clone ID: LIB3069-010-Q1-K1-H3
ccgacgcgtccgcggcgcgtgggtgcattgtggtttctgtgtacatcaaatcgaaagaggctccggctaaagatgttcttacagatctcgttgaaatgtgccgtgggattcaacatcctgtgcgtggcctttttttgataagtcacctttctcaaataagcagagacaaattgtctgatattgggtctgagtacgaaggcgatgtggaaaatattaacgatgcggctgaatttgttcttcagaatttcatagaaatgaacaaactctgggtccggatgcagcatcaggggcctgcccgagaaaaggaaaagcgtgtgaaggaaagaaatgaactgcgtgatct

SEQ ID NO: 57112 - DNA, 392 bp, Zea mays
  Clone ID: LIB3069-010-Q1-K1-H4
acgcgtgcgctgggagggctaaagcgtggcgatgtttagcgttgccaggtggtgtgcaaacctggtggtctgggtacatacaaaaagtttgaggcagaaatatacgtcctgacaaatgatgaaggtggccgtcacactgcctttgtcacaaattacacaccccaattctacttcaggactgctgatgtcactggaaaggttgagttgcttggtgagacgaagatggttttgcccggtaacaatgtaaccgcgaatttcgagttgatatcgcctgttcctcttgaaactgggcaaagattttgctatgagtgaaggatggaagacagttggtgccggggttgtctccaaagttattagctgatgaatttccactttcttgcccgtaacaattt

SEQ ID NO: 57113 - DNA, 320 bp, Zea mays
  Clone ID: LIB3069-010-Q1-K1-H5
gtgccatccctcgcctgccttttcacgtttgcgccgcccgctcgacagccacggggcagcgcgcctcgccgctcagctgcccggcacccgcccttcctcgccgagctcaggatcgacgtctcccgcaccttcttcgcgcccgttccgggctccgcatccggcctctcccccgtccccaaccccattccgcagcaggcgaccagcacaacttctctaatcctccgtctcgcattctgctctcctgcgctcctactccgcgtcccgccacccttcgtacgcacaagtttactatgtctgggatggcatctgatgattcacct

SEQ ID NO: 57114 - DNA, 377 bp, Zea mays
  Clone ID: LIB3069-010-Q1-K1-H6
ggagaaagaacagaatgctgttatgtttgcactgaagaagcaggagaagcgcgccaaggggactgtcatcatgatgatgaagtgtgaagaagatgagtcatctgagtcaagcgagagcgattgtgaggacgaggcaaccatgaatgccgagcagggcttggtgatctcaacagcgtttcccgaggttgttgcatcaagcatctcagctgtccccgcgatggagtgtgataaggctgcagtgaaggccatgaagaaaatggagaaggaacaaatgaaggccatgaagaagtatggagaaggaacagaagaaggctgctaataaggccatgaagatggagaaggaagcaaagaagatggcaatggctacactgaatggc

SEQ ID NO: 57115 - DNA, 328 bp, Zea mays
  Clone ID: LIB3069-010-Q1-K1-H7
acgttacgcaagagcccatcattgagtttgtccagagttgcgacattgtggctggcaagaggatctagagttcagtttctgagattgggcaacggcagcggctcagctcgtcaagtttgtgctgggatgccagtttatcccttctagtctattacagaaatgttgttcggatctgagtctattataaacatcttggtctgagtttattgttgagtggtgccagtttttttcaatatacatttatcttaaaaacagcggtactgatgtttttttgtctaaagttaatgagtttgcaatggttctgagtctaaaaaaaaaaattaaataa

SEQ ID NO: 57116 - DNA, 261 bp, Zea mays
  Clone ID: LIB3069-010-Q1-K1-H8
ggaggacgagccgtgaccattcagccttcacctcacccccccatcgcccgggttcgtgccaccatccactcctgcttcccggccttcctacttcatcccaacaaccgctacttcttacaggcctgccgaccgttgctcttcgcaactaaacccttggcagcttccgcccgttaccttgccttcctaccgcttgctttccgaataaaaaccgcccaaccctggccaccgaaaccttgtccggcctaacctcttcccgggttt

SEQ ID NO: 57117 - DNA, 419 bp, Zea mays
  Clone ID: LIB3069-011-Q1-K1-A1
cccacgcgtccggaaagaacagcttgcaaaagatgtcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcatgctctcagacgttatgaatctggggaagagcgctgcattgcttgtaaactatgcgaagctatatgcccagcgcaggcaattacaattgaggctgaagaacgtgaagatggcagtcgccgaaccacaagatatgatattgacatgaccaaatgcatttactgtgggttctgtcaagaggcttgcccagtcgatgctatttgtgaggggcctaactttg

SEQ ID NO: 57118 - DNA, 383 bp, Zea mays
  Clone ID: LIB3069-011-Q1-K1-A11
ctttgggctgatttatgtgcttgtttatgtgcttgtggatgtgcgggaaaccacaacaaaaaataaaaaaaaataatacaacagggaaggccccaaatcaaaataatgaaactcataatatatcaaaatcaacaacatacgccaatatttaataagaataagtacaaatcagacattaacgacggtatcctacgtaaatattgaaactctcaagaagctttaaacttcaaactcccatcgctagctcgatgtcgtcacagatcacagtttcgagttcatactgccatctattcgcactaataattctagctacatggactttgcctcactcatataccgatagaccgaaccctgtaccttaccactacccgtcttcaaagcaa

SEQ ID NO: 57119 - DNA, 480 bp, Zea mays
  Clone ID: LIB3069-011-Q1-K1-A12
tttgggctgctttatgtgcttgtttatgtgcttgtttatgtgcttgggactcctcttggtattcctcgagtaaaataccacaaaggacgaccctatctaaataatcgacgccgtaattgtcgaagtcctcagctagggcagctttaagaagaaaaggtacaagcccgacagcggcgacggtatcctacgtaagtgccgcagccgcaagaagcttaaacgttcgaaatcccatcgcgagcgccccgtcgtcggagctcaccgcctcgagttccgcctgcgcactggtcgcacgaataattagagctacatggaaatcgcctcactcatgtggtaatagaccgaactctgtaacttaccagtacccgtcttcaaagcaacctacatactcgagttcggctcggaatcaagggatcctcttaacaaaatcttcgtcctagtctgctataaaaggggacgtaaccgtaagaagctgctacgctc

SEQ ID NO: 57120 - DNA, 274 bp, Zea mays
  Clone ID: LIB3069-011-Q1-K1-A2
gctagcaagaactgcaggacgataagcaagatctggtgtgcttgggtaggacaaggctcccgatgggtttgagagttgtaacacttatgagcaatctggatttgccatagtcaacttctcttatacctatgattgatgcaggaagtggtcttatgaggaacaagacctggctgtctctgctggatctttctctgtaattgatgatgctggacaccgtggaaagcgaatgagaaaatcattctctgatcaagaagcatattcagaagagtcaaac

SEQ ID NO: 57121 - DNA, 361 bp, Zea mays
  Clone ID: LIB3069-011-Q1-K1-A3
tgcatgacgataagcattatctttcgtgcttgagtaggacaaggctccggagaggttcatagtacaacacttatgagcaatctggatttgccatagtcaacttctcttatacctatgattgatgcaggaagtggtcttatgatgaacaagacctgtctgtctctgctggatctttctttgtaattgatgatgctggacaccgtggaaagcgaatgagaaaatcattctctgatcaacaagcatattcataagagtcaaacggtcagaacaactctttacagggcagtacgcaagctattgtgacttgttcaccggtaagtacctcaaatgatcttcaagttcatctcttatcaagcatggc

SEQ ID NO: 57122 - DNA, 409 bp, Zea mays
  unsure at all n locations
  Clone ID: LIB3069-011-Q1-K1-A4
ggaaccacgggttaagaaaattcttgtccatcacatcgagacagtccaccactctgaagctgtcgaagatgttttacaatctcttttgcttgttgactcaaattccaaggagacaaagagcaagacaaaggagtggaatgacagaatcaagcaagacaaaaaaccagagcaactacgatcagctgccagacagaggcatgaggatatgggaagaaatgctcggtttgcacaaatatggaagagtcgaaaaggagaaaaggctgnatgctgtgactcattgagagaaatatgccatctntatgatgctgtccaagtagatcccgatgatgagaagcatccagcagaaccacggattacatcgtttgaagagggtgctgtctatgcaactttcttccacttataagggaat

SEQ ID NO: 57123 - DNA, 219 bp, Zea mays
  Clone ID: LIB3069-010-Q1-K1-H1
gtggcacggactgaaccaaaggtaacgtaggaatctattataatgactagtcatccagggatgagtcccctttgtctcattgcgcggagctctcaattgatcgaaagttttgtagagagcagagagcattcacttcagattacctggaactactgccatgtattctgctggtaaactcgataagaattctttgatcctgtccagcacgaattttatgca

SEQ ID NO: 57124 - DNA, 167 bp, Zea mays
  unsure at all n locations
  Clone ID: LIB3069-011-Q1-K1-A6
ctgtgcagaaatgtttggtgcctgttttatttttcttgcataaaagtcacaagcactganaggtggctcccctatttaaagcttcggaaaagggtttaacccaaccggttttccccatctggtggggaacttccgtgcttattgcgcgttccttacaattttccacc

SEQ ID NO: 57125 - DNA, 367 bp, Zea mays
  Clone ID: LIB3069-036-Q1-K1-F5
gtttttagtaaaaaggggaaaaggttctttccaacagttttgtagatgagctccttaaagattaaaaagttgtcaaatatcctctccaacttgtaagtttgtgcagtcaagaggaactatgtatcggctccccatccagcgtttttctcaggagaccggaataaattggatgcatgagtaaatttagaaaataaaggcttccagatgaggaagcggtaagagacaaagaaactattaaaaatgattggttggttagaaatagtttgaggtttcccaatgcataattgtttagtaggctattatagcagactagagaacaataaactttaaggttgctattttttttttgttaacttgctagatctgt

SEQ ID NO: 57126 - DNA, 353 bp, Zea mays
  Clone ID: LIB3069-036-Q1-K1-F6
cgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggc

SEQ ID NO: 57127 - DNA, 295 bp, Zea mays
  Clone ID: LIB3069-036-Q1-K1-F7
ggctggcgtcatacggtcccacggttcttgtggagccgcggaccgatggtcatcgtggggcatcatctgcaggcaggaccacgccacggccagcatcgcgcgcgactcaggacgcactatgagactggaaggcggagacccgtgaggagcactggaggtgcaccgagcggatcctagactggagcgagacgagcgggcgcgcactacatggacgaagcgggagacaagccacgctgctcaccacaagggaggcaaggactaggacgactacgagaagaccgtcaagatgcccgag

SEQ ID NO: 57128 - DNA, 442 bp, Zea mays
  unsure at all n locations
  Clone ID: LIB3069-036-Q1-K1-F8
cggacgcgtggggtttggtggcaccaatttgatgttgcaccaaagcctctggaagccgtcattcatcaaatgatggagcttgcggctttgaaaaagttgatgcctgctcgacccaatccggttaagctgaaggaaactttatgtgaagctaaactgagcttatctaatagcccagactctgtgttgaatcaatcaagcttgttaataagcagctcaagtcctgatattggcgagcccagtgacaaagtgcaggtggattcctgccaatacttgataagcagtcacatgggtgattgtagggtctcaggtcctgacagcagttcgttgaatacttgtgctaatagaaatgtctcttgtaaagcacatgatgaagagagcttggatcangccttaataatcaaacatgacagtgggatgatgccttctagtaatcagacatcat

SEQ ID NO: 57129 - DNA, 125 bp, Zea mays
  Clone ID: LIB3069-036-Q1-K1-G1
cggacgcgtgggcctggattatgcgaggtcaatgttggccaatgatgccaaggctgccaagggaggaggcgatagacaattcaatggtcttgtggatgtctaccgcaagacactcaaatctgatg

SEQ ID NO: 57130 - DNA, 335 bp, Zea mays
  Clone ID: LIB3069-036-Q1-K1-G10
cggacgcgtgggtgaaaggaaggggtaatgttgtggaagtaagtgaaaagagtttggttaaagctatagctgcagctagcagtgagaacacacagccggtgtcttctgcatcagcagagaaaagtaaggcaattcctcgcggtgattcggttggtgatactttggcaaggcaactgggagtccagattgcatcttctgatgaacaggcaaaagctgccgaggacttcaagaagactttatatggtgttgttgatgatggaagtagtgatgaagacgagtcaacctcaaagactaaaaagatacatataaggatacgtgataaaccggctgcacct

SEQ ID NO: 57131 - DNA, 250 bp, Zea mays
  Clone ID: LIB3069-036-Q1-K1-G12
cggtaccgcaacgagctggacatgaacgttcgcctgggcgggcatgaaggacggagggggtagctataattatagacgatgaatatagacacacatcatgctgagatccgcaccagtatagaaaactaagctgcacgcctgtctgtaattcggatgtagaaacatctacaaggcatccatgaatacagattgcaaaatctgaccatcatttcaaaatatgcagagaactctacaacgactacatctgcac

SEQ ID NO: 57132 - DNA, 388 bp, Zea mays
  Clone ID: LIB3069-036-Q1-K1-G2
cactgggttcccgaggacaggatcctcattacctacctgtggtctgctgagctctccaagctcgctgccaacgcgttcctggcacagaggatctcctctgtgaacgccatctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggcctgcccgaggtggccaactactggaagcaggtgatcaagatcaacgactaccagaagagccggttcgtgaaccgcgtcgtgtcgtccatgttcaacaccgttgccggcaaga

SEQ ID NO: 57133 - DNA, 438 bp, Zea mays
  unsure at all n locations
  Clone ID: LIB3069-036-Q1-K1-G4
cccacgcgtccgcggacgcgtgggcggatgcgtttgaaagacatgacatggcgacctgatctatgtagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggccgcccaaatggcactgcagaggtggtgtttacacggaggagcgatgcaattgctgcactgaagcgttataataatgttctacttgatggaaaagctatgaagatagaagtcatcggaaatgacttangattgcctatgacacctcgtataaatggttgtggggcttctaatggcagagctaccagaacagttggtatgacgcctgagtttagtcaacgtggc

SEQ ID NO: 57134 - DNA, 339 bp, Zea mays
  Clone ID: LIB3069-036-Q1-K1-G5
cccacgcgtccggcggtgtcgtcgtggttctcgccgcgcgcatgggcgggatctgcgctctgcagcgcgcgtggtgacctaccacaggcacactgaccggctgccggctgggatactgagagactgcatgtctttttccgtgccgcgcgctggaattcgcacggccctaccacgagcacgtgccgtacggggcgtcagcgcgtgctggatcgaagagggatgcgagctgagagagcgcgcctgatgagaggctgagacgagacctgatgcggcccacacctgcacgtgtccgtataatctgttcagagtgttcgtaatcgatcttttcaaatttttctc

SEQ ID NO: 57135 - DNA, 372 bp, Zea mays
  unsure at all n locations
  Clone ID: LIB3069-036-Q1-K1-G6
cccacgcgtccggaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcngcgtcagcat

SEQ ID NO: 57136 - DNA, 267 bp, Zea mays
  Clone ID: LIB3069-036-Q1-K1-G7
gccaaacagatggcgtaccaactatgcattggacgatggaaagggtatcgagtcctctgctgcgtcaactgcgccgatgcgcactatgagctacatggtggtgctagttgacgtctgtagatataaggtactggccaattcgtcatgcgacggaatcaccaagctgcgatgctacaaccacagcagcaatcgcttggactcctgatggtacaagacagagctgctctacgacgtcgacgccaacgtgatcaaggaggagttcatgca

SEQ ID NO: 57137 - DNA, 420 bp, Zea mays
  Clone ID: LIB3069-036-Q1-K1-G8
cctcaaaagacatactcaagaagctagatactatggatgaagaaaatatcattggagcaggaggcttcggaactgtttataaacttgcaatggatgatggcaatgtctttgctttgaaaagaatagtgaaaacaaatgaagggctagatcggttctttgatagagaacttgagatattgggaagtgttaaacatcgttacttggtcaatcttcgtggttattgcaactctccttcatcaaaacttttgatatatgattatcttcaaggtggaagcctggatgaagtgctgcatgaaaagtctgaacagttggattgggatgcacgtattaacatcatacttggagctgcaaaaggcttgtcttacttgcatcacgattgttcgcctcgaataatacatcgtgatatcaagtcgagcaaca

SEQ ID NO: 57138 - DNA, 332 bp, Zea mays
  Clone ID: LIB3069-036-Q1-K1-G9
cggacgcgtgggcaaatttcttctttaacttgcttctcagctcaacctgcgcgttaatcagtttgagattgtaaatttttatgttgttggagcttctgggctaaatatcacaatggatatagctccctatactggaattagctttgctgctgatcaagtcaaggcaatgaattattcacttactctgcatacagttcggattgatcctgtgttggtcggggactataatcttcttaatttaacttggttcaggtcattggctccagctccagctccagcattcacaatggcacctagggcctctccatctacagcatctacctttccaagac

SEQ ID NO: 57139 - DNA, 368 bp, Zea mays
  Clone ID: LIB3069-036-Q1-K1-H1
cgaggacagtggtgatcacggggatgctttcgatcggctgtgagccgcagcagctggcccagttcgcaggcggcccggccggcgactacgaccctaccaccggctgcatcacgcggttcaaccagctcgccgagcaccacaaccacatgctgaggatgatgctgagggagctgcggaccaagtaccgcaggcgcaggcccctcaccctccactacgccgacatctaccgccccgtgatcgaggccgtcgcgtcccccgcctcgtacggcttcggcgacacgccgctggcagcgtgctgcgggggccgtggcggccccaacaactttcacttcatcgccttctgcggcacgccggcgtcgaccacgtgc

SEQ ID NO: 57140 - DNA, 333 bp, Zea mays
  Clone ID: LIB3069-036-Q1-K1-H11
cccacgcgttcggtcagccagatcttagtttcagcaggtgcaccaccctgcaatggccgctggccgtgtgcctagtgggatgtacgggcacgagcttgatgcgaagttgagatacagatgatggatgcctggatgcttcactccgtacagaggacctggaggtgtggtttgttgtatgtgcgtggtcactctttgcccaggctgctgtgtattatttctgctaacatggcttatcatcagccgacggtcgcgactgattggaggcctgcctcacttgtagggttgtagcatgtacatctgaacgggtgatggaacggagtgagtctaagatct

SEQ ID NO: 57141 - DNA, 413 bp, Zea mays
  unsure at all n locations
  Clone ID: LIB3069-036-Q1-K1-F4
gagagatgggatgtgctgcttccaggttttaagatgaggaggctgtcaagatgtgccgggacagaagggacttgatcaagcaggcactggagcagcgcaaccgatttgcatcttcccacattgcttacattgagtccctgaagcgtgtttcggtggctctccaacggtttgttgccggagatgatcaccatgagctaatcttcgatacattcatctcccctatcaagcaacagaagccagagatgcttggtctgccttatggttcatatgagaagagaactattcatgtttcaagatacctgaggtcagggcctaacccatcagtgtccattgaggagcacccacgtncggtggaaacagtccgtgtcgagtcaaattaccctatggacaacgacagtggcatggtggataga

SEQ ID NO: 57142 - DNA, 338 bp, Zea mays
  Clone ID: LIB3069-036-Q1-K1-D9
gccttcatcaggaatcacagcagccgccttaacaacagcaaccacaggtgcagcaggcgcaaccacaaaaacaagcagcatctgttatgcgcagagcatcatctattgctgctcggcaagcagcaatggcacagcaatctcaggagactaaacccgtttcatcttcgcccaagatcaagcgtcaaacatcagtgagatctggttcagtggcatccataaagcctccggtagctgcatccacaccaaaacctggcggtagcccaaataaaggcgaggtcaaacctgctgccggcccagttcaaactccaaccacaggtgccgattcatcaaatacccgg

SEQ ID NO: 57143 - DNA, 330 bp, Zea mays
  Clone ID: LIB3069-036-Q1-K1-E1
gcattggagggtactaatggaagccattttatgtacagggtgatctctgttgagtatgcacttcgtgatgacgatgaaaaaggtgaaagagggaacgggtacagcccagacaggagaggtcgtgaaagatccccaggtagaaggcgttctcctagtccctacggtagaggacgggagagaggtagcccagattacgggagaagcaaggagagggggagcccagactatggcaggggaggacgcagccctgataatggcaggggagtaagcccagctggtggtggcagaggcgatcatgccaggggtggagggcgcagtcctgactatgat

SEQ ID NO: 57144 - DNA, 333 bp, Zea mays
  Clone ID: LIB3069-036-Q1-K1-E10
catcgacgaggacatcagcgccatggtgggtatcctgaagcggggcttgggtgttggatgcatccactcatggctgtcgagcaatcagatgcagcgcgcgacagctacaggcggcttgccaggggctcacatggttgcaacaggccaattccgcacgccagcgatgaacgcaatggtccaggaggcccataggcatttggccagggaagcatctgcccatgatgcggggacatcaattgtttgcaagcgcgccgtcgagcttctagatgggataaacaagcgattcgatctctggtgcaagctggaccaggaattgccgcgcacgaaccaacc

SEQ ID NO: 57145 - DNA, 329 bp, Zea mays
  Clone ID: LIB3069-036-Q1-K1-E11
gatcgacgacgacaactacgcgctttcttttccgctggagactcgctggctggggaagagcgtcgactaatggttgacaggcaatcagatgcagcgcgcgacagctacaggcggctagccaggggctcacatcgatgcaacaggccactaacgcacgccagcgatgaacgcaacgctgcatgaggcccataagcatctggacagcgaagcatctgcccatgatgcggggacatcaactgtatgcaagcgctccggccagctgctagatgggataaactagcgagacgagctatgctgcacactacaccactaatagccgtgcacgaacc

SEQ ID NO: 57146 - DNA, 336 bp, Zea mays
  Clone ID: LIB3069-036-Q1-K1-E12
aaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctagg

SEQ ID NO: 57147 - DNA, 415 bp, Zea mays
  unsure at all n locations
  Clone ID: LIB3069-036-Q1-K1-E2
cccacgcgtccgggttcaccatgtaccattggctggtcagggacattgttgggccattagcacaggaatactgagatatatctagtgtttgtagttttggggtgaactcagagaagttgaaggtaacgacttggcttgcgaatatcagctgatctgcactcgggaaatatcagagagcttgtgcagaaaaggtaacagttatgggcttatggcagatgcagtagcatgagatgtcttcataattgttgtgtacatcaggttcagtggtacccccatcgtcaagctggatacgagtttggaaaaggtaactgtaaatcgagaaaattgtaaattgattagtgagctcactgcagcaatagttgttttcctacgtntcatctgggtattggtatgaaccaccggaaggatttccggt

SEQ ID NO: 57148 - DNA, 357 bp, Zea mays
  unsure at all n locations
  Clone ID: LIB3069-036-Q1-K1-E3
cccacgcgtccgccaccttggccgctgttttccttaccgctcgtgctctctctctctcggcgccgactcggctaccgccgccgccctacggaagcttcccaggtcttcgtcaggcttttctccggcaacgagcaccctgcacagatcgtgaacctncacacctcaacgatagatggcggggttcagaagccttgcacccaagaccaggaacctggtggtggccgggggactgtctgccttcgtgctcggggtctactactacaccatgagagcggtgggaggcacggacgagctacaggtggcgatcgacaagtttgaggagacgaaaagcaggatgctggtagaaacttcagcttc

SEQ ID NO: 57149 - DNA, 309 bp, Zea mays
  unsure at all n locations
  Clone ID: LIB3069-036-Q1-K1-E4
cccacgcgtccgcccacgcgtccggctagttagcacctagcagtcgtacacacgggctagcagtcgatcacaaaccaatcgcggagaggcaatcacgtacgtatacacacgggcacgtaactagctatctagctagcagtcgtagagtgacgatgaggggtctctctgttgcggtcgctctggtcgtggtggtggccgcggcctgcctcgccgcgccgcggggcgcggacggggcggncgagtgcggggcgacgcctggggacacggtggcgctgaggctggcgccgtgcgcgtcggcggcgggggacc

SEQ ID NO: 57150 - DNA, 363 bp, Zea mays
  unsure at all n locations
  Clone ID: LIB3069-036-Q1-K1-E5
cggacgcgtgggggcctccaacgtgttcatcaacaagcacgagcacggctgcgtctcggaccacggcctggcgtcgctgatgaacccggtcacggcgaggtcccgttctcttgggtactgcgcgccggaggtcgctgacacgaggaaggcgtcccagtcctcggacgtctacagcttcggcgtcttcgtgctggagctcctcacggggaagtcgcccgtccagataaccggcggcggtggcggcgacgtggtccacctggtgagatgggtgcagtcggttgtgcgggaggagtggaccgccgaggtgttcgacggcgagcttctgcggtaccccaacatcgangaggagatggtagagatgct

SEQ ID NO: 57151 - DNA, 404 bp, Zea mays
  Clone ID: LIB3069-036-Q1-K1-E6
acgcgtcgcgtgggggcttccaacgtttcgttcaacacgcacgagcacagctgcttgtcggaccacggactggcgtcgctgataaacccggtcacggcgaggcacacggctcttggatactgcgcgccggaggtcgctgacacgaggaaggcaggcgagtccttggacgtgtacagcttgtgcgtgttcgtgctggagctcgtcacggcgaactcgcccgtgcagataaccggcggcggtggcggcgacgtggtccacctggtgagatgggtgcagtcggttgtgcgggaggagtggaccgccgaagtgttcgacggcgagcttttgcggtaccccaacatcgaagaggaaatggtagagatgctgcagatcgccatggcgtgcgtgttcaggaccccccgagc

SEQ ID NO: 57152 - DNA, 319 bp, Zea mays
  unsure at all n locations
  Clone ID: LIB3069-036-Q1-K1-E7
cggacgcgtgggtttttctttttcttccatgttctgcatttcctgtctactactgatgagtgtctgaacgagcccgagaaatggaacattcccgacgacgaggtggacgacatggatgattgtacactgttctctgaatccttttccatgtgattgtagcctcatttttttcccatttccttttagtgtgtgctatgttggcatgccgttcttggcatgggatggaggcattgagctatgttttctggtttttttgtagtcttagatgactggtatttaatcatgcgatatatatatgacggngattttgggatgtaaa

SEQ ID NO: 57153 - DNA, 331 bp, Zea mays
  Clone ID: LIB3069-036-Q1-K1-E9
gctcgtcgccacctactagttgcttccttttccgttggagactcgctgactggtgaagatggttgtccaggagttcacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcatactgttcaggacgtagctatgatggctctgtttgggata

SEQ ID NO: 57154 - DNA, 327 bp, Zea mays
  unsure at all n locations
  Clone ID: LIB3069-036-Q1-K1-F1
cggacgcgtgggcggacgcgtggggttttggaaaggaagcaccggatcggagcaggcgatacggcgccgacgacaatggcagcaacaagggtttccccggttcttctcttgctgctcaccgtccagctcagcttgctcttccgcctccccgactccccctccaccctcgccctcgccctcgccgcggaaccagagcaacagaacgccaagcagcatcgccagcccgcgctgctggtgcagtcgacgtgcaactccaccagcttctacgacctctgcatcgacgcgctcgccgncgaccccgncagctccaccgncgacgtcccgggc

SEQ ID NO: 57155 - DNA, 334 bp, Zea mays
  Clone ID: LIB3069-036-Q1-K1-F11
aaaagaacatttgttgtgaggaaaggaggtcttcctgatgctgttgtttggaacccctgggacaaaaaagcaaaggctatgtcagattttggggatgatgaatataaacgaatggtatgcgtggaggcggctgctattgaaaagactgtcactctgaagcctggtgaagagtggactggaaagttggaactttctgctgtgccatctagctattacagtggtcagctagaccctgaccgtgtgattcaggattccactgtcccggaggactccatcagctagtccttattctatttttgcaggtagagcattgtatcattatgcataagagatg

SEQ ID NO: 57156 - DNA, 119 bp, Zea mays
  Clone ID: LIB3069-036-Q1-K1-F12
ctgatcatgtaatttatattggatatattaggcttttgaggagactggaagtagatggatcacgatcaccatgtaatttgtaaaatggggctactgttactgtaataaaggcacatgtc

SEQ ID NO: 57157 - DNA, 423 bp, Zea mays
  Clone ID: LIB3069-036-Q1-K1-F2
cccacgcgtccgcggacgcgtgggagattatgatgatacgtctgtccatagaattgatcatctccttcaagagatggatgcagcaaaattatgtagaatggattcatgtgatgggcaatataatttgtgtggcacggaatcaacatctggatcacttgcacaaaacattcaatccagaaaaaatgggggtgagcatggttctcagcaactgcaaaccctggatcgtgttgactctttagatggcttccagaagcatgacagtgaacattctcttttaaaaacttctcaagtatcgccaaagatacagcatgccgctgaaatcttatgtgatatgagaagaagcattgaatcgttgagtggccaaggatacagcaatggggtgattaaatggccaaaatcaccatccgaaaaggtgatgaaagc

SEQ ID NO: 57158 - DNA, 174 bp, Zea mays
  Clone ID: LIB3069-036-Q1-K1-D8
ctcatgctctcgttccgcacgcgttctattttccgatcgcttcggtttgcgttgccacaggcttacctctgtgccccagtcgattcgcgtgagcctttcttggaaggaacgatcgaacacacctgcatgatgatcaagcgcgcccgcgtgcagagcggcctgatcgaggactat

SEQ ID NO: 57159 - DNA, 332 bp, Zea mays
  Clone ID: LIB3069-036-Q1-K1-C11
ggaggatcgtggccagtgcttctgtggctgctgactgcagcctgcatcaaaactggacggccgcagattgcaagaagagcaatcgacctagcagagaggaggctgttgaaggatggctggccggagtactatgatgggaagcttggtcggtatgttggcaagcaggcgaggaaattccagacttggtccatcacggggtatttggtcgccaagatgctgttggaagatccttcacatcttggcatgatcgccctggaagaggacaaggcgatgttgaagcctgttttgaagcggtccgcgtcatggacaaattgagatggtgacgaaaattt

SEQ ID NO: 57160 - DNA, 335 bp, Zea mays
  Clone ID: LIB3069-036-Q1-K1-C12
ccatagggctatttataagccgcatggcttcagggaataaatcaaacaagatcattatcaaaccaatctctctctcccttgcaatgaccctctcaagcgcctagggctgctaccctagaaccaagcctatagcagaggggtataacctcgccggagaagacaactatccccatggaccgaaggtccatgacacctggtatcagctccaggttatcctcaccaccaccagccgcccatccctcaccaccaccagccgccgcgccatctgccgccgcaacgccctcccacccgccctctccaactccagatgcattcactcggctcgaagagaagtg

SEQ ID NO: 57161 - DNA, 429 bp, Zea mays
  unsure at all n locations
  Clone ID: LIB3069-036-Q1-K1-C2
cccacgcgtccgcccacgcgtccggctgtcccgtctcgtcctcttcgccagcgaaaaccctagtctaggggacgggagcgcaatccacgcacggcaacatggacgccatccgcaagcagctcgaccagctcatgggggccaaccgcaacggcgatgtacgggaggtcagccgcaagtactatgatcgcgacgtctgccgcctctacctcgccggcctctgcccccacgacctcttccagcttaccaagatggacatgggcccgtgcccgaagctgcactcgctgcaactgcgcaaagagtatccttccaagtgaacagntactntatcttgtgtatntgnttgtgggggttagtttttgagtcaggcttaatgtgtaaaagccaattcaacgattcataacattacatttgatttttttgtctgcttaa

SEQ ID NO: 57162 - DNA, 111 bp, Zea mays
  Clone ID: LIB3069-036-Q1-K1-C3
attacgcgtacgctgtttcgaacgggagtaccatttcctagtagaagatagagtactcggtcggctacggcacgatatggctggacacataccagatcatcgacgccaacc

SEQ ID NO: 57163 - DNA, 444 bp, Zea mays
  Clone ID: LIB3069-036-Q1-K1-C4
cccacgcgtccgcccacgcgtccgcttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaaggaaatttatccagatgttcttccttgcccctcaagagaagggttactttgtcctcaacgattactttcacttcgttgaccaagaacatgtgcagcctgcgccagtgattgctcaggaagactacgagaagcatttggcacccaacacag

SEQ ID NO: 57164 - DNA, 263 bp, Zea mays
  Clone ID: LIB3069-036-Q1-K1-C5
gaataatctcttcttcacctcactaacactagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgc

SEQ ID NO: 57165 - DNA, 309 bp, Zea mays
  unsure at all n locations
  Clone ID: LIB3069-036-Q1-K1-C6
cggacgcgtgggtagccatagtaatgaattagtgccaggaggagcagcttatgggtcacttgggtgttgtgctgtatgagtacttacgagaggagtatcctgaggtgcttggttcaattcttggagccttgaaggctatcctcaatgtcattggtatgactaaaatgactgcaccaatcaaggatcttcttcctcgtctgaccgccattcttaagaacaggcatgagaaggtncaagagaactgcattgatcttgttggtaggattgctgatcgtggagcacaatttgtgcccagcaggggaatggatg

SEQ ID NO: 57166 - DNA, 374 bp, Zea mays
  unsure at all n locations
  Clone ID: LIB3069-036-Q1-K1-C7
cggacgcgtgggtggcggggctctacgataagccgtcggagacgtacgccaagaagcgtccgcagtaccccaaggagtggttctccatgctggccggcctcaccgcggggcaccagcgcgcctgggacgccgggtgcggcaccggccaggccgccatcggaatggcggagcactacgagagcgtggtggcgacggacgtgagcgagggccagatccagcacgccatcgcgcacccgaaggtgcggtacctccagaccccggagcacctgtcggaggacgaggtggtgtccctggtcggcggcgagggctcccttgacctggtcgtggtggccacctncatccactggttcgacgtcccgctcttctacgccgtg

SEQ ID NO: 57167 - DNA, 262 bp, Zea mays
  Clone ID: LIB3069-036-Q1-K1-C8
cccacgcgtccgggcgaggggcgactggttgagcgcttcgtctagacagcccagctgcgcatttggatgcaaattacgtgtggaggatggagtaaaatactgagcaagggagagggaagaggagacggtcttttcttttcttgagccgaggagggggatcaggtggagtgagcgaaggggaggttctgccgccggcaatggagatgaatcttccggcggagagcccactctgctcccggggccggcccgccctagtcgtgcg

SEQ ID NO: 57168 - DNA, 300 bp, Zea mays
  Clone ID: LIB3069-036-Q1-K1-C9
acgcccacgcgttcgcactttcagatcaacaatatcattaaggcaggcgagcacaacctcgcggagcttgagctgttgtagatgcacaacatgacatactgcaccgaaattgcccactacggggacacccggaaacgcaaggagatcgtcgaacaggaccacacaactgggcatagcagtgaacaacaaactggccaggatctacaacctgtacggccactgaaatagacattagaaagcggtgatacacgctggcagacaataatggagcgaaaaacctgcaacatgacataccatgcc

SEQ ID NO: 57169 - DNA, 298 bp, Zea mays
  Clone ID: LIB3069-036-Q1-K1-D1
cggacgcgtgggcggacgcgtgggcggttgcgtgggcggacgcgtgggccgtgctccctccgctagttctcccatttccttccccacctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctcaggtttgcggatgattcatatctggagagctatatcagtactattg

SEQ ID NO: 57170 - DNA, 335 bp, Zea mays
  unsure at all n locations
  Clone ID: LIB3069-036-Q1-K1-D10
cccacgcgtccgcaaagatgctgtcttattagcagcaaaaaaggcaaaagaggctggaagcacccgtttttgcatgggagctgcatggagagaaaccattggaaggaaaacaaacttcaaccagattcttgaatatgtcaaggaaataaggtattcattggaatcttttgtttatatggcaaaagtatggtatatgacgcttgacctgcataaccatgcacaattgtctgtcacctatgatgtacaggtcattgacttaacagccttaattacatggaatatgaagatatatccagccagcaaaagttttatgcatgattcttatattntatttc

SEQ ID NO: 57171 - DNA, 323 bp, Zea mays
  Clone ID: LIB3069-036-Q1-K1-D3
cccacgcgtccgagcagacggggagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctc

SEQ ID NO: 57172 - DNA, 379 bp, Zea mays
  unsure at all n locations
  Clone ID: LIB3069-036-Q1-K1-D4
cccacgcgtccgctcatagagattatggattgacgctgcagctcttgaatattatgacccaggcctcaataaaaattaaagaagtcgagtgggattacctactacagcaaaatatgcatcaattcagcattgatgccctcgagggccttataaagtatctcagtactaatggtactaccaatgctgatcctgcagttgatttagtaagagcactgcagtcccaatgccgggacgataccagtactcaacagtttgaactctcttttcatggaagtggaaacaaatattcatgtagcagtctggcagaactagatcagctcacttgcaagaacttgtgcactgatataattctggacgntcctggttctgatagagagat

SEQ ID NO: 57173 - DNA, 359 bp, Zea mays
  Clone ID: LIB3069-036-Q1-K1-D5
cctctgccccctcctccatcctttatcatattcagacggtgaagcacccagtcccagttcaggttcaaacagacgctccgcacgagctggagatggaggtggaggtggccaaatattcacgggggcagggtgctgacctgaaggcgctgggggacaagaagttgaaagggcagctcagtgtaaaagagaagctatatggccaatctgcaaaagctgctgcaaatgccgaaaagtggcttatgcctaatgatggaggtattttagagcctggtcatttggagaaaacatatagattttcacaagaggatatattgacagaggtggatcttttgagttcaagaaaaccatttgatatgatc

SEQ ID NO: 57174 - DNA, 367 bp, Zea mays
  Clone ID: LIB3069-036-Q1-K1-D6
gctgcatttgaccccaacgatatgttgagtgaagtgagtgctaaactttccaaagccttacaagcacatgttcaagatgccattttggatagccgagaggatggactcatgagtgataggaaaaactatcctttgagtatgcttgccattcatgctggtcccagattgcggcttcttctgatcacattccagcttctggaaatggaggtaagaaatatctctggaagttctgaacttgatggaatcaggtggatgcaagtatcaactaccttgatagatagtttaattcaaccagtatttatgaaatggattgaagaagaacatgccttggaaaatggacaaatcaacgaataacttatgaagacga

SEQ ID NO: 57175 - DNA, 363 bp, Zea mays
  Clone ID: LIB3069-036-Q1-K1-D7
cccacgcgtccgctccgctcggccaccatttttgaccgccttccctcccctcgtctcctgtgttcctacataccccactccacccgcaggagcggcgcggcggcggcaaaggcaaaggcaaaggcaagatgttcgggcgcgcgccgaagaagagcgacaacaccaagtactatgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgttgagattatgatcagtatggtgaagatgcccctt

SEQ ID NO: 57176 - DNA, 413 bp, Zea mays
  unsure at all n locations
  Clone ID: LIB3069-036-Q1-K1-C1
aggacgagaagattgcgtccaagctgccgtccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggnccagtcgctgccgcgagttatcggcgtcggtcggtgcggtgtgtccgttaaactttaattgtggtgggctggtacttttgggggtgttatttttttt

SEQ ID NO: 57177 - DNA, 397 bp, Zea mays
  Clone ID: LIB3069-012-Q1-K1-F8
caaggaccttcggcgcccgttcaggatccacatcttcccgagcgagttcttggttgacctgttgctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccaaggtgatcag

SEQ ID NO: 57178 - DNA, 348 bp, Zea mays
  Clone ID: LIB3069-012-Q1-K1-F9
ggagatgcctagcactgatgataactcaaagtttattggtcatcggtctacaagtcaagaaccgacatattcagctaaaaatattgctgataatggcaaagtaacatccgggactggtgaaaacaaggttgaattcacttcacagactgaaaataatgttgccgggaatctaaagtccaccttgcaaacgattgtacatggaggtgttggctatcatatggtaaactgtggtttgatactgttgaagatgttatccgaatacgttgacatcagtaaatgtttaccatcactatctttggaggtggtccaacgtgttgtggaaatattaaagcttttcaacactaggac

SEQ ID NO: 57179 - DNA, 350 bp, Zea mays
  unsure at all n locations
  Clone ID: LIB3069-012-Q1-K1-G1
gtggtgggcaagagcaggggcgacacggtcttcaccaccatcgtcaacctggcggaggaggccaagctcgcgcgcgagggcgtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaaagtntttagcta

SEQ ID NO: 57180 - DNA, 269 bp, Zea mays
  Clone ID: LIB3069-012-Q1-K1-G10
cccacgcgtccgccaacgcatggacatactcgtctgcgcacttggaccagggataataggtttcattgtcgtaccggggttgaacatttatactttgtaaactccgcaacttccaacacccttagagctatatccactcttacgactactacttacggtgctaccatcgagactattcatataaggggataggcgtccgacgtctagcttgttctaagtttctcaactgcaagggtgctactgcttacgcgcttggaatgctatcgttc

SEQ ID NO: 57181 - DNA, 407 bp, Zea mays
  Clone ID: LIB3069-012-Q1-K1-G11
gaagctgagacgacgatgaagaacaatgtttgaaccctagaagcgtcaaaagatggcaaagtgagagatgccagaaatggagaaaacaatggcactgaagatggtgggaatgaaggaatgaggagtgggaatgttggtagcaatgcagaagctgaagagtctcacggtcatggaaataatgaacgcgcagaacataccgaagatgacaagggtcaggaatgtagccacaatgagaacagtgcaagtgtaggaatccttggcgatggagacagtgaagctagagaaggcgatataaatgcggaagcggaacaaagtcaagcagacggtggcggcaatagtaaagcggaagatgctgagcacaatgaatacaccaaaactgacgccaattcaagcaagaatggtactac

SEQ ID NO: 57182 - DNA, 226 bp, Zea mays
  Clone ID: LIB3069-012-Q1-K1-G12
cccacgcgtccggttcggaacgccaagctttccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaagacctgcaccggttcgtcaagtggcccaaggtcgtgcgtatccagcggcagcgccgc

SEQ ID NO: 57183 - DNA, 215 bp, Zea mays
  Clone ID: LIB3069-012-Q1-K1-G2
caggttcagatgacatggttaaaatcacagttgcagggggactctgaactggcggaggaggctcatgttatacatgtgggcgtgaaagcacccgtccacgagatattcatgatctgcaaattgctcatctccggctatgtatccagcgtagtgtctatggctgctacagctccacttgaaccatcgaaaatattgctagacgtttaaaatccgca

SEQ ID NO: 57184 - DNA, 370 bp, Zea mays
  Clone ID: LIB3069-012-Q1-K1-G3
cggacgcgtggggcagtggaaagaaaaaggtaactctcaggcttgatctggtagagcaatcgtcattgaagtacaaggatgcagactttatcattttcaatacggggcattggtggacacatgagaaaactgctcttgggaaggactactatcaagaaggtaaccatgtgtataatgagctgaatgtcatggatgcctttcataaagctcttctcacctggtccaagtggatcgatgccaatgttaaccccagaaaaactctggtgttattcagaggctactcagcatctcatttcagtggcggacaatggaattcaggcggtggctgtgacaaggagaagtaaccaataaccaacgatcagtacctttc

SEQ ID NO: 57185 - DNA, 292 bp, Zea mays
  Clone ID: LIB3069-012-Q1-K1-G4
ggcaggctgtggaactggcagcatggccctattagcgttgctcgatctcctcatcgctactggatggagagcagttggctagttgttagcggtttccctagtttctcttcctcttgtgttccccgtttcagtttgcttatagccccgaagactcttttctcccgtagtgtcggaatgccagggtctgtccctgtgggtgtgttgcgtaactgggatccgagtataccctgctgtgttcgtcgttacattgaatggatctgaatgaaagtgggttagattggagcttttcttc

SEQ ID NO: 57186 - DNA, 383 bp, Zea mays
  unsure at all n locations
  Clone ID: LIB3069-012-Q1-K1-G5
tcggggagctttgacgcgccgtcgcaaaagaatttttgctttggtcttgccaaggccaaaaatggccacccttaccctgggcaggattatcaactttgacaaggtccagtctgtggttaagccactcaacagggaggtgaagcgcanggagaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaagtcaaggctgccggcaaggcgtggtacaagaccatggtctcggacagtgactacaccgagtttgagaact

SEQ ID NO: 57187 - DNA, 353 bp, Zea mays
  unsure at all n locations
  Clone ID: LIB3069-012-Q1-K1-G6
agcgaaaccgaaagagagcaaagcttggcattggagctcccgtggggaatgctgctgccgctgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggggtggacggtgcanggccacgtggagtacgtctcgggcggtccccagcccgggggcatgttcttcgcggtgccgcacggcgtgcacgcgctgcg

SEQ ID NO: 57188 - DNA, 330 bp, Zea mays
  Clone ID: LIB3069-012-Q1-K1-G7
cggacgcgtgggcgctagggctcgccctttttttttttttttttttccagtacgacatgatatgatgcaatacatagatacggtacaagaggttaactgatctgatcggatcggacatttatatcccagctggggcagcatgcaatgggcattcttcagtttggtctgaacggccggcagtaatataatggtgatcttggagcctcatgacaaacaagaggagacagcaggggaaagctagatgcgttttgagacaatgcatgatgcttcgtcacgtacagtatttgtaaatgccaactgctcgtgtccatcaaattgatgaatgggcta

SEQ ID NO: 57189 - DNA, 372 bp, Zea mays
  Clone ID: LIB3069-012-Q1-K1-G8
cccacgcgtccggaaaagggtcaggcgcattgtgcggaaatcacaggaaatgttatgaagaaaatggaatactggggaagtcaaccgtgccatgtcaggctacgagattttgctttcaacctcaaaatgctcatctgacatcttgtgtattttccatttagcgtctgttcattggtgcaccagaaatgcattgggacgtggtgtatcgtgtggcctgggctctactaatgtttgacaatcctgaagtgccaccagtggtgaacctggtataagcaggcgccattcatgtcagctaatcgttgagaaaacatatcagtgaaatcgtgcaactgttagtgtaatgaggcagttcctgcttacatattattactc

SEQ ID NO: 57190 - DNA, 444 bp, Zea mays
  Clone ID: LIB3069-012-Q1-K1-G9
cgggcaacggtcggaaaggagctggaagatatataaaggagacattgtgatatgacttcaatactgcatgcgctaggcatctcagttgaaggtggtgaggttaaagccttcaagcaagctcttctgaaattccatcccgacagggtatcaaggaatgatatttatcaacaagtaaaagcagaggagacatttaagttcatttcgcggctgaaggagaagctacctcggctatcctaatagccatcccactcttttttccacatgccttggcgcatcctccattcacctgtagggtcaaggtacagaattcagaggatgtttattggcgttatttacaagtaactagggctttagcttgttaaatgtgtttttgtgtgtgtgtgtgtgtgttgggggttgggttgggtaggcattcctgtcaactatgacatgggatggtaacca

SEQ ID NO: 57191 - DNA, 443 bp, Zea mays
  Clone ID: LIB3069-012-Q1-K1-H1
cccacgcgtccgcccacgcgtccgggctgtgtagcctcttccccggaaaataatttgacgagtgtatagaaaatgtcaaggttggagctagtgttcaaaagaccacatatacaatgaagagagacatgctcaccgctcacggagagaaggtcattcttcgtgcccttgaaattgagaaatcccggctgccacactcaaagggtatttgagtacctgtggatcttctgtatccataaaggatcagatcccaaaacccattggtcaaactactgaatgcagtaaacagggcatatcttatatctgagattgtagatccaagatgcagatcagcggctttgtcacccctattggtcctttatctgaagaaaatcacacgatcgacaagaatttgttgccgctggagtgtgaagggacaatggaatgccacacacgagacaacgatg

SEQ ID NO: 57192 - DNA, 278 bp, Zea mays
  unsure at all n locations
  Clone ID: LIB3069-012-Q1-K1-H10
cccacgcgtccgcccacgcgtncgcttacgtgntgtcggacgcgtgggcttgcgcgaagggggttacgccccctgtgcctcgcttccatgagaccccacagcagcggcaggaaacattcccacaccagacgccgagatccatgccagtggctcgatcttcctcaacgatggctgcctatccgacctcgctgtggacctgctgctcgccgtcgcgtgtgcactttttactccgagcagaagccccagatctgcgcaagccccgcgttattatcgacctc

SEQ ID NO: 57193 - DNA, 319 bp, Zea mays
  Clone ID: LIB3069-012-Q1-K1-H11
ccgcttcaacaagcagcgggcgggtctcgggctgcgcgcgggcgcttggtggacgacgctcaagcggaggcgggcagcgcttgggagtcaggcgtgcgaccttgcggctgtgctcaggcggggcgttgcgtgaagcgctagggagtcgggtgtgcgacgggcggcgctcgttcctcaggcatgtgcggacgacgctcagacgcatggctgtgtcgaccacttgcagacgacgccgacacagatccaggtccaggtccaggttaagtattggtttttggtgtgtggacgtgattcttctagtgagatatgttctgaagcg

SEQ ID NO: 57194 - DNA, 340 bp, Zea mays
  Clone ID: LIB3069-012-Q1-K1-H2
cgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgatggtgccgtgtgccggagacccgtcgacgtcgagccttgggaaacaacaatgaacgcaatggcctggccagtgaatgaaagtatataatattgtaataaagcagagacgta

SEQ ID NO: 57195 - DNA, 411 bp, Zea mays
  Clone ID: LIB3069-012-Q1-K1-F7
agctcgcggtcgcggtttcttgcgccactctggctcagccgccgcccgccacccgccacagccgccgcagacgagatgggcatcaagggtttgacgaaactgctggcggacaatgcgcccaaggcgatgaaggagcagaagttcgagagctacttcggccgcaaaatcgccgtcgacgccagcatgagcatataccagttcctgattgtagttggaaggacaggcatggaaactctcacaaatgaagctggtgaagtcactagtcatttgcaaggaatgttcaaccggacaataagattactggaagcgggaatcaagccagtttatgtttttgatggcaagcctcctgatatgaagaaacaagagcttgctaaaagatactcaaaaagagatgatgcaacccaagatctg

SEQ ID NO: 57196 - DNA, 422 bp, Zea mays
  Clone ID: LIB3069-012-Q1-K1-D9
actaggtctattggattgccggttgagatttgtttttaacaaattttgtgccaaggaaatgggaccttaatttcccaatgtatgtgttgttacttgtacacctagatgtatcaccagaatttattgatattatatattctgtatatgttgcacggcagttcctttttgcggatagaaggaatttgccattttcgacaggcacggcagagctaaaactaaggtacagactgtagatttgggtagatttatccctcttaataaaacactgaatagttccatctcgaggcccaggctgcttcaaggaaacaagaaaagtgatttttccagaaaactctgggctcttgacaatctctctacacatctctctccatgttctgcagacagctgcacaagcaactacatgtttcctagaaggccatgta

SEQ ID NO: 57197 - DNA, 177 bp, Zea mays
  Clone ID: LIB3069-012-Q1-K1-E1
accgggccgacccacgccgttgatctccactattaactttccgccaatttataattactgctaagaccccaaacacaaggcgcgactttaagaacggtgtgcgctccctctactacacctcccttgttagaaaaggacagcttctgtttctaaagctactaatgccgtcagaaagcc

SEQ ID NO: 57198 - DNA, 414 bp, Zea mays
  Clone ID: LIB3069-012-Q1-K1-E10
gtcttcgtactcgcctacctccgcggctcatacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaagaggatgcaaccaacaactttgcccgtggtcactacaccat

SEQ ID NO: 57199 - DNA, 322 bp, Zea mays
  Clone ID: LIB3069-012-Q1-K1-E12
ccgtccggcctactctttcttggataattgactctggatgattgacacagacaagcacacagctcaagctgcaggcatgttgtgcgtgcatactatcgtgctgaactattctgaacaatatctgagataataactaacaaagaaccagacctacaacagagcttacaaaatagcgttgagtgctgtgaacagtgctaagaacctgattatgatatgaagtatgacttcatgtaagactacaacggacctgatgctggacgatatgcagctggatgggcttgtggcgatcctcatgaacatcctgatgtacgcacagattgag

SEQ ID NO: 57200 - DNA, 265 bp, Zea mays
  Clone ID: LIB3069-012-Q1-K1-E2
cccacgcgtccggccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcagctcctgcatattcccccgggctccaaagacgccgccgtcttcagccccggcggcgacaagggctccactgccgctacagccaaggacaactcgacggcgacgaccgacttccgcgcgct

SEQ ID NO: 57201 - DNA, 284 bp, Zea mays
  unsure at all n locations
  Clone ID: LIB3069-012-Q1-K1-E3
ctggaatgctacccaggcatagcttgctaccttatacttttgcttgtgaganggcgggagtactataatatgttgggtggacttaatgattgngaatggtatgtgttacataattgtttaaatggaggtattggttgantgatgaggattaattattgaaaaaaaaaattgggggcatgtggtagataagtaatgatgtttaaatagagagaaatagattatttatttaaattgttatgatatatatatttatatttatgtatatatatatatatatatatata

SEQ ID NO: 57202 - DNA, 405 bp, Zea mays
  Clone ID: LIB3069-012-Q1-K1-E4
ccacgcgtccggccgagactaatgaagaataagaaactacgccttcatcaagacgaagatgtctggtctgtctcggcgctgttaccttgatcagcgcgacaggaccaccaaacggactcgctgcggatgcgatgaacaaggccggggtacagaaagctgtttgcaggaactgtaatggcagtggtgctgtgatatgcgacatgtgtggtggcacagggaaatggaaggccctcaatcggaagagggcgaaagatgtttatgaattcaccgagtgcccgaattgctacggccgcggaaagttggtgtgccctgtctgtctcggaactggcctgccaaacaacaaggggctcctgcgacgcccagaagccaagcagctgctcgacaagatgtataacggcaaagata

SEQ ID NO: 57203 - DNA, 413 bp, Zea mays
  Clone ID: LIB3069-012-Q1-K1-E5
gtcttcgtactcgcctacctccgcggctcatacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaagaagatgcagccaacaacttttgccgtggtcactacacca

SEQ ID NO: 57204 - DNA, 429 bp, Zea mays
  unsure at all n locations
  Clone ID: LIB3069-012-Q1-K1-E6
ctgggcactatgaagttttggccagccatcttgaaatgctgttgcctggaacctataccagatcagagagatggtatatccttgcactttgctacagtgcagctggcatggatgacagtgcgttaaacatcataaggaatggtttttctgtactggagagaaagggaaagcctcatgttccatctcttcttttaggagcaaaactatgttgtaagaacccaaagcatgcttccgaagggataaagtttgcaaataaagccatgaagtctttcagaagtcgtgatctgcatttcatcagcactacaaaacactttcttggtgtttgttatggacctttttctaggtcctccacctcatacttggacaaatcgagactgcaagataatgcactgaggctgttgcangatgctgccacaacagcgaagtata

SEQ ID NO: 57205 - DNA, 300 bp, Zea mays
  Clone ID: LIB3069-012-Q1-K1-E7
accagtgtctattctttaccctgcgcggttcttcttaatctctaatgatctgaaacagaggaacagagtaaaaggagcagagaaagcttcatcttctaggctttccttgttagaaaaggctgcttctgttttgaaggctactagtgccgggagaaagccctctgctgccaattcgatcagtagctctgtgttaagtattggatcaaggccaaaggccttgagaagaagctgggaaggaaacacggatattaaaggaaaaggcaattcagaatcaaagacagccaaacctgacaagaagtc

SEQ ID NO: 57206 - DNA, 316 bp, Zea mays
  unsure at all n locations
  Clone ID: LIB3069-012-Q1-K1-F1
ggcttctcctccccctccggttcgggttcgggttcgtgaggttctccggggttcggtttcgtgggtgagcggatcgagatggcggcgtcngatgttgagtaccgctgcttcgtcggcggcctcgcctgggccacggacgaccactccctccacaacgccttcagcacctacggcgaggtcctcgagtccaagatcatcctcgatcgggagacgcaaaggtcccgcggcttcggcttcgtcaccttcttcacggaggaggcgatgcggaacgccatcgagggcatgaacggcaaggagctggacgggcgcaacatca

SEQ ID NO: 57207 - DNA, 445 bp, Zea mays
  Clone ID: LIB3069-012-Q1-K1-F10
attcaggagtgcctaatccagggtctgaatactgggacgttggatttacaagtcaatggctggggccataaggctgcactggaaggtgaggacaaggagatctactcagaaaaaggtgtgggcaaagttcagtggaaacctgccgagaacggccgggcagccacttggtataagagatacttcgatgagccagatggagatgatcccgttgtacttgacatgagctcaatggacaaaggaatgatttttgtgaatggtgaaggcgtgggtagatactgggtctcataccgaactcttgctggaactccttctcaagcactataccatattccgcgtcctttcttgaaatccaaggacaaccttttggttgtcttcgaggaggagatgggcaaagccgatggcatcctcgtgcagaccgtgacgagagacgacatatgtctgttca

SEQ ID NO: 57208 - DNA, 372 bp, Zea mays
  unsure at all n locations
  Clone ID: LIB3069-012-Q1-K1-F11
cggacgcgtgggcggacgcgtgggcagagtactgaagcagagcgagcgagctgtccggccaaaccctcacggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcangcgctggtggcgc

SEQ ID NO: 57209 - DNA, 121 bp, Zea mays
  Clone ID: LIB3069-012-Q1-K1-F12
cggaaaggctgttttgtggtgtgatccggtggtgttcttggtgttgttgagaactgctttggtttggtgtatcagcttttgttgccgggtaaaacgcctgtgagctgtgatgtgatgcttc

SEQ ID NO: 57210 - DNA, 360 bp, Zea mays
  Clone ID: LIB3069-012-Q1-K1-F3
gctagcagccgcctcctcgtcaggccctttttccttcaccctcgccaaacccgcctcctgcggtccgaactccgtctgcttcatctgagcgtccgggaggacaaaacacgcggcgaggaccaggatggcgattgtgcgggaggaggcagtggacacgtccatcagcccaagggtgagcgcgctgcggccgtccaaaaccatggccatcaccgatcaggccatggcgctgcggcaggccggcgtgccggttatcggtctagccgcgggggagccagacttcgacacgctcgccgcgatcgcggaggccgggatggatgcaattaggaatggttatacaagatacactcctaatgctgggac

SEQ ID NO: 57211 - DNA, 384 bp, Zea mays
  unsure at all n locations
  Clone ID: LIB3069-012-Q1-K1-F4
cggacgcgtgggtgctaactgagaagctgtttttgctagtctcaagcccatacttggtggatctaggatcgcctcggttcatcggtgttcctcctgacccgcagtggtcgatcgacacggagatgcacctcaagagcgttgttcatctggacaggtctcaggaggtagtgaacattgttgggagcaacggacagacctcacctagggacaaaagaggtggcacgagaaacagggtcatgagctcggccttcgtccccctgtttcacctcagcatagagctgccaaatgaggaggatgcagaagggacggtgcaggtcctacaggcactcatcgagaagggcaaggcacggaggtgggacaagaacatnctacaccggagcaaca

SEQ ID NO: 57212 - DNA, 305 bp, Zea mays
  unsure at all n locations
  Clone ID: LIB3069-012-Q1-K1-F5
acgccttcgganaaaaaaaaaaacttgataattttacgtcaagcccacacttnaagggggtgtttttggacgggcgtctgggaggtccaaactacccgaccctctcaaaaaacagcgtagaccatcttaaggggaaacttaaattaaaaccaagggtcaggcgcgttcgatcagagcaacgagcaacacacagacgtaaccgaacgacaaaagatgtacatgcacgcacacgtccataaactgagtaatcgtaaaaacgacagcaccgatcaaaaatctcacaaataccgaagtttcactgggaa

SEQ ID NO: 57213 - DNA, 421 bp, Zea mays
  Clone ID: LIB3069-012-Q1-K1-F6
gtggagaccctggccacgttcataacgctggacgcctcgtaccgctgcagcgaggccagcgagcgggagctggagctagatcccggggagcaggagcggcggctgaccgtgatcgcgagcaacccgctgcggcgccgcgccagctacgacctccaggacagcgtgcagcattcggcagcgtccaccgtggaggtgcgcgccacggccgccgacagcatgagccccagggacgcggagatcagctcggcggcggggccgaagcaggtgcggttcttcatcgacagccacgtggtgagcccggaggccgcggagaacaagcaggtggcggatgagctggaggcgctggcggcggcccgggaagccggcactgcgttcatcctggggcattcgcacgtgcagtgcaagccccggtcgttggtgc

SEQ ID NO: 57214 - DNA, 440 bp, Zea mays
  unsure at all n locations
  Clone ID: LIB3069-012-Q1-K1-D8
cccacgcgtccgaggcttaaattgagttgtttgttttgcaaacagcgatgatgctgcctaggggttgctcaaagaattctgagcgaactcactgcaagagaaatttcaaaagcttatgctcaatgacatgaaagagctctcaagaattcaagctgaagttggtctacagatgccactgatgtctccgcttgattctgatgaagaaaagtattctgtggcttctgattctgtttcttcagctgatcatgagaaggctcaacatggtggaaactcatctgactcacagaatattgattgtgatcataccactgaagattttgaatccagtgatactctcttaacgaacagttcatncctgcctccccagcctcaaccacctgtgcctcctcatatggactcctgatatcgatttatccgaactggagagcttgttctccact

SEQ ID NO: 57215 - DNA, 349 bp, Zea mays
  Clone ID: LIB3069-012-Q1-K1-C12
gatttgaggtcgtttttgcaaaggatcttgttcatagattttccttgcccgtggtaccgggcgatggatcccacctacttttcatgggctcacttccaatgcacacgcccaggacggatcgtcacccgtgcaattgtcaatacactagagttcctccgtattgccccagcaggcagcatgggagcctacaacgtcctgatgagtgcctctgatggccttctaaaaggtggccgggaaggtatcttcacagcgaccttcttcgtcctgggccgcaagcctatcaaggaagctgatatggtgaacggcggcgtcctttgagctgcaacattagtatggggttgtactcata

SEQ ID NO: 57216 - DNA, 334 bp, Zea mays
  Clone ID: LIB3069-012-Q1-K1-C2
gcaactccctcgcttcctgcacccacattttcgcggcgctacctgcctacccagatcccgctcgccggtggtgccctcctcagtcctcactctcccgccgctggcgccgccggagcgagggggactgcccaaaccctactaggactagcagtaggaggcggaggggcgagatccggcggaggccgccccgatgggggacttcaacgtggcactggtgatcgtggcggcggtggtcagcgtgctggtgctgctcgtcagcgtctaccttctcgtcaactaccagcaccccgacgacgtcaaccaggcctacttccccaagctcgtcgtcgtgctc

SEQ ID NO: 57217 - DNA, 370 bp, Zea mays
  Clone ID: LIB3069-012-Q1-K1-C3
gaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcttgttttttggcgatcctcaagacaaaagtggggtggcatcagatagcagcttgctcgttcatcatagttgtcggggtttgctgtgcctacgtgggaacatactcgtccctgtcgaagataatccagaactacgcatagcacagctgttcctgtgatcctgtatatgcatctgcccgacaaaatcatgtgtgtgctatat

SEQ ID NO: 57218 - DNA, 393 bp, Zea mays
  Clone ID: LIB3069-012-Q1-K1-C4
cccacgcgtccggtgccacggagttggcaactgcaaggagtgatattgtggtacaacactagttctaattgaagtaataaggcggggttgaaactgtctgctaccattgcttccatggcaactaatgagaacctcccgccaaatgtcatcaagcaattggctaaagaactgaagaaccttgatgagtcacctccagaagggattaatgtgattgtcaatgatgatgacttcactactatttttgctgacattgaaggccctgctggaactccatatgagaacggagtattcaggatgaagctattattgtcacgcgatttccctcaatctcccccaaaagggttcttcttgactaaaattttccatcctaacatagctactaatggtgagata

SEQ ID NO: 57219 - DNA, 432 bp, Zea mays
  Clone ID: LIB3069-012-Q1-K1-C5
ctagagttgtgcccatcatctctagtggttaggaatctattggtgcatctgaccatcaggatcacggtgaagatgacgacagcaacggcgatgcagatcagcccttgatcaacacgatcaggtcttccgccgccaagctacggtccttgaagatctctcaacagggaccaagcagccaaaaaggggtccctggcccatccggaagcaatagctgagaggatgcatgcagtgcccctcatcgttggtgatgatttccagacattgactgaccgattcaagcagcacagggggctggcactaacatcagtttgacgaggacaccattccacgcggagctgcagtcatccgctggttagctgcttggtctaattgtgtaagcgctgtatatgatttgcacttgggttctgtgactccctttggatgcgggcccct

SEQ ID NO: 57220 - DNA, 316 bp, Zea mays
  Clone ID: LIB3069-012-Q1-K1-C7
aatccgaattgccaggattttcaacacctattttccaaggatgaacattgacgatggccgtgtggttagcaacttcattgctcaggctgtgcgtggcgaaccccttactgtccagaagccaggaacacagactaggagcttctgctatgtcgccgatatggttgatggtcttattaggctgatgaacggaaacaacactggaccgattaacttggggaacccaggtgaattcaccatgctggaacttgcttagaatgtgaaagagttgattaacccagatataacagtgacgatgaccgagaacactcctgatgat

SEQ ID NO: 57221 - DNA, 376 bp, Zea mays
  Clone ID: LIB3069-012-Q1-K1-C8
ccttgtagctgacttcaaccacatggtaccatcttagcagagtagcaatggctatcaaacagagcatcagcttcacgctgcgtgttcttgctgatctatccctcctactcttttgcgtcctgcttgcacctgtatgttcagccacaccagccacagctcctgctgttctcctgcaagtgaagtccggcctcactgaccccggaggcgtcctctctggctggtcactggaggccgacgtgtgttcatggcatggtattacgtgcctgcccggtgaggtctcaccgggcattgtgacaggcctcaacctgtccgggcacggcctgtcaggcgtgataccgccggcgatgagtggcctcatctccatcgagtccattga

SEQ ID NO: 57222 - DNA, 407 bp, Zea mays
  Clone ID: LIB3069-012-Q1-K1-D1
cccacgcgtccgctctttcccagccctctctctctccctctccacccggccgccaccatgtcaggcctctacagccagggcttctcccctgcaagaaccctctccccccagattaggagcaaccccgacgctgacagccagtacttggccgagcttctcgcggagcatcagaagctggggcccttcatgcaggtgctgccgatatgcagccggttgctcaatcaaggtgagagatccttttttttccacccctcgcttgctcactgttgcttgctgattggtgacaaatcctgtgcgctcgagcctccgagggtgttcctctgcaatcgggactggggaatcgcgaggcttcaatgatcggatggctgctgatcttttttctgcggcttttatgctggcgggggatg

SEQ ID NO: 57223 - DNA, 224 bp, Zea mays
  Clone ID: LIB3069-012-Q1-K1-D10
cgggggccgggacggcgtcggcggcggtgagctgcggcgaggtgacgtcttcggtggcgccgtgcctcgggtacgcgatgggcagcgcggcgtcgccctccgcggcgtgctgcagcggggtgcgctcgctcaacagccgcgcgtcgtcagcggcggaccggcaggccacctgcaactgcctcaagagcatgacgggccggctcggcggcagcatcagcatggcc

SEQ ID NO: 57224 - DNA, 431 bp, Zea mays
  unsure at all n locations
  Clone ID: LIB3069-012-Q1-K1-D11
acaaaccctnctncagtgctcttttctttcttctcgccgccgcaaccgcttgctagcgctctgcgctctcatcctcgcgtccgtggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaacctggtaccatngcacgatctggcacaaaagagttcatggaggcactgg

SEQ ID NO: 57225 - DNA, 260 bp, Zea mays
  Clone ID: LIB3069-012-Q1-K1-D12
cccttgaatgctttcagaacccaacttcaatgctgctgtgaagttaggatggatgagacctaacacaattttttgtcatgttaaataaccaggccaccaaagagtggcgtctccaaaccaagagcacagagccagtcttctccgttttgatattgccattgttaagtaggatcaacgtatacatgcattattgggggtcatttttgggtttgtcctcacggataattgatggaaataaatatgaaagaagccaatcttgg

SEQ ID NO: 57226 - DNA, 381 bp, Zea mays
  Clone ID: LIB3069-012-Q1-K1-D2
ctccagaaagacctccactgaatcttctccggcaagaactagctggaacaacgatttattgagatatcctccataaatcaacagtggagcaggatgaaaaggactccattgaggaaacaaatggtttaaatgtggaatctgatgaccaggaaaagatcaagtacctagcagaagggaagctggtttctttttgcggacaggttttgaaagaggcgtctgatttacagcctagcactggggaggctgccagtgcagacatacatcgtgtattagacttacgggcacctgttattgttaaggttttgaaaggaatgtgcatcatggatgctcagatcttcaaaaggcacctgaaagagttctatccattaattaccaaactta

SEQ ID NO: 57227 - DNA, 349 bp, Zea mays
  Clone ID: LIB3069-012-Q1-K1-D3
attcaagccctgtggattttgtcagtgacttgggcactcgcttcctcctcgatccaagtgtcctgaagatgtctgaacctcctcgtgtcttgtcatggatgactaagggcattgcctcaggtcttgatgttcttttcataaacaaatttgaagaacaacgtaaagattattgggaaacactatactcatcggtgcattttggtccaatactaatactctgctcagaggatgatcaacttgctacatattcagttgttcaaaattttggccagcatctgctagagcttggtggtgatgtgagcctaattaaatggcatagttctccgcatgtcggccactacaagcacca

SEQ ID NO: 57228 - DNA, 260 bp, Zea mays
  Clone ID: LIB3069-012-Q1-K1-D4
agccagcacacgcacactgttctttcgacttccatctcggccggagcagaagatggaggtggctctgggaacggccaagtatctccttggccatgttcagaacaatatctccgacgactggatgaattcctacgtgtccagcgccgagctcggcaccaaccttaacatgatcaaagagaagatgcggtacgctagagtgctgctggacgtggccaaaaagagggacgacgtcgtcgccggggaccccaaccggctggagc

SEQ ID NO: 57229 - DNA, 437 bp, Zea mays
  Clone ID: LIB3069-012-Q1-K1-D6
cggacgcgtgggcggaactcgaggcagtgtatgaggcagaaatcagcggacgcagccgcgctcggctcggccatgtccgagatccagcggctgaagcagcagctggaagcttcagcagagtctgacgcggcccgcgcgaagcagtgcgagtacgtggaagctgagatcgagggcttgaagcaggagatggagatccgcctagcgaccattgagggcctgaaggtgaatgtcagcgagagtgacagggctgcggctgaggcaaatgccacggtaaatgagaccaagcagcagctggagacagcgaaggccaccattgactcacttgtagctgagggcgtacgcatgcaggaatgcctgaggtcgaaagacatggagctcaatgagtccaaggctctcgtagcatcgctccaagaagatatggagaagtcacatgacac

SEQ ID NO: 57230 - DNA, 428 bp, Zea mays
  Clone ID: LIB3069-012-Q1-K1-D7
gaacagctgaaaaggcttcaattgagttgactgtattgcaaacagcgatgatgctgcctattggttgctcaaagaattctcagcaaactcactgcaagagaaatttcaaaagcttatgctcaatgacatgaaagagctctcaagaattcaagctaaagttggtctacagatgccactgatgtctccgcttgattctgatgaagaaaagtattctgtggcttctgattctgtttcttcagctgatcatgagaaggttcaacatggtggaaactcatctgactcagagaatattgattgtgatcataccactgaagattttgaatccagtgatactctctcaacgaacagttgatccctgcctccccagcctcaaccacctgtgcctgctcatatggtctcctgatatcgatttatccgaactggagagc

SEQ ID NO: 57231 - DNA, 449 bp, Zea mays
  unsure at all n locations
  Clone ID: LIB3069-012-Q1-K1-C11
agatgatagtgtggaagcagccaaagggggttatccaggggaaggtgaaaatcatatctataagcaaaaataaaaggcatcaagacagaacagctgctcttgaagtatgggagcgcttggaggaatttatgcgggcacggacataattgatgtgcagtcatgataaaagacaaccattttactagattcattcgcaatattggtcggtgactgtagatggcagaatggaatggctgggagcccatgaagactgcaatctttgtacgctaggatgtatttgtaatgttgtacttgcaaactgctaacttatttctagtttaagtatatgagacaattttgcaagttgcgcctgaaagtatattttctttctacgtctctatgttctgggggtcgcttgctctcatnctgccattatctgaggtctatgttttaaatttgtttttctatat

SEQ ID NO: 57232 - DNA, 336 bp, Zea mays
  Clone ID: LIB3069-036-Q1-K1-A11
ggcgtcttcgtactcgcctacctccgcggttcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcaccct

SEQ ID NO: 57233 - DNA, 331 bp, Zea mays
  Clone ID: LIB3069-036-Q1-K1-A12
agggaatcagggaagtgaactagcggtccacgatactccgacgcccactttgctacctcggaaccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggtgccgcgatgtcggtgcggatcaaggcggttgtagaccggttcgtgaaagaactgcaggaagcgctggacgcggacatccaagaccgcgtcatgaaggagcgcgagatgc

SEQ ID NO: 57234 - DNA, 324 bp, Zea mays
  Clone ID: LIB3069-036-Q1-K1-A2
ctgagctgatgtacgagacaatccgcgaatggccaagatatgtcaatgtccctctacctgttgcaagggctattgcttccccaagggagatgctgctcaataaagtgccgttcccgcttccaacaccatccattttcaacctagaccaaatcaacgcatttgctgtggacaacctcgtatcggaagatgctctgactttcgaagacctcagcatcatgcctcagaagctaaaggggtacccggtggagtacctggtgtcttacaggaagggcgggccgtcgttcggctcgaccgtgagcgagaagatgaggagctcggagatgt

SEQ ID NO: 57235 - DNA, 329 bp, Zea mays
  unsure at all n locations
  Clone ID: LIB3069-036-Q1-K1-A3
ccgaagcctaagaccaagcataaggttgttattgatactgtcgagaaattccagacactgcgtgagcaagagcagaaatacttcgatgaaatggttcagaagtgcaaagatgctggtgcaaccctggttatttgtcagtggggttttgatgatgaagccaatcatttgttgatgcatagaaatctgccagctgtcagatgggttggtggtgttgaattggaattgattgccattgcaacaggaggacgaattgttccgagattccaagagttgagtcctgaaaagcttgngaagggctgattagtcagagagaaatcattcggaacaac

SEQ ID NO: 57236 - DNA, 314 bp, Zea mays
  Clone ID: LIB3069-036-Q1-K1-A4
cccacgcgtccgcccacgcgtccggtttatatcatgtcaagattgaacacatcacctttgttaaaactacttgaattgttattttccttttccacaagaggtacatggcagattcctgttgagatttgatcttttggtgcctgttaagctttctgaatgtgaattactaaccatagtgaccttgtattaggttcaaaatgctgggctggaaactattggactaagaccggcaaattctccaagtctgtcaactaattcaggggtttatgagcaattcatgcagaagtaccattagccacagactcaaaattcac

SEQ ID NO: 57237 - DNA, 390 bp, Zea mays
  Clone ID: LIB3069-036-Q1-K1-A6
gaggagctcacgagcatgaaacgaatgatggttgaattggaaaaactacgcctgttgtgtgagaggataattaagagagagaaggtgaagagagagacggttttgtgtgatcatgaaatacttgccaaaactaaggacacagttattttctcctaccttgcatgcggagcaagctcagaatctgcaactacttcagttaataacaggtcgtacagtggagcagcacaaagatctgatgatgtcacagtagatagtactatttctgggaagaaaaccataaggttttctctgaataacagaggtgctgatagaaacacagctgacagctcgaggacattgctatcattcaaacgcaagttgagtgagaggggaccacgagctggtaagcaa

SEQ ID NO: 57238 - DNA, 369 bp, Zea mays
  Clone ID: LIB3069-036-Q1-K1-A7
gtccctcacacactcactatacactgctctgctgcagcaagaaggaagaagctagcgcctccctagctctcgttgtcagcaatggccaccaccgctgcgtccagcctcctcaagtcctccttcgcgggctcccggctcccttcggccacgcgcaccaccaccccgtcgtccgtggccgtggccaccccgcgcgccggcggcggccccatccgcgcgtccattctctcccccaacccgccctacgacctgacgtccttccggttcagccccatcaaggagtccatcgtgtcccgcgagatgaccccgcgctacatgacggacatgatcacccacgccgacaccgacgtggtgatcgtggggcgccgggtc

SEQ ID NO: 57239 - DNA, 338 bp, Zea mays
  Clone ID: LIB3069-036-Q1-K1-A9
acgcggacgcgtggggttccagcggtctattggttttgagtgggaactcataacttacacagatgatacttcatctttagcagaaactgatttggatgttctgtccagaaccaagcctaaagaagcaaacgagcttatttctaagcaggaatcgcaggataagttggaaaaggctcctgatacctctgtgccaactaatgggaatagctaccaagaaaagcttattggcagcccagatatacgaccaaagaaattggccttaaaattagcatttactttaccaacatcatgctacgctacaatggctatccgggagcttctgaagacttccacctcag

SEQ ID NO: 57240 - DNA, 357 bp, Zea mays
  Clone ID: LIB3069-036-Q1-K1-B1
gaggctgcagtggaggacatgggccgcctgcttcatccaagctgcctggcaccggtactgcaggaagaagatcgaggattctttgcgtgagaaggagaagaggctgcagttcgcgattgccaacgacagctccacttcgctcagcttcatggcagcgctgtatgcttcgcggttcgctgggaatatgatacggatcctgaggagaaacgccacgcgcaaggccaggctgcaggaaagagtgcccgcgagactgctgcagaaaccggctgaacccaacttttccgcagaagagcagtagtatttcgcttctctgacttctcgttttgcagatacagatatgggaaaattgttgcgtga

SEQ ID NO: 57241 - DNA, 333 bp, Zea mays
  Clone ID: LIB3069-036-Q1-K1-B10
cttggttgtctgaaaactttcctgttgcatacaaaacgttatgcgaaggtgtttctgaagctcaattaaagtcagcagaggatgatcttggtttcaagctccctatgcccacaaagctgttgtatcgcttttgcaatgctcaactgccttttagtgaggaccatgacacaaataaaagcatttccactcatggattgattgggggctatgcgttttatgatcattgggtgaatgtgcatttgtcaccgcttgagcaaatagttgaagagacgaaggacttctatcgggagttccctgatgtatttcatgggcgcaaattcattgtagtggcaa

SEQ ID NO: 57242 - DNA, 330 bp, Zea mays
  Clone ID: LIB3069-036-Q1-K1-B11
gcttgccactggggatgtgctattcgatccacatagtgggcgataattttgacagagatgaggatcacctcgcactgatgatggagctgctaggaatgatgcctcgaaagattgcgttgggtggtcggtattcacgtgatttcttcaatcggtatggggatttgcggcacatccgacgcttgcggttctggcctctcaacaaggtgctgatggagaagtacgagttcactgaaataaatgctaatgggatggcagattttcttgttccaatacttgattttgttcctgagaagcgccctacagctgctcaattgcttcagcatccatggc

SEQ ID NO: 57243 - DNA, 239 bp, Zea mays
  Clone ID: LIB3069-036-Q1-K1-B12
cggacgcgtgggtggcttgcggagaatggtgcctggaagttcgaatagtgtgcggattggatcttcaagaaggccagtagcttggccactagtggcagcccggacatctgcttcaggttctcggccttcttcacctaggtcacttgttgatggggaaggttacaacagtgctgatgaacagggcccctgttatgccttgagttatgatgattcggaaagggagcgtatgtttgaccatg

SEQ ID NO: 57244 - DNA, 334 bp, Zea mays
  Clone ID: LIB3069-036-Q1-K1-B2
gttctatgcagcatattgttatcaattgtatatcttgatttgattcctattggatttggattagttcgatttcaataggggttcttcctgtatttcgtcttttattatgttagatgaaggggaaaaaatgggaactcaaagatatcgaagagtaaaaaaaaggatggaataaaagagtgattggttgaaaagaaagagaaatagaataatgagaatcatatggatttacacaaacctctaatgattagaaactaaaaacgagatctcgaagtaattcgaacgatttcgattatcatttatttgtacttattagttacttctacccgatagagct

SEQ ID NO: 57245 - DNA, 363 bp, Zea mays
  Clone ID: LIB3069-036-Q1-K1-B3
gcctccgccgctggaatcaggcgatgggttacgcggacgcctacgcgaagcgggtgctactcaccgcagctggcgacaccgtctcgcgggggatcgcctctaccctcaccaagcacggctgcagattggtcttgttgggcgacgagggcgcgctggccgcgacggaggaggaggcgcggcgctgcggggtagggggcggatgcgtcgaattggtcgggctggacttcaaggcgtgcggtgaggctgctgccgacgcggcggtggatcgggcctggcgctgcttcgccggactggatgccttcgtcaactgctactcctacgagggggaggtgcaagattgcctcagtataagtgaagacgagt

SEQ ID NO: 57246 - DNA, 337 bp, Zea mays
  Clone ID: LIB3069-036-Q1-K1-B4
ctcgcgtctctttcctattcgcgccgccttcgctgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctcaagaccgccgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaagcccatgggctggcacccg

SEQ ID NO: 57247 - DNA, 321 bp, Zea mays
  Clone ID: LIB3069-036-Q1-K1-B5
cggacgcgtgggcttttacagccatcgttgtaatcctaatagcaatccctggcatgacggttctggacatctttgtttgcatccttgccttcatgcccactggatggggtttgctcctgattgcccaagctatcaggcctgtgattcaaaagatcgggctgtgggggtcgatcaaggctcttgcccggggctacgagatcctaatggggcttctcctgttcacgcccattgctttccttgcctggttcccgttcgtgtccgagttccagaccaggatgctgttcaaccaggccttcagcagaggtctgcagatcttccgta

SEQ ID NO: 57248 - DNA, 421 bp, Zea mays
  Clone ID: LIB3069-036-Q1-K1-B6
cccacgcgtccgcccacgcgtccgtccactcgtccgattgccccagcagtgtatggagatatttatggatatgggtatgctccttacggggcatactctccggccacttccccagttccaacggttgatggtcagatgtttggcgcacagcattaccagtatccaaccacgtattttcagcctgctacaccaattccttctaccactcaaagcaacctgcagtcttccaacaatcctgaaaagccagcagctaaagcagatcctgccaaggcaaccgctaatggtgttccaaatggtactggtcacactcacagttacagtggaactgtaccaagccaacaaagttcagcactgacgcctgatggaacttatagggcgcccttgctaggtggagttccttctgcttgttacctagagacga

SEQ ID NO: 57249 - DNA, 416 bp, Zea mays
  Clone ID: LIB3069-036-Q1-K1-B8
agagcagcaatccagttttaatcagattgtaagggacgctccgaggcttggagatgagtcactgttcccccctttgactgggtctagtaacaagatgaagcagcctgtttttacgcctaagcgtcctcgaacttttcctgctgctgaggatatccatgctgcaaagatgcgctatgctctgggaatgaacgaggacatgtactctgcgttcaaagagattgctggtgaataccgtcgaggtaccatggatgcttttgagtatctttcatatgtcgagcagttcggactgtcgcaccttggtcctgagatggctaggctattgcctgattctcgaaaaccgaaggaacttgctgatgcgcactataccaatacaccgttgaaaaaccttcaagaaaatggaaattattagaaggggg

SEQ ID NO: 57250 - DNA, 328 bp, Zea mays
  Clone ID: LIB3069-036-Q1-K1-A10
cggacgcgtgggcagtgtgtgtgtcgtagctatagcagtgcccggtgcggactgcgagtgacatgggctaaataaagtgtgcgtcgtctggtctggtggtggtagtggggcgcggtgccccatgtgtgccgctgcagcttgtgtctctgtgttgcttcatgttctctgtctatctactctcatgtatggcagtttgggtacgggtatatcaagcatgttcagtcttctttggttgaaaaaaacaaagaaattggacagaaaattagcatttactctaccaacatcatgctacgctacaatggatatccgatagctcctgaagacttac

SEQ ID NO: 57251 - DNA, 336 bp, Zea mays
  Clone ID: LIB3069-035-Q1-K1-G12
gggaagcgtcttcacgcgactgctcgtgatcttctgacatcgtcgactcagctgatcctggcgcgcgccaacaatcagaccttcacgtcataccgcatcctccgctcgccgacctcccgcgcccggtccttgagcacccgcagctggccggcggcgtcgtgctgcgcgaacatcttcctcacaaaccatggaggccacaggaggtagcgcaagaggccgctcctgcggaggtgcacgtcggggttgccgcggtacacgtacttgtcgatgcagttgttgcagtcgttggcgaggatacggacctggttcatccacgtgcgcacctgcacgccgtgc

SEQ ID NO: 57252 - DNA, 423 bp, Zea mays
  Clone ID: LIB3069-035-Q1-K1-G2
cggacgcgtgggttcatacatcctgccattcaaaggtcatcctgagaggctaacgcatagcgctgaaactatactgtagcaagtagcctttcgtgactgcagagacctagccatccagatctaaatggctgcctgttcatagctaaaatgcatagcaccattattcatttgcaacactatcattcgatttctacgagctattcatgtactgctcggatgccagtcttcttgactctaatgctatctccatcagtgtactcatcctgatcatcttatttcaaactacactatgcgaacaatgcagtctatagtacaaacagcgttctgcacagtcacatgcacgtttagctggctataccctaacagtaaggatccatgcagaaaacttagtttctaatactacagtaggtcaaatttacacac

SEQ ID NO: 57253 - DNA, 373 bp, Zea mays
  Clone ID: LIB3069-035-Q1-K1-G3
gctcggcaggggaacggtgcgaagcggattagcgtcgatgcagatccgggtgcagtgcgcgtgcggcgagtcgtcgtgcccggaatgggccgtcgtggagctgcagggcgtggtgcagccgcaggcctccttcgccggcgacatccggggactccacatcggccgcctctgctcctccccttccccagcctccgcctcgtccaaggcagggttcaccttcacggtggggtaccacgagctcgccggcacaaaggtgacgctcaagaagcccctgctggtgctcaggaagaagaaggttaatgctggtgctcaggaagaagagccaccgacggcggcggaggtggagctggaggtgatcggcatcatccggcac

SEQ ID NO: 57254 - DNA, 428 bp, Zea mays
  Clone ID: LIB3069-035-Q1-K1-G4
tcgctgacgcgtgggccggcgaggcgacctttcgacctccgttcctctgcgctccggctgagtttctgatttgggataatcctgttctctctgagtgaatcaacatgtctgggaatgatgataagccacatgctgctgcagacagaataaaggcagccacgttatcagtggctaagggattgagcagggctcaagctgaacgcgctgcgactgctgctgcccgcaatgtgaatgcctatgggcagaaggaagagggaccaagccgctggcaggagaggaaggaagccaagagacagatgtatctgatgagtacagagaaggctgcgaagctgggcactgtgaagccaaaagcttcagaaacttcttctgttggcgcatatacccaatgccagaagtgtttccagcatggtcactggacatatgagtgc

SEQ ID NO: 57255 - DNA, 330 bp, Zea mays
  Clone ID: LIB3069-035-Q1-K1-G5
acgccacgcgtccgctagttctagatcgctctctatctagaactagtgctcctgatgaagaaggaataccactcaaaaaggttatggatgcatgctcttcttgctttgagcaaagaacaatatttacccagcaagttctggcaaaagcactaaatcaactggttgaacagatacctctatctttgctattcatgaggactgtcatgcaagcaataagtgtttttactgcattggtggattttgcgatggagatcatgtcacgccttgtgagcaagcagatttggaaatattccaagttattggtaggacttctgaagtgtgctatcttga

SEQ ID NO: 57256 - DNA, 245 bp, Zea mays
  Clone ID: LIB3069-035-Q1-K1-G6
cccacgcgtccggatggtcactaatttttacaagcattttaaaactcataaatattggatacattttaaattggaattgtatttaatcattgccttttgtgatcactccgataatcggtttatggcaacctattggaaccaaaaacaataaatcaactggttgaacagataactattactttgctattcatgaggactgtcatgcacgccataagggttgttgctgcatagatagagtttgtgat

SEQ ID NO: 57257 - DNA, 327 bp, Zea mays
  Clone ID: LIB3069-035-Q1-K1-G7
cccacgcgtccgaaaaaaaaaaaattaaataaaaaaaaaaaaaaaaaaaaaaaaaaaaaagaaaaaaaaaaaaaaaaaaaaaaataaataaaaaaaaaaaaaaaataaaaaaaaaaaaaaaaaaaataaaaaaaaagaaataaaaaaaaaaagggggtgaacttttagaagataaaagtttatgatcgggtatttatgaggactaacatttaattaaggggagctaaaattgaattgatgggacttgtttataaacatgatgtcattggaaaaacagcgggctgaccaagataaatcccatggtataaataccatttttgaaaagtg

SEQ ID NO: 57258 - DNA, 337 bp, Zea mays
  Clone ID: LIB3069-035-Q1-K1-G9
cccacgcgtccggtttctaattcaggcgttctccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtaggtggcaaccgggctcagagatcatctggctgctgttaagacatgaggcatccacg

SEQ ID NO: 57259 - DNA, 367 bp, Zea mays
  unsure at all n locations
  Clone ID: LIB3069-035-Q1-K1-H1
gagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctctcgccgccgtcgtgcccgaggaggctgcccccgccgncgaggccaaggtggaggagccagctgccccggcggagaccgagccagctgccgncgctgagcccgaggcggcccccgtggcggcggatgaagagacgccaaaggaggaagagacggc

SEQ ID NO: 57260 - DNA, 338 bp, Zea mays
  Clone ID: LIB3069-035-Q1-K1-H10
gcgagagcggacccagcagatggagcgtttgtcataacattacgaacacaacgagagaaaacgatggtacatggcaagtcaagtgccttaggttctggagtgtgagaacgggtaaaaccgacacgaagcgctgaatcatgtacatctctagatgggagcacaaaagttatgggttggcaactgccaggctcatctctagagggcagtgcaaaagtctgaggttggaaaccaccagtcttatcacttgaacggattgctgatggttcaagatcacaagcatcgtgtacttctacgcaaaggggcacataatcttcaggttggcagcgatcaagttcata

SEQ ID NO: 57261 - DNA, 333 bp, Zea mays
  unsure at all n locations
  Clone ID: LIB3069-035-Q1-K1-H11
gaactttctagtgctgatggattcttgcttagaaggtcatgtatccaactcggacggaacagacttgatgcgattagcatcccgttgcctgcaatatgaagcacgtgaccgtccaaatctgaaaactgtggtatctggtctcacaagtctccagaaagatgcttatactccttcgcacactttgcttgggattcaacatgataagaacaactcaggtcaagtttccttatctgctattgggaaagcttttgccagagcagacctgaatgaagtgcatgaaatattgctgcatgatggatataatgaggacgacnaggctaatgctgagctatc

SEQ ID NO: 57262 - DNA, 269 bp, Zea mays
  Clone ID: LIB3069-035-Q1-K1-H12
gctacggcggcggtggatgaggaggtggtggtgggtatggcggtggcacaaggacctaaaactaggtgccgtagcaatacaagctacacacgctgttacaattgcgacggcgcctaaaactactgaaagagctaatcgggcgcattcatatacagcatcacatcaattctcagtatcctactgtcattctgatacatatacagcagctcaaatgatatcaagctgcaaacactgctcttatcactgagcaagattgataatgactgata

SEQ ID NO: 57263 - DNA, 439 bp, Zea mays
  Clone ID: LIB3069-035-Q1-K1-H2
cccacgcgtccgcggacgcgtgggtgactttgcatgccatgcccatgacacccctcgggtgcgagtgcgacatggcccctgcagcttctcgccagtcgtggcctctccctcgctgcggcctgctggtcttggcccttgcactggcgacgaccgccgcggtgggcagcgcgcagctgtcgtccgagagctactacgacgcgtgctgccccgcctgccttctcaccatcaggaccgacgtctcgacggccgtgctgctggagccccgcatgggggcctgccttctgcgacttcacttccacgactgtttcgtgcacggttgcgacgcgtcggtgctgctagacgacacggcgagcttcaccggcgagaagggggcggcgccgaacgcggcgtcgctcccgggcttcgacgtgatcgacgacatcaagatgctgctggagct

SEQ ID NO: 57264 - DNA, 255 bp, Zea mays
  Clone ID: LIB3069-035-Q1-K1-H3
gagacacgtcagtggactcgtgcatgacttcgtttgctatggccatgacaccattcgggagcgagtgcaacatgagccttgcagcttatctacagtctaggcctttggctcgcgtgcggactgctggtcttggccctagcacatggccactaccgacgtgcaggacagcacgcagctgtcgaccgagagctactacgacggcggctagccccgcctgccttctcagcatcaggaccggaggctggacgggcgggc

SEQ ID NO: 57265 - DNA, 51 bp, Zea mays
  Clone ID: LIB3069-035-Q1-K1-H7
cccacgcgtccgcggacgcgtgggttgttgcgtgggctagttctagatcgc

SEQ ID NO: 57266 - DNA, 314 bp, Zea mays
  Clone ID: LIB3069-035-Q1-K1-H8
cacaattccagctcaggccaccagttagttcatcgcaaaggcagcaagtaagcaagcgagtaaccacaccacaactacagggaggaagagcagaacagaggcagagagagagagagccatggcggcggtcgccgtgagcgggaggctgcggacgctggggcgcggcgcgtcgggcgccgtggtgtcgctggcgtgggacgccgcgtcgggggagctggtcgcggtcaagtcggccggcgcgagcggcgcggcggcgctgaagcgggagcacgcggtgctggccgggctgcgctcgccgcatgtcgtgcgctgcg

SEQ ID NO: 57267 - DNA, 330 bp, Zea mays
  Clone ID: LIB3069-035-Q1-K1-H9
caggagaatgttttggctgagtcaaggattatggtcccagactgccacaaacgacttgaaactgcactggctgacttgaaagcaacactggctgaactgaaggagtcaaatgagcaaggtgccgagattggagaagctgagagtacaatcgcagaagttgaagcagttgtcaagccagcagaagattaaactaaaaaaactcttggtttgctgaactgttagcgcacatcctattttcgcatattgagcccttgtgagcctattacgagatgtttgaggcgtgaaatcctgtaccattatcatcacttctatcttgaaatttgagtttct

SEQ ID NO: 57268 - DNA, 342 bp, Zea mays
  Clone ID: LIB3069-036-Q1-K1-A1
ggcagaagaggagtacgacgagaagaatgtggcagcgaccccgcagccggccgccaaagcacaggtggtgggatggccaccagtctgcaactaccgcaagaacacgatgactaccacccagctggagggcagcaaggaggatggtgatgccaagcagggtcaggggttcctgtacgtcaaggtcagcatggatggcgcgccgtacctcaggaagatcgacctcaagacttacaagaactacaaggacctgtcgaccgcgcttgagaagatgttcagtggcttcattactggcaaggacggctcatctgagtaccgcaaggatggtgaatatgttctgactta

SEQ ID NO: 57269 - DNA, 357 bp, Zea mays
  Clone ID: LIB3069-035-Q1-K1-G11
cggccgacccacgcgtacgcgcaagctcgcgccttttatgccggaccatgaagtcgcgtcggacagcatgacggtcggggagggtctgctcatgatggacgatgaagagagggtacggccatgctgagatcccgaccagtggctatcgcaagctgcgcgtctgactgcgacgtcgcctagtcaagaactacgaccagatcagggacaaccgctgcaaaaactgtccatttgtatagatggacagagagcacgacatcaccgtgaactagaccaccccgaactttactggaattatctgtctgatggaccccactctgagctaggcagcccgttggttgaaaattggcaggttcatta

SEQ ID NO: 57270 - DNA, 334 bp, Zea mays
  Clone ID: LIB3069-035-Q1-K1-E12
gctcaaggtgtccaaggcggagttcatcgttctgtcgcgcaagtccggcaagttcgacgaggacagcctggcgttccagtcgcgtctgctggccaagtccggcatcggcgacgagtcgtacatgccgcgctgcgtgttcgagcccaacgccagctgcgccaccatgaaggagggccgcgccgaggcgtccacggccatgttcgcggcgctggacgagctgttcgacaagtgccgcgtccggcccaaggacgtgggcgtgctggtggtcaactgcagcctcttcaacccgacgcccttcctgtccgccatgatcgtcaaccactacaagatgcgc

SEQ ID NO: 57271 - DNA, 286 bp, Zea mays
  Clone ID: LIB3069-035-Q1-K1-E2
gcggcgaagaagccggtggccaagaagctcgcttaggatgagcccgcgacagagaaggcggtgaacgctccggcggggaagaagcccaaggccgagaagcgcctaccggcgggcaagtccaaggagggcggctagggctagaaggggaaaacgaatgcgaagaagtccgtggagacctacaagatctacatcttcaaggtgctgaatcaggtgcaccccgacatcggcatctcgtccaagggcatgtccatcatgaactgcttcatcaacgacatcttcgagaagc

SEQ ID NO: 57272 - DNA, 344 bp, Zea mays
  Clone ID: LIB3069-035-Q1-K1-E3
ggaggcggcaacaatggcgaacagcggattcgtgttatatatccgagagcacgactagcatggagggggcgtcaggcgtacgacgacttcgacgggacacgccagatctcgtggttgtcgagttcgtttgactccaaccgtggccatgcgtcgggacactggctacgcgggtcccacgtaggctgcccattttgggacccttgtcttcagacacgtgcatttttacagtatctcgttttagaactgaattctacattaactatcacagtgcaagtgtatatcaccctctgggtcctaaactatatttagatcgttttggaatactccctagtggtaatagactc

SEQ ID NO: 57273 - DNA, 434 bp, Zea mays
  unsure at all n locations
  Clone ID: LIB3069-035-Q1-K1-E4
gccgccgccgccaccaccagcactgccactctcttcaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaggattgaaaggggtattgctttcccaacctgtgtatncgtcaatgacacagtttgccacttctcaccgcttgcaaccgatgatgccgttctggaagaaaatgacatggttaaaattgatatgggct

SEQ ID NO: 57274 - DNA, 124 bp, Zea mays
  Clone ID: LIB3069-035-Q1-K1-E5
acacagctgagcagactgcaacagggatgtgaggcgtttattgccgcacgcagtactgcaaatggagacattacagtagtagaggaagcagagaacataattcaggcaatcaagtcagtcagag

SEQ ID NO: 57275 - DNA, 118 bp, Zea mays
  Clone ID: LIB3069-035-Q1-K1-E6
cccacgcgtccgcagaagatcaattgctttccaaatccacgctgacaccaactcgacgagctgcgcgccaagcaccaaagctccgatgggccgcactaaacagactgctcgcaagtcg

SEQ ID NO: 57276 - DNA, 408 bp, Zea mays
  Clone ID: LIB3069-035-Q1-K1-E7
ggcacacgcactacacgcacggcacgcatatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccagcgaaatcgggaacgcgcaccaactgttcgtcgttgtgttcgacaccgacaggtatac

SEQ ID NO: 57277 - DNA, 371 bp, Zea mays
  unsure at all n locations
  Clone ID: LIB3069-035-Q1-K1-E8
cccacgcgtacgcccacgcgtgcgttcgttgttctgctgtccaaacacatgtctactgtgtgaaaatagctcattttgtagttacatttgcatcaagctttgatgattgctgtacaaggatgatatggcctnccgcccaaagctgtctggtattcagaagcaggttttggcgctgtacaggggattccttcggacagcacgccttaaggcccctgaagaacgccgcaggatcgagtctgttatcttggcagagttccgtgacaacgcaaggagtgttgaccgtaggaactttgtacacatagagtacttgttgaggagagggatgaagcagcttgagcagctcaagaatcctgatattactggactcgcta

SEQ ID NO: 57278 - DNA, 305 bp, Zea mays
  Clone ID: LIB3069-035-Q1-K1-E9
acttgattaaccagcctttggtttggctcgtcctccctctccggatctctcccgtttctgtgtggcgagagagacatgggccggggtgggaggacgatgcatctagctgttgacgatgacgaaaaatttgtgatgatcgtggatatcaagtgtaaagatctagagaggatgatgatgtaactttttctctattttcttttcttttttgttatacgtccacacacatactttgctaataccatgctctgcagaagtgcctgtactagctcaattcctataaactaaactattataccctgtgttct

SEQ ID NO: 57279 - DNA, 332 bp, Zea mays
  Clone ID: LIB3069-035-Q1-K1-F1
agaaaactgatgtatttggctatggaatttcacttttagagcttattacaggacagcgggccttcgatctagcttgccttgctaatgatgatgatgtcatgcttcttgattgggtcaagggattgctcaaggagaagaaactggagagtctggtcgaccaagatctagaacacaactacgtcgacgttgaggtggaatctctggtacaggtcgcactcctctgcactcagagcaaccccatggaacgccctaagatgtcagaggttgtgaggatgctcgaaagcgatggtctcgccgagagatgggaagagtggcagaaagcggaagtagta

SEQ ID NO: 57280 - DNA, 223 bp, Zea mays
  Clone ID: LIB3069-035-Q1-K1-F10
aaaaaacgtgagcagattcgagtagaattttatttcaacgccctgcaacaaggtagcggggctgattgctatataacatgcacgaacattatcatagcaagccatatgcaacgggccaaatagttcacgtggaagagtatgaacatgagtcagagtggctcaaatcgataactcgccgacataaacgataaaggctaattttcagtacatgcataacctgtat

SEQ ID NO: 57281 - DNA, 338 bp, Zea mays
  unsure at all n locations
  Clone ID: LIB3069-035-Q1-K1-F11
cggacgcgtgggcggacgcgtgggcggactcgtgtgcgccgagggtcacttcgcgcgcggggatgcggtgctgatgctccactacgcctatggtgcggtcaagaagtccatccacgcgtacgtcgcgcgtgcgggggccaccgtcgtcgaggtgcccctcccattccccgtcgcgtccgccgacgcaatcattgccgagttccgtgctgcgctcgcggtcgccaaggaaggagggcgtagggtcaggctcgcagtcatcgaccacattacctncatgcccagtgtcgtcatcccagtcaaggagctcgtcgccatctgtcgagaagagggcgttgaca

SEQ ID NO: 57282 - DNA, 340 bp, Zea mays
  unsure at all n locations
  Clone ID: LIB3069-035-Q1-K1-F12
cccacgcgtgcgatgcatacgaataagcatcgnctgaacctgactaacactcagctaagcaagctctttctctactgcaataatggccgctcgctcctgctgctcccagccgcagctggtcgcggcggcggcggtcctggcagcggcgctgctgctgctggcggcagtggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaagccacctgcaac

SEQ ID NO: 57283 - DNA, 383 bp, Zea mays
  unsure at all n locations
  Clone ID: LIB3069-035-Q1-K1-F4
cggacgcgtgggcggacgcgtgggcggtctaagaagaccgacgactcactcacaaccaattagctcaagatcgagctatagagagaaaagctaagatcgaaacatataccaatgggcaacagccttaggtgctgcctggcctgcgtcctcccctgcggcgcgctggacctgatcaggatcgtccacctcaacggccgcatcgaggagtacggccggccggtggccgccggcgagatcctggccgtcaacccgaaccacgtnctcagcaagccgtgctcccagggcgtcgccgtgcggaggatcctcatcgtgtcgccggactccgagctagagcgcggcgagatatacttnctcatcccggnctcgtcggtgccgccggagaa

SEQ ID NO: 57284 - DNA, 383 bp, Zea mays
  unsure at all n locations
  Clone ID: LIB3069-035-Q1-K1-F5
aatctgtgcactcccagccgctgcacctggcttcttcgccactctctcctctactcgttcactctgccaggtggccggccagccctgctcccatctcccacagccgccgccgccctcagctcctcagtcacctcccatggcctcgtctacctgctgcagcgaagccgaccaccgtttcctgcagcctcgatagctccctcgatcgctnccccccatgccgtccctgctcacctcaccttcgtcggccgttcttggacgccgtgctcggcgcccgagctccctacgccggtcaccatgctctccatggcaggagctccgatcggaccctgctgaccttggcactcggcgtggctccaagcagggccttcttccccaggaccggg

SEQ ID NO: 57285 - DNA, 375 bp, Zea mays
  unsure at all n locations
  Clone ID: LIB3069-035-Q1-K1-F6
caccggggcagagcgcttcagtgacacatgccgctgctccaagaaaccaccgccgagcccaaccgcacaagcgcgcgaggcaggagagagagagaggcggtgagcaaaacaatggaggggaaagaggaggacgtgcgcctgggcgccaacaagttctcggagcgccagcccatctggacggcggtgcagggcgccgttgacgacaaggactacaaggagcccccgccggcgccgctgttcgagcccggggagctcaagtcctggtccttctaccgcgcgggcatcgccgagttcgtcgncaccttcctgttcctctacatcaccatcctgaccgtcatgggcgtctccaagtccacctccaagtgcgccaccgtc

SEQ ID NO: 57286 - DNA, 413 bp, Zea mays
  Clone ID: LIB3069-035-Q1-K1-F8
cccacgcgtccgcccacgcgtccgtccactcgtccgcccacgcgttcgcccacgcgtccgcggacgcgtgggaggagatcttcattggactgaccctgggtctgatcgcgggaggcatgtggaagatgcaccactggaacgagcagaggaagactaggtccttctatgacatgcttgacaagggccagatcagcgttgtcgtcgaggaggtaagagttcttcccaggtattttcaaagaactctctcgagagcatgacaaagtgattgctggctgtggaaatttgtcctggaaataagcccaaccatttgggaccaccaaattttgccgaattttcctttcctttggatgaatatttgagcccgtccatgtaaataccaaacatttggcctttacttcatctcttttttcctt

SEQ ID NO: 57287 - DNA, 93 bp, Zea mays
  Clone ID: LIB3069-035-Q1-K1-F9
aaaaaaaaaaaaaagattgaataaaaaaatttttaatttaaaaaaatgaaaaaaaaaaaaagggactaattgaataaaaaacaagcataaact

SEQ ID NO: 57288 - DNA, 339 bp, Zea mays
  unsure at all n locations
  Clone ID: LIB3069-035-Q1-K1-E10
cacatnccctcccttcttcggttattccttgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagcttgcaggacatgatcaacgaggtcgatgcggatggcaatgggaccatcgacttcccggagttcctgaacctgatggcgaggaagatgaaggacacggactcagaggaggagctcaaggaggccttccgcgtcttc

SEQ ID NO: 57289 - DNA, 360 bp, Zea mays
  Clone ID: LIB3069-035-Q1-K1-G1
acggcacgcgtccggccacgcgttcgggcattagaatgtgcaattcttagagaaactcaaggaactgggtctgtttattgagaggaaactagacaaaaaggatttcggtccattgatgttctactcccaacctgatggtcctatagttggaagtggcaccttcaaatccactggtctagttccaggcgaacctgaagcattctatgtgggtcctccgtctagtgaaaaactgccaaagaatgcttcacctggggctggtttggttgggtccataacctatggtactgtaagcacatttaacaagaaagatgaacaaaaccaccgtgcttcaatatcttataagatctcatataccatttt

SEQ ID NO: 57290 - DNA, 336 bp, Zea mays
  Clone ID: LIB3069-035-Q1-K1-G10
cggacgcgtgcggcttctaattcatgcgtttccatcagatcctgacaatttcccttttgttctgttgggtaacaaagttgatgtatatggtgggaacagccttgtggtgtcggagaaaaaggccaaggcatggtgcgcctataaagggaacatcccgtactttgagacgtctgttaaagatggaacgaacgtggaagatgccttccagtgtattgtcaagaatgctctgaagaatgaaccggacgaagaattgtatgtgccatataccgtggatgtggtatgtggcaaccacgctcagagatcatctggctgctgttaagacatgaggcatgcact

SEQ ID NO: 57291 - DNA, 336 bp, Zea mays
  Clone ID: LIB3069-015-Q1-K1-B2
cggacgcgtggggcagtgcaggtcgctttcttccccaaaattttgaaccccgaaccctaggtctgctcctcagttaccccgtgtccatggacatcggcggcagcggcggcatcatattgtcgcccggatcggaggatgataagtttgcgcggaggcgctcccgccgtgtgagcttcgcggacaccaccgcggtgcacgtgttcgaccgcgacgaggacttcgagacgccttccgaggagcgcgagcccgactccacccccgcacccccttctcccaggaggtcctcggttggccgggaggttgaggacgacactgaggaggatttcaaccgccccc

SEQ ID NO: 57292 - DNA, 353 bp, Zea mays
  Clone ID: LIB3069-015-Q1-K1-B3
cggacgcgtgggcggacgcgtgggctgtaggtgggatttttgggagtttactgggaggatgtgcgttatccaatctcccaatacatgtaatatatattggtttctcagccctcccattcttccaattagtttcctgcatgtttgttgaggattcttcaaaagggttccacaacgccagtgatgaacataagtatgtagacaaccagagttctgttactgccttttctggaaaagctctagtgagggcactagaaggcgaaagggaacttctaaaagtaacaacagcagtccacaggcaaagcgaactgagtctaatgaaaaatacaacgggtcaattaattcgttgccttgtt

SEQ ID NO: 57293 - DNA, 321 bp, Zea mays
  Clone ID: LIB3069-015-Q1-K1-B4
cagaggctgcgtggcaccaccagggtccataaagagctcgacgatctcgtgtccgcgaccaggacgaccaccacagggcgtcccttccgcaccatactgaggcgcaagtacaggccgcagctggtcatagctctcctcgtacccttcttcaaccaggtcaccggcatcaacgtcatcaacttctacgcgccggtcatgttccggaccatcgggctcaaggagagcgcgtccctcatgtcggccgtggtcacgcgcgtctgcgccacggccgccaacgtggtggccatggtggtcgtggacaggttcggccgccggaagctc

SEQ ID NO: 57294 - DNA, 284 bp, Zea mays
  unsure at all n locations
  Clone ID: LIB3069-015-Q1-K1-B5
agctatattagtctactaatggattttgccttttcttggtggtagctttaactgcgatttcggttgtttgtttcgtttctatcagatattaataatctaaaatggtgtgcagcttaggttaaaatcaaaaaaaaattgtcgggcggataatacaaggcctacaacagaaggaataccctttgtgcgacaggcgaacagctgtctctatctctctctgcagtgttatttggtttattatatgcagttgcaggggagaaaactaangcatgttcactgcagctaga

SEQ ID NO: 57295 - DNA, 427 bp, Zea mays
  unsure at all n locations
  Clone ID: LIB3069-015-Q1-K1-B6
caaatataaaaataccgcctcgctacgcaacaacagccatctgattcttacattgccaatggaagacaatcttatcgaatggtggtggacccaaatcaaactggcagcgaccagcaacagtgttaatcaaatgcaatgtacacaggtaatctacaaaacttctgctctaagagcaagtccttcgggattgtgtgcctcgatgtcaacatgtttaatcccaggcacaagcttttggatctcagactccagccgatccacttcatatcccagagcttcaactacatcctccccgtagttggccatgacccttagcaattccgtatcatccttggacattgcagcttcccggaactgttttgcccaactcccacgtncagtcctttccaaataattttgtaccagaacaactccattgaaatcaatttca

SEQ ID NO: 57296 - DNA, 371 bp, Zea mays
  Clone ID: LIB3069-015-Q1-K1-B7
cccacgcgtccgcccacgcgtccgtccacgcgtccgcccacgcgtccgcccacgcgtccggacccacgcgtccgcccacgcgtccggtcagaggctctaagagttagggatgagatggttggctttggatgtctgccagatgtggtaacatacaataccctgttgaatgggctctgtaagcagcacaggttgcttgacgcggagaaacttttgaatgagatggaggagagaggggttacaccagatttatgcactttcacaactttgattcatgggtactgtaggcaaggtaacttcgagaatgcattgcaattgtttgacacacttgtgcgccagcgtttgaggccagatgtcgtgacatacaataggtt

SEQ ID NO: 57297 - DNA, 420 bp, Zea mays
  Clone ID: LIB3069-015-Q1-K1-B8
gcatgcggcacttgcaggccaccgtcgagtacctggccggggtggccgccacgcccccggcggcgtccgcggggggcggcgtgcacacggacacgttcctcatcctggccgccgtgctctgcttcttgctctgcgtcgtcgggctggccttcgtcgcgcggtgctcgcgcctgtgcaacccctcgtcctactccgtggacgcgcgggggcccgtcgacgacgacgacgacgaggcggcaatgccggcgccgcgcaagggggtcgacagggccgtgctggagaagctgccgaccgtgccgttcgcgttcgaggacgaggacgctcaggacggcgagcggtcggagtgcgccatctgcctcgccgagttcgcgcccggggacgaggtccgcgtgctcccgccctgcgcacacgcctttcacg

SEQ ID NO: 57298 - DNA, 424 bp, Zea mays
  unsure at all n locations
  Clone ID: LIB3069-015-Q1-K1-C1
cttgagacttcacacatcgatccccactccttccaccccaaggaagcgaagcgtacgctgcgcgcactgccctccggcgaccgccccgccgctggcgggtcggattgggtccgatccggatctggatcagcaccggcatcgccgcgacaaggatgtcgaccccgaggcagcggcatacctccacctccggcgggggcggaggagggaggcgcgccgcctccgggtcggccatgctgccccccgtggtggtcctcgtgttcctcttcgtggtcgcgccttcgctcttcttcgtcgtgcgcaatgacggtcgcgcccacgcccacgtncacgtagcctccgatcgcaagggtaagaatggcaatcaggaagcagcagcaatgaagaacctaaatctattttgcccaagagggtgttgatgctataa

SEQ ID NO: 57299 - DNA, 405 bp, Zea mays
  Clone ID: LIB3069-015-Q1-K1-C10
cttccctggagccgcccgcttgcccttcggtcgctagctcgctcggagcgcgtcgggccggtccatggcgctcttcgggcgggtgctggctctcgccctggctctggccctgggccccgccgcgaccctggcgggtcccgccaagtcgccctaccagctggtgctgcagcacagcaggctccggggccgccagcacggccccaacgtgtgtgctgtgcagaacgttattggcactaataggaagtacttcaccaactgcaagcagcggtaccaaaggaaaatctgtggcaaatcaacagtcatcagctacgagtgctgtcctggatatgacatggtccatggggagaacggctgtccagcatccctaccactgtcaaacctttacgagaccctgggagtcgttgg

SEQ ID NO: 57300 - DNA, 399 bp, Zea mays
  Clone ID: LIB3069-015-Q1-K1-C12
cacacgcatgccttgaaaatacacttttactctgatccaagcacacaaacagctcaggccgtgacacactattctgcgccaggcccatcttctctcctgccttacaacgccatggggagcaatctcaacccccaactctgcctgatgccctttatcttgggcctcttgtctggaggtgtgaccaccactccatggtctttggcccggccccagggatcctgctctctggagggggtagagatcaaaggcggctccttccgacttctacaagacggccatgcactggactacgtgtgtccttctagcttctacccgtaccctgtgcatacacgtacctgcagatctacggagtcctggagcaccctgaatactcaagaccaaaatactgtcaggaaggca

SEQ ID NO: 57301 - DNA, 361 bp, Zea mays
  Clone ID: LIB3069-015-Q1-K1-C2
cgatccatctcactctccgctggtcgctcactcttgcagctccacccttcactcagtctgagtctgttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcg

SEQ ID NO: 57302 - DNA, 334 bp, Zea mays
  Clone ID: LIB3069-015-Q1-K1-C3
gagctgagtagtctgggtggagcatcgtcctctacaccttatagtaaggatagaatgagacgacaggggcaatatggtgaagcggatattaactccatggttgttgcccagttgcatcactaccaggcacaacaaagggtacagaaacaccctgagaatagctacactggaagagatcccgcacaagcttctacggagcatcaatacactccccctaaggcaagacaaagtcaatgggatcgaggtggaccaaatgtgccaagccaggttccatcatatgtatatataacgaaggttatggctccacctttgcaccaactgctgcagcgcctac

SEQ ID NO: 57303 - DNA, 371 bp, Zea mays
  Clone ID: LIB3069-015-Q1-K1-C4
ggcatccgaatgtttatccggatgggcgtgtttgcatttctattcttcatccacctggtgaagatcccagtggttatgagcttgcaagcgaacggtggacaccagtgcacacggttgaaagtatagttctgagcatcatttcaatgctctctagtccgaatgacgagtcttcagcaaatattgaagctgccaaggattggagagagaagcgggatgagttcaagaagaaggttaggcaatgtgtccgcaggtctcaggaaatgctgtgaaggaggaacatgggggagttgaatgagtctgcaatcggtgtgctgcaattcacaaccaattatctcatgccatcattcttttggtttcccctgtatattttt

SEQ ID NO: 57304 - DNA, 446 bp, Zea mays
  unsure at all n locations
  Clone ID: LIB3069-015-Q1-K1-C5
gaagctgcttattcagaaccaagatgagattattaagtctggtaggctatcagagccgtgcaagggtattgttgactgcttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtatngctgggctttaccgtggatttaaca

SEQ ID NO: 57305 - DNA, 445 bp, Zea mays
  Clone ID: LIB3069-015-Q1-K1-C6
cccacgcgtccggtacatacagagattatatgcaaagtcaattcagcatgcaccatagacgtccatccgacaaagccatggatggtcatcactcaagctaacaagtttgttcatgtttgggactaccatacaaaggtagtggaatggacgattcagattaagggagcgaaagttagttcagctaaatttatagccagccaggattggattgtggcgggtactacccgtggattccttcacgtgtacgattgcgaatcgaggaaggaaatacgccgtctttgtgaacacccgaaatctatcacgtctttggctgttgacgatgatgcccttgagctggtgctgtcagcgtccatcgatggcaagattttgatctggagctactggcactactaccgcgcacgtagaggtagacgtagtacctggcatttggaaaaaacatttgacg

SEQ ID NO: 57306 - DNA, 441 bp, Zea mays
  Clone ID: LIB3069-015-Q1-K1-C7
agcaaaccccaaggactatctcactttcttttgcttaggtaaccgcgaggtgaagcaggagggagaatatgaaccagaggagcacccagaacctgacactgattacatgcgggctcaagaggctaggaggtttatgatctatgttcataccaaaatgatgatagtggacgatgagtacatcatcattgggtctgccaacatcaaccagaggtccatggacggtgccagggactccgagatcgccatgggcgcgtaccagccgtaccacttggcgactaggcagcctgcccggggccagatccatggcttccggatgtctattaggtacgagcacctgtgaatgctggaagacgtcttgcagcggtccgagagcgtatagtgtgtgcagatggtgaacaaggtcgccgagaagtactgggacctgtactcgagcgacgacct

SEQ ID NO: 57307 - DNA, 343 bp, Zea mays
  Clone ID: LIB3069-015-Q1-K1-B12
ggcttgtattgttcattcatgattagttttttggtgctgggacccccgtggagggggttagtctctacaccatcactgctggaacaaggccccagcttcgccttctatgtgcccctggtggtcctcatctccatctcccttgtgctgcagatcggcgtgggggtgctgctcatcttccttgtcaagtacgaccttaacaaccctgacaagcacgccaagctggacttcctcaacaacctggccacgggcctggtgttcatcatcgtggtagtcaacatcttcatcacggccttcggagtccaaaagcccttgatggacatggcaccccagcagtatgacaccc

SEQ ID NO: 57308 - DNA, 437 bp, Zea mays
  Clone ID: LIB3069-014-Q1-K1-G11
ggacctttgggctggtttatgtgcttgtctaggtctaacgcgttcgagtgagctacttggtggtgttttgagtttgttgtatgtaggggttagcggtggtggtggtggtggtcacgggtagtagtagtagtagttagcgggtccttttggttcgcttcggaaacgatgattttggatattgctcgattacggcaaaatcggcagaagtaataaagacgtgcgaggaatagacgaaggttgaagtctatctagggagaagtagtgtcgtagtagcagtccgcaggcggcgccaagaccgcagtctccgtcactagcgccaactgcctaccgctaggcggccgtccaccgctgctcgtaatcgacgttgcgcatcttttgacgtagtacgctggcactcgatcatcgaacccgagatggtcctctctggacgcccctct

SEQ ID NO: 57309 - DNA, 219 bp, Zea mays
  Clone ID: LIB3069-014-Q1-K1-G12
ggcacgcttccttgcgccttcgatcgcgcacgctctggacgccgattcgattgctagaacgagaaggggttcttcacgaggacactaagaaagtcaccaaggtcgtccttgagggcttatctaagggcactacgggccacgcggaagaggactcggccctcattgatccctccggcgatagtaggctgagtactcctgatgttaaggttgggactgtct

SEQ ID NO: 57310 - DNA, 456 bp, Zea mays
  unsure at all n locations
  Clone ID: LIB3069-014-Q1-K1-H10
tgcttgtttatgtgcttgtcccctcctctgaaagcacaaaaggcgcccgctcccgaaagtcagaaaaggcagtccctcaccacggtatactagcttaaattacaacccagctacccccacatcatatgcgtaacgggcacgaacttaagccgcgagagtgcaagaggcgaatacagtaattagcacgaaatcatccaagccgacggaagagtagcctttccgtcacgatcgacaccccactgaaacgtacagtaaaagtcacgcgatcagaaaaaaatggaaatactccacagcccggaacggagatccaataccccgccggtcaggataccgggtcacactccgtcattcntctatccggtataaacaatcctacccgccctttagagatcgccaccaacgtcccgtaggaacatataccaccctccggcacttaccgaagcacataacatccaa

SEQ ID NO: 57311 - DNA, 427 bp, Zea mays
  Clone ID: LIB3069-014-Q1-K1-H12
tgcttgattaagcttaatctaacgaaacatccgactctaagctcgacatcgaccctacagttatataggacccctcgagcctacgtcagatccatcgtataacatacccaacccttaacactcagacaccataatacctacttagtacgaaatcgccgcgtcgaccctccgaatcacacactacgccacaagtaaccaaaaaactcctctcatccgaacgcgtcagaccgattacattcaggttcccgcccttcctaaaatcaaaccgattcacaacgcgcgataaagggagcatcgtctaattgacccacggcgccccgagtcaaacacacgcgtttcgcccagcatcgacctaagcacaagccattcgaccagcgaattttagattaacttttagcagaacttcgcctaccaggagtacgggaac

SEQ ID NO: 57312 - DNA, 445 bp, Zea mays
  Clone ID: LIB3069-014-Q1-K1-H9
tttgggctgctttatgtgcttggcccgaggcagatacaaaggaatcgttcgcgtaaaccgatattctgattcatacgttactacaaacgggaaggataatcgagaagagaggaggacaggggagcgagtagttgctcggagacggccattcccgaatcacttgactcggaggacccgacccgttcttcccgcgcatcccaaaaagggtagttaggacgacgactcgcaccccaagataacgtcgctcgcccgggcccaggaccccgtcccgctgaaaatcagtatatccaccgcatcatcgagtagtacacccgcccctactttcgggccaaacgacgtgctcaaatatcctcgtcggttcgaaaagagtattattgctccggctctttagtagtaggtagtaccgatctgtcaaaaagccataacctctagacgtggacgagtt

SEQ ID NO: 57313 - DNA, 415 bp, Zea mays
  unsure at all n locations
  Clone ID: LIB3069-015-Q1-K1-A1
cactgctcaggtcgggaacgcagaggcgggtgcaacaagaaggccgggcgagaagacaagaggaagccaaaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgtagcaccaacaaaagcagccttggcgccacaggcctctgctgcgccgncaactacagctgcctcgccgcagctggctgccacgttggcccccgtttcctcaccgncactagct

SEQ ID NO: 57314 - DNA, 341 bp, Zea mays
  unsure at all n locations
  Clone ID: LIB3069-015-Q1-K1-A10
cccacgcgtccggcaggctccgggcttaagattgcttctcttctctcctccaaggtgtagggactgatcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgnctcgctgatgagctggtctgcgatccttgatgggggc

SEQ ID NO: 57315 - DNA, 348 bp, Zea mays
  unsure at all n locations
  Clone ID: LIB3069-015-Q1-K1-A2
gtcgggaacgcagaggcgggggcaacaagaaggccgggcgagaagacaagaggaagccaaaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgtagcaccaacaaaagcagccttggcgccacaggcctctgctgcgccgncaactaca

SEQ ID NO: 57316 - DNA, 432 bp, Zea mays
  Clone ID: LIB3069-015-Q1-K1-A3
aacaaggaaccaccattttgatgcaaaggttagcatctgcattttactcgagttacatgtgactgctaccccttaatcccggggtgcctttgatttgcgacatccaggagcagatgcgacaggatcacaagtaggaggagctgcgacgatgctgtagcgagagacatgggtgccgaggtcgttgtgctgcggtggtggcaggacaggaaggaaacgaaaaagcaggagccagggttgttcaacaacgtgaccgagtcgctgaggcgaggaagagtaaggtgaaggcactcgtcgacgcctttgagactgacagagcgtcatctcgctgcaggaaaccagcaagcctgctgctgctccagctatgaaagtaggtgtcgtgccatgagtgcttcttgacctgcagtgtgcatgatcacctttcttggaatttta

SEQ ID NO: 57317 - DNA, 346 bp, Zea mays
  Clone ID: LIB3069-015-Q1-K1-A4
cgaggacaggatcctcaccaccaacctgttttccgctgagctctccaagctcgcacgccagggcgtgctttggcacagaggatctcctctgtcaatgccatctccgttctctgcgaggcaaccggagccaatgtctctgaggtggcttacgccgtgggcaaggacacgagaattggccccaagttcctgaacgccagtgttgggttcggtggctcatgcttccagaaggacatcctgaacctggtgtacatctgcgagtgcaacggcctgcccgaggtggccaactactggaagcaggtgatcaagatcaacgactaccacaagagcctgttcgtgaaccgcgtcg

SEQ ID NO: 57318 - DNA, 381 bp, Zea mays
  Clone ID: LIB3069-015-Q1-K1-A5
gatctgcccctgcactgccgatcaaataaaggcacatccttggttccgaggagttgcatgggataaactttatgaaatggaagcagcatttaagcctcaagtaaatgatgaactggacacacagaatttcatgaaattcgaggaattggaaaatcctccagccaaaacaggctctggaccttcaaggaagacgatgctgaactccaaagatctgagctttgtggggtatacgtacaaaaacttcgatgcggtgaaagcaataaaaatttcagatctgcaaaggaattcatctctaacaaggccttccattggttcaatattcggtccaccaggcatggattctcccacggaaccaaacgggaggggcacacatatgcacac

SEQ ID NO: 57319 - DNA, 428 bp, Zea mays
  Clone ID: LIB3069-015-Q1-K1-A6
cattaacctcgggattaatgaaactgtgaaattatcagaatcaaatggatgcaagactgaacactttgtaggacccagtaaaattaatgctaataatactatttcttgtggagagggaggcgaacaatcagaaagaatactgcaggatgcaaatggaaatggccagccaatccatcagtcccagtatcttggtgagaccagtataggcaatgccacgcccgctcaacaagagaccagtaatggcaaggcctcacatgctgaacaatgttttgaggggtcatctcaccaaaaagagcatgcaaactctttaagaaacaaacgccaacttgaagaagataagtttcagaaaatgcttgctaagtcagcttcttctgagcttcggctgtctgtatggatggaatgatgctataattttatgcgctcgcaaa

SEQ ID NO: 57320 - DNA, 388 bp, Zea mays
  Clone ID: LIB3069-015-Q1-K1-A7
gacccacgcgtccggaagagacacttccgcagaaagaaaatgatccagctgatgatgccaaggagaatggagtagcttaatcgcaagaaaaatgaagaatgaatacaattaacttctctgctggaggggcagtaacacgcagaatcaaaaccatggcagtatttgttggtagttgtatttgcttttgctccatgtagcctctactccaaaacactttcttgacttgatatgatgctgtataattctagtgtcctatcagttttcagcttgcttatggtgcaattaaaattctatgtgcctgatgaaattgttcttatgaatgaagaatgataccaggactatgttcgttggcaaaaaaaaaaaaaaaaaaataaaaatggaagaaaaa

SEQ ID NO: 57321 - DNA, 391 bp, Zea mays
  Clone ID: LIB3069-015-Q1-K1-A8
cagaacttcactcaagatcttccccctgctcgtgttcgcacggtcaagaacagaaggattgcgtactccgaggccattcctctgagaggttcaacatccaacgacactgagcacctcaagagctttggcagtacgaagcctgtttcgtcagtggtcgtctctgtgctggctgatcccagagaggctggcgatggggatggtgagggaaggatctcttcaaaatcattgtcccgcatcttagttgtcgttcttatagatagtgttaagtatgttacgtactcttgtgtcctgccgttcaaaagccatagccctcacctttaggtcttggttttggacgtgagttgataaaagctgacctataccatttatagcagaagaggtgtaaggacaa

SEQ ID NO: 57322 - DNA, 411 bp, Zea mays
  Clone ID: LIB3069-015-Q1-K1-B1
cccacgcgtccgcccacgcgtccgcccactcgtccgctcaacttcttctctatcttgatgcttgcttcggttccaaatccactctttgaccttgctggtattatgtgtgggcaatttggtgtgcctttctgggagttcttgtttgctactttgattgggaaagccatcatcaagactcatattcagacactatttatcgtgtccctgtgcaacaatcagctcttgtatcttattgaaaaggagttaatctggatatttggtcacgttcctgggttttctgccacccttccgtctgtgattgccagactccatgctgccaaggacaagtatctatcaccaccagccccagtctcaccgtcatcacaaatgggggagaaacagtggaatttctcttttacatctgtctggaac

SEQ ID NO: 57323 - DNA, 293 bp, Zea mays
  Clone ID: LIB3069-015-Q1-K1-B10
atggtcaagactctttcaacaaggcctgactccaagcccaagagcggttcatacaggtgcaaggctcggcgaaaactgggacatatatgggggtggcaataataaaaaaggtgtttctgaaacactagtgctcaatatgtcaactctgacatggtcagttgttatcactctggaaagacacgttcctcttgccacagagggcatgactctagtgcatatcaattacactgggtatgattatatcgtctctttttgaggatacactggacgatacaacaacgcggtgtacactc

SEQ ID NO: 57324 - DNA, 333 bp, Zea mays
  Clone ID: LIB3069-014-Q1-K1-G10
tttgggctgatttatgtgcttgtttatgtgcttgaccgcccccgctctcacggaccatagtcataatagctcaaacagtcgaccgcaacttgaagtgaatagcttaaatagctctccgccccgagccattaagggaccccccgcgcgatctcgacaaaagacgcaatcgaacgccccaccacagcccacattacccgaattgcatccccaccgtctgttaaaaaaaaaaaaaaaaaaaaaaaaaaaaaaaaaaaaaataaaaataaaaaaaaaaacgacaaaaaaaagataaacataacactctataaaacaaggatacgcattaccgaaagc

SEQ ID NO: 57325 - DNA, 460 bp, Zea mays
  Clone ID: LIB3069-014-Q1-K1-C9
tttgggctgctttatgtgcttggagaccccggtacctttagcctagaagtacactctcaaacgaatcgaagaggaaggagtttgattccgacacggaaatattggtactccataaggaattaaaaattaacgccggtggcaggctactcctataaagtaacggctgtggactatataagcttaataagtgcgaaaagtctgatcctaactactcaagattgaagaaacgaaaaacggcgcctgagccagtctccgcatctcgcccgcagtcgcatttaaccggttactcgtcgcgccccgctgaccacactcagagagtcggcaattacgcttacgcgattacgcggtacgtacctccagcgagaccacgcggcgccaactaccccctccctcaccgacgcgcctcatctaatcatctcgtcgcaagacgcgaggtctcatcgcatagtagcgacgaacg

SEQ ID NO: 57326 - DNA, 444 bp, Zea mays
  Clone ID: LIB3069-014-Q1-K1-D10
ggacctttgggctgatttatgtgcttggacgccctcagcttcaagagagtcagggctcgaaaagaaccctaccgcaaaaaaacaccgcgacacgggagaagtcaccggagaaaacgagttacgtatcccgccgttcatagttcgcaattcatcattatattaagtcaactcgggcgaggcactttgcgtctagtgtatcaccgaagttgcggagaagtcgccgtcgtaggggacgggcctagccaccgaacttaaggataccaccggaactcataggatcttaccaccggacgattatggataagcttgccattacacctattaaaagtaagcataggccattggacgctactgcggaaatgtaaacgcttgccacgtacggtccttccgtcttaaaagtatcgcgtacgcaacgacgtcgaacggcgcccgtaagccgacaag

SEQ ID NO: 57327 - DNA, 435 bp, Zea mays
  Clone ID: LIB3069-014-Q1-K1-D11
gctggacctttgggctgatttatgtgcttgggctcccctaacgcctttaaacgctctcctggatcctaccgacgagccaactaaggtagacgaccccgatacgaactcgatcgccgacacgtcccacgagtcgaatctataagacacggcctacgacgacctcgaggccactaactacccctacgacgacctcgaggtcattaacgattcctacgacggtaagggtgcattcggcgtcgaccattataagatcgcggcgtttgagagcagtagtaatacgaactaagattcgtagaatgaggagctagtaataatcctcgacgcgaaactcgcgtcgttaaagcctctatagactaacccgtcctataacgattcgagttcgttcgacgacgacaagctagtggcgatcctcaccgtaaaccgactccctacact

SEQ ID NO: 57328 - DNA, 413 bp, Zea mays
  Clone ID: LIB3069-014-Q1-K1-D12
tttgggctgatttatgtgcttggtaggcgtctacccgccacgtcacttcgccgtacctaacacgatcatcggattatcgtaccgggagccgtcgtaaagggtaagggtcatagataattaggcgcgtcgcgtcctcccgcgcgtcggcgccttaccccttccaatccctacccggtactaccccgttagccccacgtcccaaaacgccaactgatcgcccggcgttagtcgcccgccgtaatacgtggtttagtctgagacattagcgtaggccacgccgtccggggatatcttatctccgccggattcgcaagccgattcgagacccttacccatcctttcccagcctcgctagcgattaccgtccactcagtccttagatcgacatcacgtattattatacaatcaacctc

SEQ ID NO: 57329 - DNA, 185 bp, Zea mays
  Clone ID: LIB3069-014-Q1-K1-D6
ccttggtaggcgtctacccgccacctcacttcggactacctaacacgatcatcgaattatcgaacggagagccctcataaaagttagggttcataaataattagccgcgtcgcgtcctcccgcgcttcggagccttaccccttccaatccctacccggtactaccccgttagccccacgtcccaa

SEQ ID NO: 57330 - DNA, 398 bp, Zea mays
  Clone ID: LIB3069-014-Q1-K1-D7
tcttctttcttgtctgtcctgaatttagggtttcccccaagttctgggtgacttggtcacataactcgtcagggcccttcttggttggtttggctacgctcctgctggtggtgtcttcttcttctttttcttctattgctgtcggttaggggttggctcgttagaggttgtttgctgttgttgctacttcgtagtaggtgcctattcgctgagtggcggatgttttacggtcttggagctattgtcttggtcctacggatggggacgacggggtttcgtaaaacgtagcaatatccgcgtcgtaaaataaggaggaccccgctgtcacctccctccacgtcctgcggcgttttcccctcaaaacccctaggataaacccctaaaaatcgctacttccc

SEQ ID NO: 57331 - DNA, 475 bp, Zea mays
  Clone ID: LIB3069-014-Q1-K1-D9
tggcctggacctttgggctgatttatgtgcttgtttatgtgcttgtttatgtgcttgggaacgcgaagacacggggaatactattagaccttaccgacgtcctcgaggatagaaaaagacccaacgtaacctctgaggagtcctaaaccgaatagttaaagggagggaccgtaagaagcgagctcgacgttccggtaaccgttctagaagcaggccatttcgccgcggcttgcttactacacgcctccggcggatgggtaacggagaccgcgcataatgatgaaaaatcgactaagcactctgtaattgtggcgtaagcagacttagaaaggttcgccccagcggataaacactcaaccgacgtagccgaaaccgacgccgacgtaccggtcgatatagtcgggaacgccgcgaccggcggaaccacggagtacactgagtaggtcggcacatacctaggcgacctagtacgcct

SEQ ID NO: 57332 - DNA, 264 bp, Zea mays
  Clone ID: LIB3069-014-Q1-K1-E10
cgtctacccgccacgtcacttcgccgtccctaacacgatcatcggattatcgtaccgggagccctcctaaagggtaagggtcatagataattaagcgcgtcgcgtcctcccgcgcgtcggcgccttaccccttccaatccctacccggtactacctcgttagccacacgtcccaaaacgccaactgatcgtccgacgttagtcgcccgtcgtaatacgtggattaatctgagacattagcgtaggccacgccgtccggggatat

SEQ ID NO: 57333 - DNA, 372 bp, Zea mays
  Clone ID: LIB3069-014-Q1-K1-E11
ggacctttgggctgatttagtgcttgaaaaaaaaaaaaaaaaaaaaaaaaaaacccaaacaaaaaaaaaaaaaaaaaaaaaaaaagggaagaaaaaaaaaaaaaaaaaaaaaaaaaaaaaaaaaaaaaaaaagggtggttgccccaaaggacttaagtccatccatgtgcgtccgtaatgctacagtcccctcacagggctattcaaaccaaaccaatcggttgctgccccataatgctgggatcgggaaaatttcggtgccatttaatccaactgttccgtagaaaacttttcccctgttagccggtgcaacagtaaaaaggtttgaattgactgttccctttaatagccgtttaattcgaacggtgaacg

SEQ ID NO: 57334 - DNA, 354 bp, Zea mays
  Clone ID: LIB3069-014-Q1-K1-E12
ggacctttgggctgatttatgtgcttgtttatgtgcttggtgttttgtggttttgctgggcttcttctttcttgtctgtctggaattagaggttctgtgatgctctgtgttacgtgggtctgtgactcgtcagggcccttcttggtgggtgtggttacgctgctggtggtggtgtcttcttcttctttttcttctattgctgtcggttaggggttggctcgttagaggttgtttgctgttgttgctacttcgtagtaggtgcttattcgctgagtggcggatgttttaaggtcttggggctattgtgttggtcctgcggagggggacgacggggtttcgtaaaaggtagcagta

SEQ ID NO: 57335 - DNA, 421 bp, Zea mays
  Clone ID: LIB3069-014-Q1-K1-E9
ggacctttgggctgatttatgtgcttggcctaagaagacgcccgattctactgagctcagcataattcgaatgggtatacttgtcggactcttgtttagacgaattgtgcttgtaatggtgagtcgcattgtcatactcgtgatattaagggtgttcctgcgtagttcgtccctcatgaggtccctgggtcgatggcggccgaggttacgattcgtggttcgtttatgcccgttatagttcatggtggcttggttgagactactgcgtatggtgcgctcggtcattatactgatttccattagggtgataaggtgctggtttcgtctgcggatcctcctgataagcgttaggtggatttgagttatcggagtaagactctttagggtgggtcttagtgcactgaggagaagcatattcgga

SEQ ID NO: 57336 - DNA, 426 bp, Zea mays
  Clone ID: LIB3069-014-Q1-K1-F10
tggacctttgggctgatttatgtgcttgaccgacggagaatacggggttacccacgcctgtacacccgacccgagagtcggaggagataagactatgtaggtcccgaaactcacacgtcggaggagtaaggttacttaagcagaggtcggcaagtaagtatgattggagaagcccgagacttcagtcaaaactaagtcgatatcgtagttacggatgctgagtccaagaggcggctactaagaaggtacatgagacggattccgtttagccgcatagttaacgatatcactatcataaccctctaaggacaggggcgccgtccagtccgcagtaattgacgataacgcccacccccgcatcctgaatcacgcccgaaagtacgctccctcccctagatagcggccgatcggcaaactaaccgtaga

SEQ ID NO: 57337 - DNA, 451 bp, Zea mays
  Clone ID: LIB3069-014-Q1-K1-F11
tttgggctgatttatgtgcttgtttatgtgcttggtggcggtcgcttatccgtactacaggagtactcatgaggagggtgatgtgactaagtgatggaagtgtcatgtttgtttcccggccgactcctagacgaagacgcatcaccatgaggggacggagttccggagtttgaagaaaaagacgttcggtgacgcgttggagggagttgcgtcgacttgggaatatatagtgatgattaattcgcctagtcgttctcggcctaatgaggcgaattctcctattttatgtgattagactagtcctggtcatgcggtgtgtaggtctggtgatgtctctgagtctcctacgccttttaatcgtgagcataatctgtcgcctgcttcgtataggtatatgagggagtatctgctcaaggctgagcgggttaaaatggctgatgagactgcggag

SEQ ID NO: 57338 - DNA, 422 bp, Zea mays
  unsure at all n locations
  Clone ID: LIB3069-014-Q1-K1-F12
ggacctttgggctgatttatgtgcttggctgttcagtcccggagattcgaattatccgactagcgtaataacgagcggagcgatccgtcgttcttgtcctttcggatagtcgaatctggattcgtgtaagtctgtagctaattcgaccttgcctttctgttcgtatcctcccacggctggtcccgtgttatctattctgtgcggtctgtagtagcattgcgtctctatcgctttcgagtcaatttagtagacgcgggacgttaagaatacgacgcgcgtcgtcgatttgtgctacggttgtcactctatagtactcgttacgccttgcggaaagacgagtattaaggaggcggatgagtaaacgactaacgcttagaataagaatctgcntcatcctgcggagcggacttttaataacgcga

SEQ ID NO: 57339 - DNA, 445 bp, Zea mays
  Clone ID: LIB3069-014-Q1-K1-F9
tggacctttggtctgatttatgtgcttgtaaaactcggacgtccacgtgaagtctccttaagtatttccgctctgcgtttaggcggaggtctctgtcgtctctcccggtcgggcgacgctcgacgacgaaggcgaggccgcctttttcgggatagttatctcggctcgtcgaccatagtttatggctgttcaacaccttaatcgccgcttcacggacttcctttcaacttcacctcggaacgcttgtggctctaatctcgttgtcagataggacgccgtcaggagcccggccgacctgtcaagagcagacgccgctcgcccgtaagaaataaagccggctaaccgtgactgttgtatagccccgctaacgccaggtgtcgacctcgataacaatcctacccgctcgtttctggccggggtaagcggcggggcgtcgaccctccgg

SEQ ID NO: 57340 - DNA, 468 bp, Zea mays
  Clone ID: LIB3069-014-Q1-K1-C12
ggacctttgggctggtttatgtgcttgtggatgtgcgggtttggtctgagactgaacctttgttctcgttaagtagtactctcctcgataagggtcttctagacgagcctactgacgttaatacttagtccgtctctgccgccgtcaggaagtctaaagagtctaaggggatcaggctccgcacagcgcccttcgactaattcgaaaaatgcagggtactagagccgcctaagatagtcacagatatgaccgagggcgcaattactagtctttcggacgacccatttatcgatttcgctaatagtcctcctaaactaacaagaaatatttcggaccccgatcctctagacgataacgaaggcagacggaaactcgacgaattattactgccacacactcctactaatagtagtatgtgcgattccgtcctcacagagaagcacgcggaaaaagccgttatactcgcct

SEQ ID NO: 57341 - DNA, 227 bp, Zea mays
  Clone ID: LIB3069-035-Q1-K1-C4
accagacgccgtcagcgacgaccttggcttctcgtcatggttgcggtgccacgagtagtaggcgtgcgtccggttcaccaacaggtactggatgcccaccgacgacgacacaaactgacgatcaccgccgcagagggaacaaattactgatagatcagcgtagcacgttcctgagctagccccgccccctttatgttctccaattcagtaatgcaatgcgtttttat

SEQ ID NO: 57342 - DNA, 77 bp, Zea mays
  Clone ID: LIB3069-035-Q1-K1-C5
cggacgcgtgggtttttttggggttcattttaatgaaaaaaaaagaaaaaaaatgaaaaaggaaatagggcatgctg

SEQ ID NO: 57343 - DNA, 298 bp, Zea mays
  Clone ID: LIB3069-035-Q1-K1-C6
cggacgcgtggggtctcccaccggtgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatatataccccatccctccct

SEQ ID NO: 57344 - DNA, 286 bp, Zea mays
  Clone ID: LIB3069-035-Q1-K1-C7
ggacgatcgcataccactctctcctcgagtcagctagggctggtggtctcacgctggaactgaatccagccatggccgggctgagaatttccgacagcaggaaagggtgcagcatgtaaaggggggagcagatgagatcatgtttgggatgctcccagatatgtatagttatgtatcagccagttgtttgtaaattaccaattaatattagaagttattagaaaaaaatggagttaacttgtacgtttcgtgtgctctgtcatctgaagcaattaaagtggttagc

SEQ ID NO: 57345 - DNA, 343 bp, Zea mays
  Clone ID: LIB3069-035-Q1-K1-C8
cccacgcgtccggttagaaacaagtatatcataagagtttccttgcgaaggaacacctcaagagtctaaagtctaaagggtgttgtcccaggtcagatgtctatcactattagtctattatcacctgccaattcatgcacatcatttccatcattgtctgtgcgaatcatacatgaccaagagttagcaaacagagaaaataaataatcagacattcagatgggtatgtgctgtgtgtagcaacaaattataggatgacgaacatagagtatttgcatgcttgttgttgagtattgttcatttaccggaccatctaaagcctttgtttctacactgctctata

SEQ ID NO: 57346 - DNA, 332 bp, Zea mays
  unsure at all n locations
  Clone ID: LIB3069-035-Q1-K1-C9
cccacgcgtccgcttagtcagattcaagttattaaagaggcagttgagcttcccttgactttccctgagctatattaatacattggtattaggccttccaagggagtcatattataaggagaacctggaacaggaaaacctcttcttgccaagaacaaattttgagggtgagcatgatacagtcactgagaaggacctagaacatctnctgcaacttttagataataaggaaagcggggatacagcttggcagaatttgatggagcgtagaacctncaacatgacatacaatgcctggcggcgtgagcctgangagggacctataatgtact

SEQ ID NO: 57347 - DNA, 389 bp, Zea mays
  Clone ID: LIB3069-035-Q1-K1-D1
cgctagggtttatctgctcgaggaatggtttcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagc

SEQ ID NO: 57348 - DNA, 318 bp, Zea mays
  Clone ID: LIB3069-035-Q1-K1-D10
cccacgcgtccgccccggccgccgcggtgtcaacccagctctccggagcgcccgcgacccctgctcccgtcgtcagggtggcggcgccgcgcggagtcgcctcgccgtccgctggcgccgcgtgcagggccagcgggcaaggggaaggaggtgctcagcggtgtcgtgttccaacccttcgaggacatcaagggggagctcgccctcgtgccccagtactcagacaagtcgctcgcgcgccacaagttcgtggatgactgcgaggccgccctcaacgagcagatcaacgtggagtacaacgcctcgtatgcataccac

SEQ ID NO: 57349 - DNA, 333 bp, Zea mays
  Clone ID: LIB3069-035-Q1-K1-D11
ccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaagtgtgcgaccattactccagatgaaactcgggtt

SEQ ID NO: 57350 - DNA, 336 bp, Zea mays
  Clone ID: LIB3069-035-Q1-K1-D12
cccacgcgtccgcggacgcgtgggcaacgtcaccagctagcagcagcagcagcagcatggccaccaccagcacgcctcgcctcgccaccctcctggtgctcctggcggcggcgtcaccgctgctgagcgcagctcaaaaggccgccccgaaggctccggcggcggcgaaggcggcgccagggccggcggcgtcgtcgtcgtccggcgcgggcgcggcggacgcggcccctcccacagacgtgaacaaggcgctcaaggacgaccagttcagcgagttcaagcagctgctgcacgacacgcgcgtggacacgcagatcaacgcgcagctgacggaca

SEQ ID NO: 57351 - DNA, 358 bp, Zea mays
  Clone ID: LIB3069-035-Q1-K1-D2
cccacgcgtccggccacactgaagccaactcatagtgatgcagtccttcaggagatcttagagaggaatatggctactgaggaaatactgcatactgacatggctgctgaggatgcacctacaaccaatttgatcaccgagaagtcatcaatgaaagatgcttgacaggagccagttcaaactaacgaaccatctgagcaggcactgataactgaagagattgataagccacagcatagtgaaaagattgctacggacacgagatggactgaagaatctactgaggagatgcttgagcttgaaagtaatgccactgaattaaacaaggatcaatgagaacttgaagggctttcatctg

SEQ ID NO: 57352 - DNA, 431 bp, Zea mays
  unsure at all n locations
  Clone ID: LIB3069-035-Q1-K1-D3
ccgggaaagagcttacgctgctggggtgttgggcgagcccgttcgtgctccgggcgcgcatcgcgctcagtctcaaaggcctcacctacgcttactgcgaggagaaccttgacgacaagagcgagcttctcctcagcttcaaccccgtgctcaagaaggtgcccgtgctcatccaccacggcaagcccgtctgcgagtcccagatcatcgtgcagtacgtcgacgaggctattcccggcgacgcacctaatttccttccatccgaccactacgaccgcgccattgctcgcttctgggcctgctacgtcgacgacaagttctacagcgcgtggatacccgtgttcaggggcatgacggcngaagagatggcggaggctgccaggcaggccgtcgcggcgctggagacactggagcaggcgttcagggagtgc

SEQ ID NO: 57353 - DNA, 412 bp, Zea mays
  unsure at all n locations
  Clone ID: LIB3069-035-Q1-K1-D4
aaaggcaaggctgtcgattttaaaggacatatactccagttctctggatttgtttggcatgaaagtgatgaaaagcacagagtcaaggcaaaagaaaagcttgacaagtgtgtaaaagaaacgctgttggacctttgttggacccttggcattccaactccaaaagcaaacattagaaaggaagatattgtgtcaaagctgttggactttattgctgaacctcactctgcagctgattctgggctctctgatgaccagggttcaaattctaaaaaacgcaagagaggaggtgaaagtgcacgtaagacttctgatagcacacctagtangtcaagaaagaaattatcaatgacagcacttctagtaaaaggcagaaaaaagcgctcgaatatgatactgatgaggatgaatc

SEQ ID NO: 57354 - DNA, 324 bp, Zea mays
  Clone ID: LIB3069-035-Q1-K1-D5
cccacgcgtccgccctttcgtccgttatttcaacagctatcaccaccgccagcacgatggctgttaccagcacgcgtcgggtcgacacactccaggagctcctggcagcggcttcaccgctgctgagcgcagctcacaacgacgcccctaaggctacggctgcggggaaagctgctccagggacggctgcaccctcacattccgtcgcatgcgctgccgacgctgaccctctcacaaacttgaacaaagcgctcaatgacgaccagatcagcgagttcaaacatgctgctgcacgacacgcgcgtggacacgcagctcaacact

SEQ ID NO: 57355 - DNA, 272 bp, Zea mays
  Clone ID: LIB3069-035-Q1-K1-D7
ccaggcctacaccttgaagcggatccgggaccgggactaccatgtcacgctgcgccccgacctttccaaggagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggttcttcgtattttcgcggat

SEQ ID NO: 57356 - DNA, 427 bp, Zea mays
  Clone ID: LIB3069-035-Q1-K1-D8
gatggttaccagccccacttgattgcccttgagcaaggatacagaaggcttatagatagttctttaagctactttaagggtccagctgaagcgtctgttgatgcggtccatttggtcttaaaagagcttgttcggagatcgattgcagcaacagaggaattgaagcgatttccaacacttcaatcggatatagcagctgctgcaaacgaaagcctggaaagattccgcgaggatggacggaagactgttcttcgtctaatagagatggaagccagctacctaacagtagaatttttccgcaagcttcctactgaaccagagaaagcggctgataagaacactccagtgagtgatagatatcaggacaatcatctcagaagaataggatcgaatgtgtcatcttatattaacatggtctgtgagactc

SEQ ID NO: 57357 - DNA, 330 bp, Zea mays
  Clone ID: LIB3069-035-Q1-K1-D9
cggacgcgtgggcggacgcgtgggccggtgttcgttttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtgga

SEQ ID NO: 57358 - DNA, 287 bp, Zea mays
  unsure at all n locations
  Clone ID: LIB3069-035-Q1-K1-E1
gtgacacagttccacgcagcagatcagagtgctgcaggtacgctagcgatctagctaccgctgtgctgcgtacagtacgtagtaccatggcgaagaaagtggccactctgctggccctcaacctcctcttctttgccttcgccgacgcatgcggctgcaggtgcggcggatcctgccctagtccaggcggcggtggcggtggcggtggaggatctggtggtggtggtggtggtggtggaagcggtnggggtgggagtggagggggtggatcgggtggtgggagcggt

SEQ ID NO: 57359 - DNA, 348 bp, Zea mays
  Clone ID: LIB3069-035-Q1-K1-C3
cccacgcatgcggattggacaaggccatttccttaagaaatttgtgattgtgattgcaggactgtggatcctgtatgttcttgggagctgctgcaattatctcaccttgtcttacatagttagtatggtactgtacactgtaccggtcctgtatgagaaacatgaggataaggttgatgcttttggagagaaggccatggtcaacctgaaaaggtactacgacatatacgacgagaaatgcctattaaagattacgtatggcccattaaaagacaagaagcaccattagaagcttagaatcagataagggtacctggagattgatcatctgtaatgaccattattcgt

SEQ ID NO: 57360 - DNA, 335 bp, Zea mays
  Clone ID: LIB3069-035-Q1-K1-A9
gctgggagaggctttacccttgaggagcttaaggctgctggcatcccaaagaagcttgctccaaccattggtatttctgttgatcaccgccgcaagaacaaatcccttgagggactgcaggccaatgtccagaggcttaagacatacaaggccaagctggttatcttcccaaggcgtgcgcgcaaggtgaaggctggtgactctactccagaggagcttgccaccgctacccaggtccagggtgactacatgccatttactcgtggtgagaaacgttcagttgaggttgtgaaggtcacagatgagatgaagtcatttgctgcctatggcaagct

SEQ ID NO: 57361 - DNA, 243 bp, Zea mays
  Clone ID: LIB3069-035-Q1-K1-B1
cggtcgaccacgcgtccgtgacggatacgatgttaaatggaactttattatgagcagcgacagaatgaatgaagtgtgaactctttcactatcaggacggacgcaaactgcaaatactaactgctcatgtgatcaatcataagagtaagagatcgcgtttgaaacattagcaattagcgtaaggaaagaccttgctactgaacgaatgacatcaagtataaatggttcgacacatatatttca

SEQ ID NO: 57362 - DNA, 293 bp, Zea mays
  Clone ID: LIB3069-035-Q1-K1-B10
ccatagggctatttataagccgcatggcatcagggaataaatcaaacaagatcattatcaaaccaatctctctctcccttgcaatgaccctctcaagcgcctagggctgctaccctagaaccaagcctatagcagaggggtataacctcgccggagaagacaactatccccatggaccgaaggtccatgacacctggtatcagcttcaggttatcctcaccaacaacagccggccattccttaccaccaccagccgtcgagccatctggcggcggaacgggcctccaaccggc

SEQ ID NO: 57363 - DNA, 334 bp, Zea mays
  unsure at all n locations
  Clone ID: LIB3069-035-Q1-K1-B12
cccactacgcggtcttcgctcgctcctcgagttcagtcctcacctccccaccgagctccattaatggcgcctcccctaattttgccataagtgccgagaccacgtggggtctgggaaggaaaggctactgccacttcagaggtcggcctgngaggctgcatcgcatccacatggngtaccagcccatgcacggcaacggcgggacagccggtgccgggacatcaggctccggcggcggcggcggcggagaccacttgcgccaccaccaccagcagcgcctgcacagcccccgcatggcccgcngaggcttcatgacgcgccgggccagctcgtt

SEQ ID NO: 57364 - DNA, 350 bp, Zea mays
  unsure at all n locations
  Clone ID: LIB3069-035-Q1-K1-B2
cccacgcgtccgcccacgcgtccgcccactcgttcgcggacgcgtgggctgacctcgttggcctcacctacctaccaatggttatcaaggaggttcttcggctgcatcctccaaaccctctgttggtcccgcgtgagtcgagagaggattgccaagtcatgggctaccacattcccaaaggcaccaaggtgctcgtgaacgcatttgcgatctccagggattcaaggtactggaacaaccctgaagattttagcccagagaggtttcagaataacaatgtcgactacaaagggaccgattntgagttcacccncttcggtgctggtcgtcgacgctgccctgcaatcatg

SEQ ID NO: 57365 - DNA, 427 bp, Zea mays
  Clone ID: LIB3069-035-Q1-K1-B3
ctgggagctttgctggtctatgacattattagacgccagagcttcgatcatataccccgctggctagatgaactccgagcccatgccgacaagaacattgtgataatgctggttggcaacaagagtgatctcgaggagcagcgagcggtgagcactgaagatgccaaggagtttgccgagaaggagaacctcttcttcctggagacctctgcgctccaggcaacaaacgtagagagtgcttttcaaactgtcttgacagagatattcaagatccacagcaagaagaacatggtgtcggagccgaagagcaatggagctgcccaagcaatgccggggacaaaggtccttgtcccaagtccggcgcaggaaatccccaagagcaagtgctgcagttccatgtgatgcttctacgtttgggtactggtgg

SEQ ID NO: 57366 - DNA, 416 bp, Zea mays
  Clone ID: LIB3069-035-Q1-K1-B4
ggagaaatgagcagttttgggttattggttgcacttctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctttaccccttcctcaagggtctcatgggcaggcagaaccggacgccaacaatcgtcatcgtttggtccatcctccttgcgtctatcttcttcttgctgtgggtg

SEQ ID NO: 57367 - DNA, 423 bp, Zea mays
  Clone ID: LIB3069-035-Q1-K1-B5
gcgcccacgcgtccgtccacgcgtccgtgttatggtgggcaatgatttaatgagttttgtgagtacctggccactaagttcatggaaggaaactcttgctctgctttgcacatttgcacagaaagaggagtggcatattttgtgtgacacacttgcgtctaggcttctgaatgtcggtgatacactagctgcgaccctctgttatatttgtgctggaaatattgacaaagctgttgaaatatggtcccgcaccttgaaatctgaagatggtgggaagacttatgttgatcttctccaggatttgatggagaaaaccattacgcttgcccttgctacgggccagaagagatttagcgcgtcactgtctaggcttattgagaactacgctgaattgctggctagtcaaggtcttcttaaaactgc

SEQ ID NO: 57368 - DNA, 298 bp, Zea mays
  unsure at all n locations
  Clone ID: LIB3069-035-Q1-K1-B6
ctctgttatcagttgaggggatcgatgtttatgcagttaacaggtctggagagactgcatttgccattgccgagaaaatggacagtgtagaactcgtggacatcctgaaagaagctggtggaaaagccgcaaagcagcaagtacatcctgcgaattcggcgaagcaacttaaggaaacagtcagcgatatcagacacgacgtncagtcccagttcaagcaaacacgttagaccaagatgcaagtcaaccagatcaagaagaggcttgagaagcttcacatcggcgggctgaacaacgc

SEQ ID NO: 57369 - DNA, 365 bp, Zea mays
  Clone ID: LIB3069-035-Q1-K1-B7
gcgagcggcgcccttttttagtgtttttacatgagtcgggtcaaactgaggtcaacatatatgctggacaaagacaactttgccttgtactatgtgatattgccttgtgctctgctagcgctacttgttcatccttcaacatcgcacaacatagtgaacagaatctgctgggccttctgtgtttatttggaagcagtttcagagctgccccagttgcgcctgatgcaaaatacccagattgttgagccgttcacagctcattatgtgtttgcactgggtgttgcaaggtttcttaactgtgcacattgggtccttcatgttttggataccccaggccgcttgttgactgctctgggctattggtt

SEQ ID NO: 57370 - DNA, 419 bp, Zea mays
  unsure at all n locations
  Clone ID: LIB3069-035-Q1-K1-B8
cccacgcgtccgctctttacaggagcgctttttcactgaaagtggaacgtgttgcaagttcttttagtacactatttactatcactttgttgatttgctaggtgataacaaagttctgctctgaaagaattgccaagtatgcttttgagtatgcataccttaacaatcgaaagaaagtgacagcagtgcataaagccaacatcatgaagcttgctgatggtttgttcttggagtcttgccgtgaggttgcaaagaagtaccctggaattcaatataatgaaatcattgtggacaactgttgcatgcagcttgttgcaaagcctgaacaatttgatgttatggtcaccccaaatctttatggcaatctggtggctaatgtanctgcaagtattgctggaggcactggtgtcatgcctgga

SEQ ID NO: 57371 - DNA, 264 bp, Zea mays
  Clone ID: LIB3069-035-Q1-K1-B9
gagacattaaatgcgcatatattctggtgcatgcttatggatctgtgaagcttgcacattttggactcgctaaggagattaccaaattcaatgaacttaaatcatgcaaaggaactgtttattggatggcaccggatgttgttgatccgcagcagacatatgtacctgcagatgatatattgagtcttggatgcactgtcctggagatgttgacacgccagatacgctatcctgaccttgaatgggcacaagcttatatacagg

SEQ ID NO: 57372 - DNA, 411 bp, Zea mays
  unsure at all n locations
  Clone ID: LIB3069-035-Q1-K1-C1
ggagaagaggataagaggaagcgagtggtgtctgtgagtgagttggaaggaggggggtggcaatggcgttgcggaatggtggtggtggtggtggagcctgtcccgcggcggttgtgctggtggctgcggccgtcgcggcgctgctgggcgccggggtggcggcggcgaccaagttcgacgacgtggtgcagcccagctgggccaacgaccacgtggtgtacgacggcgacctcctcaagctccgcctcgactccagctccggcggagggttcgtgtcaaggaccaagttcctgtacggcaaggccagcgccgacctcaagctcgtgccgggggactccgncggcgtcgtcacggctttctatctgtcgtcgggccgggacaagcacaacgagttcgacttcgagttcctgg

SEQ ID NO: 57373 - DNA, 337 bp, Zea mays
  Clone ID: LIB3069-035-Q1-K1-C10
cctaaatccagcaaacgcaaaccccatcatgccgtcgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctccttcagacctcgcgctccgccgagaagatgtacaagatcgactcccacctggcgtgcgccgtggccgggatcatgtgcgacgccaacatcctcatcaacagccgccggctgcacgcccaacgctacgcgc

SEQ ID NO: 57374 - DNA, 335 bp, Zea mays
  Clone ID: LIB3069-035-Q1-K1-C11
cccacgcgtccgcactaccttcccaacatgttcaagaagtttgtcgttcacaacgtctctgagctggagctgctgttgatgcacaacaggacatactgtgccgagattgcccacaacgtgtccacccggaagcgcaaggagatcgtcgaacgtgctgcgcaactggacatcgtggtcaccaacaagcttgccaggcttcgcagccaggaggacgagtgaaatggccattatttccggttgtgatccgctggtgtgcaagatgttgctgagatccgagattcattctctgccatttttttatgcttatgttagacttttccaatggacaaaattct

SEQ ID NO: 57375 - DNA, 340 bp, Zea mays
  unsure at all n locations
  Clone ID: LIB3069-035-Q1-K1-C12
cccacgcgtccgaaggaattaagcgatggtgcctgcgccgggaggcccgggacggagagggagatgcatgctgctgcttctgggggctctcgccctcgcattgcccggcgctgcgactgcgaccgcgtggcctcaccctcacggcggcgccgccgnccccgccgcgggtgcgggcaggccgggcggcgccgagcgctggtacagggatctcgcactcaggaggatggagagcgtcagatcctccttcggggccagaagagatttggcgacggcttccgcgagcgcgcgggtgtaccacgtgacggactacggcgcggaccccgaccgcgccgncgacgcc

SEQ ID NO: 57376 - DNA, 356 bp, Zea mays
  Clone ID: LIB3069-035-Q1-K1-A8
gagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgtaagccatatccatctgccatggaaatagaccaaattctaccattcacctggtactccggaagtgctaaacatgtggtaccgtccattccttgcgagcacaggccacgacgttgaggacagcacga

SEQ ID NO: 57377 - DNA, 283 bp, Zea mays
  Clone ID: LIB3069-035-Q1-K1-C2
cggacgcgtgggaaaaagaatcaaaaatttcagtttaaagaaaagaaaagaaaaaaagaggaaagggctaagccgaatgaatggaaaaggtaaaaaaaaaaaaaaaaaaggcgggtctacttaaaggtgccacctttacggtcatgataatgcaacgaattacctttttgctactggtcctgaaaaataatggagtctgtctataatctcaactacatggttggtaaaaccttgccgtgaaacaattatctgggctactgttaattacatatttttgaggcta

SEQ ID NO: 57378 - DNA, 106 bp, Zea mays
  Clone ID: LIB3069-034-Q1-K1-H11
cccacgcgtccgcccacgcgtccgcccacgcgtccgcccacgcgtacgcccacgcgttgggggacgcgtgcgaggacgcgtattccgttgcggagaccgattcgtt

SEQ ID NO: 57379 - DNA, 429 bp, Zea mays
  unsure at all n locations
  Clone ID: LIB3069-034-Q1-K1-H12
cccacgcgtacgcccacgcgtccgcggatttttaaccagttcagagtacggatctgagctgcagaggtcgccctcaccgtctactgagccgttacagaggtcgtggacaagggagcagagccctagggccgctggcttcgacttcttcctgagcaataggagcaatgactcgccacctgtctacaggaaggaacccgatgacgcggcatcgcagtccgagtctgacgcgaagtctgcagacggtgaggatgatggcatcgcctacacgctgcaccagagagttcttgagctagaggacgagctcaatgcgacaaaccagaaactacaagatgcagacgagaagcttgaggttctggaggaaaagagcttgangtgccattgcgattataaagagaatggaaactgagctcagcgaactacagaagtttc

SEQ ID NO: 57380 - DNA, 418 bp, Zea mays
  Clone ID: LIB3069-034-Q1-K1-H2
cccaacaacgtcaagtccagtgtttgtgatatccctccgcgtggcctctccatggcctccaccttcattggcaactccacgtccatccaggagatgttccgccgtgtgagcgagcagttcactgctatgttcaggaggaaggctttcttgcattggtacactggtgagggcatggatgagatggagttcaccgaagctgagagcaacatgaacgatctggtgtccgagtaccagcagtaccaggatgccactgctgatgaggaggcggaatacgaggacgaggaggccatccaagacgagtaagggtggtttgggccctgccacatttgtacccttggttcctttcattccggggcttgcctatggtttgcctggtgtatttgctcaagttatgccgtatgtagtagtacttttcgtg

SEQ ID NO: 57381 - DNA, 377 bp, Zea mays
  Clone ID: LIB3069-034-Q1-K1-H3
atcaaggtttctggccgaaaaagcttatggaaggttgctcctggtgacgctgagaggctttcagcttttgaggttggagattgggtccgcccaaaaccaagtattgggagcagacctacttatgactggaatagtgttgggagaataaacattgcagtagtccatagcattcaggactctggttacttggagttagctggctgtttcaggaatgggaagtggctaacccataacacagacattgagaaagtgcagacattaaaaattggtcagcatgttcggttccgtgctggaatttcagagcctagatggggatggagagatgcgaaccctgattctagaggcatcatcgctggtgtacatgctgatggagaagt

SEQ ID NO: 57382 - DNA, 396 bp, Zea mays
  Clone ID: LIB3069-034-Q1-K1-H4
cccacgcgtccgcccacgcgtccgcgttgcgtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgtcgccgccaagaaggatgagaaggccgtcaacgccgcgcgccgcgccggtgcggagatcgataccatgaagaagtacaacgctggtacgaacaaggcggcattcagcggtacattcctcaacaccaagcgcctcgacgacgacaccgaaaaccttggccatgaacgagttc

SEQ ID NO: 57383 - DNA, 202 bp, Zea mays
  Clone ID: LIB3069-034-Q1-K1-H6
ctctctttctctctctattctttccatccccgcttctgggaagctcatcagccatggacgacgcctcgggagagggagaagcttcgatgttcgagaccagccatgtccttggcgccctgctggccttctcggcgatgctggcgtccggctgggaccggtgtacgaccggcacaagcgcggcgcccgggttcgtgcccggaaa

SEQ ID NO: 57384 - DNA, 435 bp, Zea mays
  Clone ID: LIB3069-034-Q1-K1-H8
cagcatctgccaaaagttcccctatttggtcaaaaagaaattaaaggaaggggaggaggttagacgagttgctcaacttgaatggaagataattgagagtgatattcagaaaccattcacaacttcagggctagagtttgttcccttgccggtgatccatggtgaagactacatttgtttgggtttccttttcggaaggaaatcaaaagttgcttacatatcagatgtttcacggtttcccccaagcacagaatatgcaatttcaaaatctggaggaaggcaacttgatttgctcatcttggattgcctatacaggacgggttctcacaatgtgcacttgtgttgggaccagacactagatgctgttaggaggaattgccccaaaagagcacttgctattgggatgacccacgagatggatcatcacaaggacaa

SEQ ID NO: 57385 - DNA, 349 bp, Zea mays
  Clone ID: LIB3069-034-Q1-K1-H9
cccacgcgtccgcaccgctctgcctcgcctcgcctcacctcacctcacctcgccgactagggttttgtaccgccgtggatctcgccgtccccgccatggacgtctcgcacgcgggatcctccgtcgccggcgaggctccgacgaccggggagcaccggatggggactaccatcgtcggggtctgctacgagggcggcgtcgtcctgggcgccgattccaggaccagcactggagtgtatgtagccaaccgtgcttcatacaagattactcagctgacagacaatgtgtatgtctgtcgctctggatctgctgctgatacacaagtcatttcggattatgtacgctattt

SEQ ID NO: 57386 - DNA, 310 bp, Zea mays
  Clone ID: LIB3069-035-Q1-K1-A1
tccacgcgtccggattgagtggctcaccttctttcccagccagcacgagcttgcaagcaagcgagctcctgagatttcagctcgcttctcctccagaggtcgagcagaccagactcctccgaccgaagctctaccacttgccagttagcctgtccaggaactgcttggccggagatccaaacaaacctctgtgttggggttctccggggttccttgcgctggagggaggtttcgatctcgctggccatggtttggctgagaagcagcagcggcagcatcttgatgccaaatctctgagctttatgaagat

SEQ ID NO: 57387 - DNA, 300 bp, Zea mays
  Clone ID: LIB3069-035-Q1-K1-A10
acgaaatactcagatgttatattacatagcgtgtttaacctcatgacgtgcaccacaatctagtggccgctgtccgtatgcctagtgataagcaccgccacaacctagacgctaaggtgatagacagcacaatggacagcagtgtatgctacatctacgtgcagagctacctatattgccaatgcgttgtctgacggtgaacagctctttacctatactacatatgagctagtcatgcttacacaggttaccagagactgcatgccatgtactattggagagatacgtcaattttagggt

SEQ ID NO: 57388 - DNA, 342 bp, Zea mays
  Clone ID: LIB3069-035-Q1-K1-A11
acgcccacgcgtccgcccacgcgtccgcccactcgttcgcccacgcgtccgggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgt

SEQ ID NO: 57389 - DNA, 188 bp, Zea mays
  Clone ID: LIB3069-035-Q1-K1-A12
gaattcggcagacccacgcgttcggggtaatataacgcgacgcgttattttaaaactccgcagaacattgctacgcgagaccttatcgtcgccatgccttctaagggacagggctggtaccctatcaccaacgtgtggcacaggggttaacctgccatagatgaccactatgcccatggaccgaaggg

SEQ ID NO: 57390 - DNA, 412 bp, Zea mays
  unsure at all n locations
  Clone ID: LIB3069-035-Q1-K1-A2
cacacaactagggcgaccgccgccgacctacggccagctgtgcccatgtcttcgtcgggcccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgcttaagtcagaggaaaagcatncatacatcaaagttgactggaacanatggtgc

SEQ ID NO: 57391 - DNA, 433 bp, Zea mays
  unsure at all n locations
  Clone ID: LIB3069-035-Q1-K1-A3
tttctccagaaaatgttaaatatgctgccatgcttggtctgtcagcagcagcaatgaagtctaagctctttgccgatcaagaagaacgcgaagtgcaaagactaactgctactgtaataaatcatcagttgaagagattggagttgaagctgaagcagtttgcggaagttgagaccttgctcttgaaggaatgtgagcaagtagaaagggttagacacaggatttcagctgaacgcgtcaggatgaggtcagccctattaggtcccaccggaagcggtctaccagggggcagttgtagcactatgccatcaaatccagcaggcatgagccccagaccagtcggtgtgccaggctacatgccacagaccagcatgccagccacatatgccaacaacctgcaggggcatgggaatnctcagatgccgttcttaca

SEQ ID NO: 57392 - DNA, 388 bp, Zea mays
  Clone ID: LIB3069-035-Q1-K1-A4
cacagttctatgaccattcgtgccccaaggcgattgagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgctgctcgtgattccaccgccctggttggtggaccatactgggacgtgccacttggccggagagactcggtcggtgcatgcattcaggg

SEQ ID NO: 57393 - DNA, 322 bp, Zea mays
  Clone ID: LIB3069-035-Q1-K1-A5
gccacgcgttcgcccacgcgtccgttccatgcgagccagcacgagctggcatgcgcgcgagctcctgagatttcagctcgcttctcctccagaggtcagagcagaccatactactacgaccgaagctcgtccacttcccagtgagcctgtccaggaactgactggccggacatccaaacgcacgtctgtgcaggggtgctccggagcaccttgcgctcgacggaggtttccgtcttaatggccatggggagactgctaaggaccatgggcggcatcctgatgccaaatctctgagctttatgaacatagccactcacatgtg

SEQ ID NO: 57394 - DNA, 428 bp, Zea mays
  unsure at all n locations
  Clone ID: LIB3069-034-Q1-K1-H10
cccacgcgtccgcccacgcgtccggggaaagggaacgggagcgggaggggaatccaattgcgatggcctccgactcgggcgatttcggtggggagaacaagtcgttggaaacggcgaggcggctgctggaggagaccttcacgagtgaggcagaggcggaggcgctaccgagcttgcccttcgggttctacgacgccttcgtcctgaggggaatccgcgtcgtccaggcccttcagcccggcacactcctctgccacttcaacgtgcccttcagactactcaactcgggcggcttcctgcacggcggcgcaaccgncttcctcgtggatctgngtgcctncgncgncttcgccactgcccggctacgcaccaggggcttcaccccttgagatgaacatctcctaccttgatgctgcttttgctgatga

SEQ ID NO: 57395 - DNA, 190 bp, Zea mays
  unsure at all n locations
  Clone ID: LIB3069-035-Q1-K1-A6
cccacgcgtccgcccacgcgtccgttcattctncgcgcacacacacaagacgggggggggttacacaaaagaaaggcagcgccaatatcaacaacaacacatccctcaccacatcagagatatgcaaagactaaccaaactataatactaacacacacgactaatgccatcacaaagacctaaccttaca

SEQ ID NO: 57396 - DNA, 418 bp, Zea mays
  Clone ID: LIB3069-035-Q1-K1-A7
cccacgcgtgcgcccacgcgtccgttcctttcgttcgttgactgaaagaattacgcgttagattacacatatgtgagtcaacgccactagagagcacaacggccgcctaccaataggatacaagcatgtcaaaaccaatgtgattggaacaggctacagactattgggtacacaatatgcttgttttttacatatatgcctagaaacatcatgtggacgccgtattatgccgccttaaccaggtcatggagacgccttaggccctgttcgtttatcctgaaattcctcccgagaatcgttccaactgatcaaagcttatataaattagtgaagaaatccgacccagattcattccagaacgaccattcccggggaaccgaacatgcccattcccggggaaccgaacatgccctaaact

SEQ ID NO: 57397 - DNA, 434 bp, Zea mays
  Clone ID: LIB3069-013-Q1-K1-H5
ggacctttgggctgatttatgtgcttgggagcggggacgaagtaacctagcaaagctcgtagggagtctcccggtacgtcctagaagaccgacggcgataaccacttagagatttcgcgttgtacgcctactactaacgtaggttagggaccttggtcctcacggggtattgctaagagtccctccgatttaaagattatcgtaaagacctacgcctcgggcaataagcactagagtaagtcctctgaggcgaccgacgtcagcgagccgttagaaacccccggcggaattcgttgacgcgaaggcggccgtacgaaggtcgataaaggtttccggaaggattttgaaactccgaagacggcctaaagcggcgacgggaggcgcggactatctggcatggttctccctgaggtcttggagaaaacgacccgcga

SEQ ID NO: 57398 - DNA, 460 bp, Zea mays
  Clone ID: LIB3069-013-Q1-K1-H6
tggccttggacctttgggctgatttatgtgcttgtcgcaagcagtggcccttggcactcagccgtccgtctcctcctccttgtcgagggtgggtgatcacctccgcttccttcttgataacaaattaatgggttcgagactctatcgcgagatgtcgcaaacaaggaaatacggaagccgggagtcagctaccgaggatgagccaggtttcgcctgcccatactggaccgtatttgaaaccaccttggtcaactaaagcccacacaaaccacagaagtaacttggtctggaactgccttgatttattaacttgatataaatgaataaggttccagtggcgcgtacttagggggtccccgcggtctaacacgcgacgttcccctgttttcgtcgacccctcgcaaacaaaatgacgtcgggagttactggcgcgaccgaatcagcgtctcggcacgtgcgt

SEQ ID NO: 57399 - DNA, 429 bp, Zea mays
  Clone ID: LIB3069-013-Q1-K1-H7
ggacctttggtctgatttatgtgcttgtttatgtgcttggttggtgttccttatgctcttagcttgatatcttgatctatcgtttgcgtgttggtttaatttggtgtaacggttgctgatcttgtagttttgaggtttctgacgttcttttgatctgtttcgtgagtttattctcgacttcttgttctcttgtcattaacgtgtgtgtcttgtccatcttgtagatgtccgtgtcttccgattatagttcatgtcgctaagtaggatatggtttctcggatttgcgtatttgctcttgttactagcgtcggtattgatgatggtcaatgtcgttctactgttgctgattcactcgatgttatggattctggggatctgcatatgaatttgggttgacattcgtcgacttgagcatttggtgaggagtct

SEQ ID NO: 57400 - DNA, 434 bp, Zea mays
  unsure at all n locations
  Clone ID: LIB3069-013-Q1-K1-H8
tttgggctgatttatgtgttgaaccgaagtatcgagggctctccataagcacnacgaatttaccccgcgccttccccgtaatcatgaacacgggtctcgtgacttccgtaacggactcggcgcgatacgactcgacgaccttcccccttaacccctcacccaggaaatagcgaccattatagtctacatccctcgcgatccgtagggacggacgggattaaatcacctcacccttatagtccgcgtcattagcaatcctcgcacttccaacgtagtaaattatactagaagaggtgaagtcgatgccacgtctcgtggcggcctcgacgtattctccactttaactggaccgggaggccccgcggttcgtagagtatccctatagaggaatagcgatttaataaaagtcctctggttccgggatacgggatgcg

SEQ ID NO: 57401 - DNA, 272 bp, Zea mays
  Clone ID: LIB3069-013-Q1-K1-H9
agaggacaggggagcgagtagttgctcggagacggccattcccgaatcacttgactcggaggacccgacccgttcttcccgcgcatcccaaaaagggtagttaggacgacgactcgcaccccaagataacgtcgctcgcccgggcccaggaccccgtcccgctgaaaatcagtatatccaccgcatcatcgactagtacacccgccgctactttcgggccaaacgacgtgctcaaatatcctcgtcggttcgaaaagagtattattgctccg

SEQ ID NO: 57402 - DNA, 193 bp, Zea mays
  Clone ID: LIB3069-014-Q1-K1-A10
gacctttgggtctgtttatgtgcttgaaaacaaaacaacatccgtaattagaacctcaaaaataacaaaggttactatcgcagggactaagtccatgcgaattcgtacgtgaagaagctgtcggcggacgagtttgttcatgccaagctgatcgtttggtagaacataatggtggaatcgtgaaaatttcgcg

SEQ ID NO: 57403 - DNA, 419 bp, Zea mays
  Clone ID: LIB3069-014-Q1-K1-A11
ggacctttgggctgatttagtgcttggaaatccaaacggagtagcagcactcactacaccggcattttcgccatcgagcacaaccccgaactcacgcatcgctacaaacgagacaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgatt

SEQ ID NO: 57404 - DNA, 417 bp, Zea mays
  Clone ID: LIB3069-014-Q1-K1-A12
gacctttgggtctgtttatgtgcttgtcttctgtaccccttccgtaattgaccgctcactttttctttaattaaagattgacggtgtttaaggttgagaagaagtttgtggtgaagaagttggcggaggaggagtttgtggctgagaagatgattgttgggaagaagtttaaggtggagaagtgggcttttgtcggtaagcttgttggtaaggagggtggtgagggtaagtgcggtaagaagaagggtaagaagagtgcggagatgcataagactcatactcctaaggcgtcgaagtaggcgtatttggatactggtactcttcttaaagttacgcttactacgaatcttcctactaatgatactcctgagaagtcggttggtgaggttgttaagtctgtgtgtcataataagaagt

SEQ ID NO: 57405 - DNA, 132 bp, Zea mays
  Clone ID: LIB3069-014-Q1-K1-A2
attataattatttttttctctttttttttattttttttttttttattatttttttttttttattttttattttattttttttattttattttttttatttttttattttttttttttttctttatttttttt

SEQ ID NO: 57406 - DNA, 385 bp, Zea mays
  unsure at all n locations
  Clone ID: LIB3069-014-Q1-K1-A9
tttgggctgatttatgtgcttgtttatgtgcttgtttatgtgcttgttgcgcttcatgagtagctgtatgtaagcgctaagagatgaaatggctgatacggtctgtatgtaactcgttgcagtggctgttgcggcggttgtggcgtcgtcgtcggtagtggtggtgatgattctggaggttgttactattcgtgggtaggcgagtcttgttactgtgtttcgttctcttcatgtttgtggtatggggcttggttttcttgtgcttcgtcgcagtggtgctaggaattctaagagtgttgttagtattgttgttgataggtgtgttgntcgtaatcgttctaagaatgttgntaggggtgctagtggttctaatgttggtaatgtt

SEQ ID NO: 57407 - DNA, 400 bp, Zea mays
  Clone ID: LIB3069-014-Q1-K1-B10
tttgggctggtttctgtgcttgtttatgtgcttgtttatgtgcttgaagccacacggtccggctccgcgtctgcttgacgagtacggtttctgtcgttgcttcttcgtcgcgtggtggtgtgcggtcgtagtaggtggtggaggtgtgtttttattatacggatattgatagtagtactgatacggattgtggtagtgatgatcctcctcttactgcggggcatctgttggaggattcgatgtagtatgattggtctgctaggtcgcctgaggagcgggcggttaagcattgtaaggtgcatggtagtcctgaggagaagtcgtgttggcctgaggcgcctaaggataattcgtattatactgatgaggttaataggaaggaggctattagtcatcggtc

SEQ ID NO: 57408 - DNA, 448 bp, Zea mays
  Clone ID: LIB3069-014-Q1-K1-B11
gacctttgggctgctttatgtgcttggcgggacgttagctaatccacagtcctcggtgggacgttactactttatctagtcatagcgatgagtatccctagcggtcgcgggaacttaagaaggtccctgcagcgtaatacccgtaatcgtatcagctcccgtacgcgcggccacgtacgacgtccccggagcctggccatacgttggaaagtaggtagaggcgtcgaactaaaccgctcacgagtcgttagaggaatatttaccactagagataaagttatcgtgcgaaacttccggatacatcgccttctaggctgcggttggccgtacttccggaacttctacggtcgctgccacgtccccgctctctgggaggctccagctaagcgccgcctatttcacactctgtcggcgacggtcataaagtacaaaaatacgacctctttac

SEQ ID NO: 57409 - DNA, 365 bp, Zea mays
  Clone ID: LIB3069-014-Q1-K1-B12
tttgggctggtttatgtgcttgatctcgtaccgtcctcggtatcactaggcgacccatctcggacgcggtctcgcgtagggctcggtagtcctcgcaaccttaagcggcaccggtcttcgcctcgcgagttatccagtaccgatcacgacatatcgtagatcaccacggtgtacgagccctagtcacccgatacgcgttagtagtactcaacggaaagcgtagtagatccatcagacccatagagactccaccagtaagtcgtaggactcatactcgaacggaggcgtatgtccatcaggaatcacggccacgctaccgaccggtcaagtcagtacgacgttatccgactaccatctgacgacac

SEQ ID NO: 57410 - DNA, 430 bp, Zea mays
  unsure at all n locations
  Clone ID: LIB3069-014-Q1-K1-B9
tttgggctggtttatgtgcttgtttatgtgcttgtgttcgcgtccggtacgtgcgaagtcgacactagaaacaagacgaccgtcttattctcgctaaattccgaaggcccaacgctaccagatgatcccgatgacgtcgaaggtggtcttaagtcggaatgacctctatgggagatgtcggacttactaccgctacggaaggatgcggagcggtctaagcttactattagttcgttgacctcgtctaagggtactgctattgtggaagatgtgaggaaggttgcggaggtgggggtggttggtccgactgcgcttaattatggtgtttggtagtcggatcacgtgttggttattactctggtgtctgaagaggcggccaaggtggcggtggnggtcgcgttggcgtcggcggatggtggtgcttggtgtg

SEQ ID NO: 57411 - DNA, 404 bp, Zea mays
  Clone ID: LIB3069-014-Q1-K1-C10
ggttggccctttgggctggtttatgtgcttgtttatgtgcttgtttatgtgcttgtttatcgtgcctggctgtctcctgaggttactcatgactaggtggtgtttatggactcgaattttaatttggaacttctttttatgcgtgcttctgttagttttcatgctaggttctctcctattcctgtagaggctgatgataatggtcattataattagatcccttttactatttattttgatgagcatagttctcctcctgttaatcgtgtgttggagattagtgctagtacggaggcttgtattgatacgcataatattaatttggatggtattagggatcattctcttgctggtacggttctcgctttaatgactcatgttcctcctgttgctcgtcacgctgc

SEQ ID NO: 57412 - DNA, 417 bp, Zea mays
  Clone ID: LIB3069-014-Q1-K1-C11
tttgggctggtttatgtgcttgtggatgtgcgggtggatgtgcgggctacgcagttagtcgtgttaagagccttaagccgtcgtctagaatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaa

SEQ ID NO: 57413 - DNA, 273 bp, Zea mays
  Clone ID: LIB3069-013-Q1-K1-H4
ctgatttatgtgcttgaaaaaaaaaaaaaaaaaaaaaaaaaaacccaaacccaaaaaaaaaaaaaaaaaaaaaaaggggagggatgacccaaaagaatatacaacaataaatatgaatacttaattatacagtctaccacacaggggtatttaaaccgaagttatcggttgcttccactatatatccgaaatcgacaaaattttcgcggccttattataaacggttccttaggataccgttccacaagttaccgttggaaaaatttacaggtt

SEQ ID NO: 57414 - DNA, 414 bp, Zea mays
  Clone ID: LIB3069-013-Q1-K1-G10
gttcagtcccggagattcgaattacccgaccagcgtaataacgagcggagcgatcggtcagtcttgtcctttcggatagtcgaatctggattcgtgtaagtctgtagctaattcgaccttgcctttctgttcgtatcctcccacggctggtcccgtgttatctattctgtgcggtctgtagtagcattgcgtctctatcgctttcgagtcaatttagtagacgcgggacgttaagaatacgacgcgcgtcgtcgatttgtgctacggttgtcactctatagtactcgttacgccttgcggaaagacgagtattaaggaggcggatgagtaaacgactaacgcttagaataagaatctgcttcatcctgcggagcggacttttaataacgcgaagcttagcgcccgcgacacttt

SEQ ID NO: 57415 - DNA, 407 bp, Zea mays
  Clone ID: LIB3069-013-Q1-K1-G11
gtgttttgagtttagttgtatgtaggggtggagcggtcgtgagtggtggtgaggcacgggtacatagtagtagtagttagcgggtccttttggttcgcttcggaaacgatgattttggatattgctcgattacggcaaaatcggcagaagtaataaagacgtgcgaggaatagacgaaggttgaagtctatctagggagaagtagtgtcgtagtagcagtccgcaagcggcgccaagaccgcagtctccgtcactagcgccaactgcctaccgctaggcggccgtccaccgctggtcgtaatcgacgttgcgcatcttttgacgtaatacgctggcactcgatcatcgaacccgagatggtcctccctggacgcccctctaaaaaaaaaaaacaaaagggttggttg

SEQ ID NO: 57416 - DNA, 132 bp, Zea mays
  Clone ID: LIB3069-013-Q1-K1-G12
tttggtctgatttatgtgcttggctcagcctcagactgtgagtggttgcctgttctatcggcacgcttccttgcgccttcgatcgcggacgctctggccgccgattctattgctagaactgagaagggggtt

SEQ ID NO: 57417 - DNA, 404 bp, Zea mays
  Clone ID: LIB3069-013-Q1-K1-G2
ggacctttgggctgctttatgtgcttgtttatgtgcatggttatgtgcatgttcacatgcctgtggatgtgcgggtcgtgctgtgtctacgagttagttgctttttcagcgtttgtttacttgatagttgtaggtcctcagtccccgctttagatggtaggttgttatttgttaggttgtacttggtgattgcttggtttcgatgtggcgatcgtgactcttcttgcctcatgcgtgttatttcgaactggcgaggtggacattcgtaagtattgattcgtttcggcctggtggactttcgagagttcactcgttaattggcctagaaatctttgacttgtatgggttaaggttgacctgtgtcttcgtaattccttcgtgtgcataatagtcagtgacaaatc

SEQ ID NO: 57418 - DNA, 363 bp, Zea mays
  Clone ID: LIB3069-013-Q1-K1-G3
ggaactttgggtctgtttatgtgcttgaaaaaaaaaaaaaaaaaaaaaaaaaaacccaaaccaaaaaaaaaaaaaaaaaaaaaaaaggaaaagaaaaaacaaaaatcccccccccccccccaaaaacacaacaccaccacaaaaaaaaaaaggggtggttctcccaaaggatttaagtcaatgcatgtgggtccgtaatgcaaaattcacctaacggggttattaaaactaaacctatgggttgctgcccaaaaatgcgagaatgggaaaaatttcggtgcatttaaatcaaactgttccgaaaaaaacttttccccctttaatcggtcaaaaattaaaaaggtttgaattaactgttccctt

SEQ ID NO: 57419 - DNA, 415 bp, Zea mays
  Clone ID: LIB3069-013-Q1-K1-G4
ggacctttgggctgctttatgtgcttgtttatgtgcttgtttatgtgcttgttcctgtgcctgtcataagacaatagaaatccgcgacccgcaacccgacactaagtccgcggacgggtgaatttctagtggatcctagcgtcgaagacgccagcagtactctaggcttccgttataatatccgcccaaagttccgccgtgagtacggccgcgtccgccgggaagacgaacacgccgaagtcgcaacactccgcgggtaagacgacccggtggccgaggaaaccggaactgtctccatagaagcgatgatgactgcctcgccggtggccgatgaaaggctaggctcgtacgaagacctcgacgatgaccatactgacgacttaacctccctctcggaactcgacctaatcgacga

SEQ ID NO: 57420 - DNA, 460 bp, Zea mays
  unsure at all n locations
  Clone ID: LIB3069-013-Q1-K1-G5
tttgggctgctttatgtgcttggcccatttgtaggtaccgcaccaccggtcctgcatacatccgacggaatgttgggacgccgtcatcaaaatcgccccacgaagaaatacgccggtctagtagtgtacgtagtaagtcacgacggtaaataacgtgggtaacaatccattcgattgaagcgtaagggtactcaactacgtaagcagcaatacgatcctcgataattagctctactaagttctttaactagccggcgtcgtaagcctctacgacggcggcaacgcttaaagataagacttggaatgactcattttcgaaagcggtataaacattagttacgactaaagctaatagagcctcataggcgtcgnaggtctataagccttgtccagatgcaacagtggatacgggcgggcaatcctcgtaagtagcgtacccgacgtcgtaaaagatacaacg

SEQ ID NO: 57421 - DNA, 389 bp, Zea mays
  Clone ID: LIB3069-013-Q1-K1-G6
ggacctttgggctgatttatgtgcttgtaagatcgaggtcatacgaggtctacgccggcctcctcgagctcgcggcggagacttagggtatatcggattaagtaaaagtcgtttacagttcttcgtaaggtcccaccagcgtaaatagttggtaataatagtagtttcacctcctccgtacgttatcccatttaaatcggggacagtcctcggctctacggctgcgctagaggaaaatagaactagtagggcccggtacgcggtcgcagactctagatcgtagaccactcgcaatgacgacgccgccgaaggaggtcgcccaatagcgtaagtaagacaatccacatccacgttccaggataagcaacaccgtcccttctcgacgaaaa

SEQ ID NO: 57422 - DNA, 436 bp, Zea mays
  Clone ID: LIB3069-013-Q1-K1-G7
tggctctggacctttgggctgatttatgtgcttgtggtcatggccctaattcggtcgcttccccgactattactgctatttcggaagcttcgtctcggatgaggcggaaaaatagtattggccttatgggggtacaccagtcatccaattgacccccacaggcgcccgcgacggctagcgaaggaggcctgcacctcccgcctgaacacccctgtgcgcacgtagccgcaacgcttgtacccgtcgtgcgacgcgcgtacgcgctccggatccgttgccttgacgttccccgcgtcgtctggaacggagacggaacgacgacccttgttgtaccctttacgtcgtgaacggcggcagactcggcacacctcgccgcgacatcgcgatcgatccacggcgcgcccggcccacggagctatctcacgtcccacgaggc

SEQ ID NO: 57423 - DNA, 423 bp, Zea mays
  unsure at all n locations
  Clone ID: LIB3069-013-Q1-K1-G8
tggccttggacctttgggctgatttatgtgcttgtttatgtgcttgtttatgtgcctgaccccccctagggagtaaaggcatactagatgtagagttcaatagcaaaaaagactaaccagcgccggatacacgcgctacacgttccgagtaagagcataacgtcgcccccgcgttgcaagcaccgcactccccttagaatccgaacgtctcccgccgagaacgaagtaatccgacccctctcaccccctcacccttccccctttacaaccttaaacacatcaggtaataccacggcccctacacccttcgcctatcagcagccctccgaccacctctccaacggtccgttctacaatcngacagaatccgaacatcgtcaaggttcctcccggacgcctagcatcaaggaatcacaacctcag

SEQ ID NO: 57424 - DNA, 379 bp, Zea mays
  Clone ID: LIB3069-013-Q1-K1-G9
tggtggcggtcgcttatccgtaccacaggagtactcatgaggagggtgatgtcgctaagtcatggaagtgtcatggttgtttcccggccgactcctagacgaagacgcatcaccatgaggggacggagttccggagtttgaagaaaaagacgttcggtgacgcgttggagggagttgcgtcgacttgggaatatatagtgatgattaattcgcctagtcgttctcggcctaatgaggcgaattctcctattttatgtgattagactagtcctggtcatgcggtgtgtaggtctggtgatgtctctgagtctcctacgccttttaatcgtgagcataatctgtcgcctgcttcgtataggtatatgagggagtatctgct

SEQ ID NO: 57425 - DNA, 419 bp, Zea mays
  Clone ID: LIB3069-013-Q1-K1-H1
ggacctttgggctgctttatgtgcttgtataaaaggactaaggacgaaaccgagtccggtaacggttcgttagacactagaagtatctggtaacgctcttaggtagcaaaagatgttgggcccgaggccgcccgggacaaggactccgtcgaagacctctttccgttccggcatccgtttccggacttaagttgacctctttcgagcagtccttgcccgattctcgcgggatgtacgaccatttgtataacggctaaggtttcggagcatgccggctccgtcttgtagggtagcgagagggctctcaacccttcggagaaggtcgtagaagggtcggcagagggtggaaagaaggagactcctatgttaacgcatcctccctccgcctggaagttctcctcggaacgagtctccggact

SEQ ID NO: 57426 - DNA, 418 bp, Zea mays
  Clone ID: LIB3069-013-Q1-K1-H10
cagcggcagactgtgagtggttgtcctgtccctcggcacgcttccttgcgccttcatcgcggacgctctggacgccgattcgattgctagaactgagaagggggttcttcacgaggacactaagaaagtcaccaaggtcgtccttgagggcttatctaagggcactacgggccacgcggaagaggactcggccctcattgatccttccggcgatagtaggctgagtactcctgatgttaaggttgggactgtctcgaatgattatcctgctaagtctgctctgcggcatgataatgagcggggtcatagtaattgtgctgctgattcgacttgttatacgcctaagatttagcaggggcccccttttttcgtcctctacggacggccgtcgtccgcgcacgttgagaacaaacgcgga

SEQ ID NO: 57427 - DNA, 178 bp, Zea mays
  Clone ID: LIB3069-013-Q1-K1-H12
ccctcacatcatatgcgtatcgggcacgaactttagccgagagagtgcaagaagcgaatacagtaattagcacgaaatcatccaagccgacggaagagtaacctttccgtcacgatcgactccctactgaaacgtacagtacaagtcacgcgatcagaaaaaaatggaaatactccac

SEQ ID NO: 57428 - DNA, 442 bp, Zea mays
  Clone ID: LIB3069-013-Q1-K1-H2
ttggacctttgggctgctttatgtgcttgtttatgtgcttggggtacggtgctgtcgtaggattcgtcgtctctgaataatttgtcggatggtggttcgttgtagcttggtcggggggtgtcggtgggttcggttatgtcggattcgcttaatgctggttctgcgggtgttacattggggcttacggtggtttcgatggggtcttggccttcggtgtcggattataattgttcgatgggggttgcgttagttgagtctgtttggtcgtttagtactggtgtgtcgcattcgaatggtaataattcgatggggatgtcggagcctctggttgggcctcattagtgtacggggtggtggcctgtgctgcgggataattttgggtcgcgtcataatgctgtggttgcggatgtggcttatgtgttgctgggtgcggcggcgcgta

SEQ ID NO: 57429 - DNA, 371 bp, Zea mays
  Clone ID: LIB3069-013-Q1-K1-H3
ggaactttgggctgctttatgtgcttggtaggcgtatcggtagaacggttcccgaccatatcatatcaaagttccgcctagcaacgcccaaccctacacggaccgcggaccgaaaaaaaaaaaagaaaaaaaaaaaaaaaaacaaaaaaaaaaaaaaaaaaaaaaaaaaaaaaagaaaatgacgaaatggacccaattcaatccaagaagcataatgacaatacaaattacttaagggtgttcacatacccaccaaagggagtggcaagacatcgtgaagactcccaacgaatacaccgacaagccaaataaaaaggctagtatcaaatctaacgacgaacaataggatagtaaacatcaaagctttaata

SEQ ID NO: 57430 - DNA, 451 bp, Zea mays
  Clone ID: LIB3069-013-Q1-K1-G1
ggacctttgggctgatttatgtgcttggccagctcgacggcatgcgtcatctggccaattgcagcaacctcagagtcaacatgcgtaataaattttgatccttggcaggggtgtacccaccagacaaaaggtcgatgtgggtctcgtttgttgacttgacgacctacgacaatccgattgactgtatggttcctgcgttggtgatgtactacctaaaccctcgtttcactaatccctgacggcaggacaggggttcattacggcggcgatgggcgatggagaaccagggcctgaccttggagagggagttcgaaaaatggtcattatacttaaggaaagtagtaggtgtgtaaaccatttaacttcgatatggggaggcagcgataaccaacaataacattgggtgtgccagcgctcggcaaccggaacgagcataactcaaactttccaa

SEQ ID NO: 57431 - DNA, 260 bp, Zea mays
  Clone ID: LIB3069-013-Q1-K1-E5
ccaacaccgataaaggatgagctcgaggtccttataccactgtgctgtttccacccttccccccgtggtacctagttccttcgcccacgtctatttagaaatgtcgttgatagcaaaagacgtcgtcgactaaccgagcgtttgagcgtgtcatactgtatcggactctaatagtggcaagacttccgagagccactgttttcaaaaatgccacataacgacgagtatcaccgaagcctcgtcacgtggtatggatctac

SEQ ID NO: 57432 - DNA, 407 bp, Zea mays
  Clone ID: LIB3069-013-Q1-K1-E6
tttgggctgattatgtgctgaggaatcgtggaccaagaggcttacccgagcgttagttaccagtaataaaactgtcgacactttcttcgacgagcatctgcggtgtaagcatggatagaagttaaccaacggccttttatatttgatgggccatcataaacgtagtattgctaggggtcgcttagtaaggaagtatgctgagtgacgcgcagatgatttggtgacgtcaactgcgatacatgaacgtgagtatagctatatttagtcgttagtatagatcgtttagattcagaagactagcaaactgctgtcttacctcggaagtgtggtgagtacgttcccgtattcagacggttacgcagaactctaagttcctgacccctgaccgtagtagtagtaacgattac

SEQ ID NO: 57433 - DNA, 411 bp, Zea mays
  Clone ID: LIB3069-013-Q1-K1-E7
tggctctggacctttgggctgatttatgtgcttgtttatgtgcttgatagatgaacaactctcctcctattctatcaatattagtcagtaatctccctctcttcgtaacaacggttgtctgtcttcttcttctttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggagcgtgtctgtctaatagttgtgtgctgctggtggtggattggtaggttattcgtaatcgttctaagagtacgatgggttggtctggtggtggtgctagta

SEQ ID NO: 57434 - DNA, 483 bp, Zea mays
  unsure at all n locations
  Clone ID: LIB3069-013-Q1-K1-E8
ttggccttggacctttgggctgatttatgtgcttgtttatgtgcttgtcccgtcacatgtccccaagtataccgcctaaactcccgatgattaccactaactatttcgtcgagaccgcgaacacgtccgttaagagttcgttcggaagtgtaatgcctccttctatgcccgccgtgtcgaagcctccggccggtcacggttccgagtctctctgttcggccttctctactaccccttattcgaaaaggaagcattcacgtaagatggaggaagaagcgagagtggtacgggtcttagcggactcgggacacaatattagggcattaaacgatacgtctactgtaatagccgcctcgcgtcatctagctaccgtgttcccgaccaccttgcctggcgctgtacatcccgtttctggacggtccacagtangaaactagacttcgagagcccatgccttcagtcatgagagtcatggatgaacgc

SEQ ID NO: 57435 - DNA, 275 bp, Zea mays
  Clone ID: LIB3069-013-Q1-K1-E9
ttcgaatgggtatacttgtcggggtcgggtttacacgaattgtgcttggaatggtgagtcgcattgtcatactcgtgatattaaaggtgttcctgcgtagttcgtccctcatgaagtccctgggtcgatggcggcccgagttacgattcgtggttcgtttatgcccgttatagttcatggtggcttggttgagactactgcgtatggtgcgctcggtcattatactgatttccattaaggtgataaggtgctggtttcgtctgcggatcctcctg

SEQ ID NO: 57436 - DNA, 426 bp, Zea mays
  Clone ID: LIB3069-013-Q1-K1-F1
ggacctttgggctgatttatgtgcttgtttatgtgcttggcttagctaagtaaagcgccagcgtaagcgtcaagactatcgatttacgtgaggccggcgataggggcaatagcggaagacgtaggttcagtataagtagcgatactagtgatgagagcctacgtagcagtacgagtagtatgaagttctataaggtgaatgacctgtggcgggaggtgacttagatggttagagtcagagatgggacttccggattgagctaccctaggtcgtcgaagagatcaggtcttagtgacaccggtagtgcgcactctctggaatcgagcgggattgtgagtcaccctgtgacgaaggctacggataaggtactatccgtaggttggaaaaagtcgtcctgggtctaaatagagaaggagaccccgtaac

SEQ ID NO: 57437 - DNA, 244 bp, Zea mays
  Clone ID: LIB3069-013-Q1-K1-F11
ttcccggacgaatgctagacgaagacgcatcaccatgaggggaccgagttccggagtttgaagaaaaagacgttcggtgacgcgttggagggagttgagtcgacttcggaatatactagggatcattaattcgcctagtcgttctcggcctaatgaggggaattctcctattttatgtgattagactagtccacgtcatgcggtgtgtaggtctagtgatgtctcagagtcaccgacgcctttt

SEQ ID NO: 57438 - DNA, 436 bp, Zea mays
  Clone ID: LIB3069-013-Q1-K1-F12
attggtctgatttatgtgcttggatgttcagtcccggagattcgaattccccgcctagcgtaataacgagcggagcgatcggtcggtcttgtcctttcggatagtcgaatctggattcgtgtaagtctgtagctaattcgaccttgtctttctgttcgtatcctcccacggctggtcccgtgttatctattctgtgcggtctgtagtagcattgcgtctctatcgctttcgagtcaatttagtagacgcgggacgttaagaatacgacgcgcgtcgtcgatttgtgctacggttgtcactctatagtactcgttacgccttgcggaaagacgagtattaaggaggcggatgagtaaacgactaacgcttagaatatgaatctgcgtcatcctgcggagcggacttttaataacgcgaaacttagcgcccgcgacac

SEQ ID NO: 57439 - DNA, 417 bp, Zea mays
  unsure at all n locations
  Clone ID: LIB3069-013-Q1-K1-F2
ggacctttgggctgattagtgcttgttagtgcttggttatgtgcatggaacgagagccgaagaagcacacagtcggactgtagaagcaggtagtaacctccatccgaagtcgtttactcgcgctaagaggtcgggtcacacgattaagtcgaggaaacgtataaacgagcatgagttcccgttacggtctccgagataacaaatacgcgtccgctcgacgtagatcgcgttacgatatggagcacgccagatggtgagagctacgtcgtcgtttcaatctacctctgtagcgaaacgccggagatagtcagagatctcctccaagttagtacctaagagaaggattcgagccacgagtaatatatcgtgtcgagatagtcngcaagtccctattacacgcacaggtcagtcttagtc

SEQ ID NO: 57440 - DNA, 398 bp, Zea mays
  Clone ID: LIB3069-013-Q1-K1-F3
ggacctttgggctgatttatgtgcttgtctacccttacccgttctgtctgttccctcttctcttatcttatcttaccttaatgtagtggttctgttttgtcccacaggttgttgtttgtgttatactgttattgctctgtattgctgtggttatttacctctctctgcttactgtactgtcttggtctttagtgtaactgacttacttgctttcaggcgcgtcctagtcacgtagcctagtagtgcgtccttttcagagggaaaagtgcgcacgagtttagcgaggaaaggtagcggaggccacgggagcgagaggacgaggactaatcggcgtagtactaggtgtaatacggtatcaaggaggacgcgccctagcgtaaggggcgtcgtgagtagta

SEQ ID NO: 57441 - DNA, 347 bp, Zea mays
  unsure at all n locations
  Clone ID: LIB3069-013-Q1-K1-F4
ctttggctgatttatgtgcttgcctccacctcccagcacaaaaagacacacatccgctcgaaaggntcgagtctcgtagtagggttagacatcattgctgcagatggggcggacgtgcgtatacgagtctcgtcagatgtcattcttcgagaggtcacgttcctactggagagggtaccttcgccgttatcggcgtatctcacgtcgtcaagcattggtacgaggcgtctaaggagctcggtttcgacgggtcagacgctatacgggttcgtatcgatcaaggcattctaaacaacggttagggtccccagcgctctagtacggtatactccctgaagtccgtcacc

SEQ ID NO: 57442 - DNA, 289 bp, Zea mays
  Clone ID: LIB3069-013-Q1-K1-F5
ctttgtctgattttgtgcttgaaaaaaaacaaaaaaaaaaaaaccaaaacacaaaaaaaaaaaaaaaaaaaaaaagaaaagggaaaaacaaaaaaaaaaaaagggaaaacacctcaaacgccttaagtcccactatcctacgaacctaatccaccacccacttccctcgagaatttcccacccaaccgttcgtttccccgccccacattgctcccctcgcaaataaccttcccggccatttactccccccctcccgtactatacatcctcccatttactcggtccccca

SEQ ID NO: 57443 - DNA, 333 bp, Zea mays
  Clone ID: LIB3069-013-Q1-K1-F6
tggcttgcgacctttgggctgatttatgtgcttggtgtcgcttaagggtgctttgcctatgcctcgctacggtcgagtctcccggtaaggttataggtcgtcgttgcggatagggcggccttacgtatacgcctctcgtcttttataattcttcgggaagtcccgttcctactggaaaaggtaccttcggcgttatcggcgtaattcccgtcgtcaaacattgctacgaagcgtctaaggagctcggtttcgacgggtccgacgctataccggtgcctcccggtgacggcattcgcaacaacggttagcctcccgagcgctcgaatacggtat

SEQ ID NO: 57444 - DNA, 428 bp, Zea mays
  Clone ID: LIB3069-013-Q1-K1-F7
ctttgggctgatttatgtgcttgtaagcaatttatttgttctttttctcccccctgtttttcttcttacttacggcgtgaagaaagcgcaagtacttaagtatcccgctggaggagagggaaagagaggactaactaactaacctgcttcaaacccaatttcttcaaaaattatccacaccatcatccccacccacacaaacttgcttttactttaattacttgttagtttatttgttttgttcgacttgctttagtgaccgtcacgagcccaggcgaccccattatagactccttctcccccccgagcacgcaaacaaagcccgaggcttaggtctgctacgcaaacctgggagtgagcgaaactgggcatgcaggaaccaggagtagagggataagaaggttcggtcgtccggtaatagtaataag

SEQ ID NO: 57445 - DNA, 444 bp, Zea mays
  Clone ID: LIB3069-013-Q1-K1-F8
tggccttggacctttgggctgctttatgtgcttcgttataaagtattgacgcgacgcgcatcccacccctattattccacgcacgcaaccgctctgtacgccacactaagagaagcatctcaccttcaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgatt

SEQ ID NO: 57446 - DNA, 251 bp, Zea mays
  Clone ID: LIB3069-013-Q1-K1-F9
ctgtaaaactcggacgtccacgtcaagtctccctacctatttcagatctgtgtttaggctggggtcgctctcgtctctcagggtcgggcgacgctccacgacgaatgcgaggccaacattttcgagatagatatctcggatcgtcgaccatagtttatggctattcaacaccataatcgccacttcactgacttcccttcaacatcacctcggaacgcttattggtctaatctcgttggcagatatgacgc

SEQ ID NO: 57447 - DNA, 440 bp, Zea mays
  Clone ID: LIB3069-013-Q1-K1-E4
ggacctttgggctgcattatgtgcttgtttatgtgcttgaataccccgcggcgtcagcggtacagacgctaatagaaacaaacggggcaagggactcacttaagaaaacgaggtctaagtcgggggtcatcctcgaattcgcgaaattaccggagaagttcctagccggatccgcgaaggacgattccgcgaaattactagagaagttcctactcggattcgcgatgggggaattcgcaaagttattggagaagttcctagtcggattcgcgaaggatgagttcacgaaattactggagaagttcctcgtcgaattcgcgaagaatgaatttagcgagttagtctcagtcggagaaaataactgagtctttagggcaagttagatcataagcctcttaaacaacgtaggcaccgacgtattagcagctaagtacgacaat

SEQ ID NO: 57448 - DNA, 384 bp, Zea mays
  Clone ID: LIB3069-038-Q1-K1-E2
gcgtcgaaaagagggaggtgagagagagagagagagagataggagttgcaagttggtgagatggatctgttggagcggaatattaagacggagacgggggagacgcgcaaggaacaggagcgtaaggaggaggtggaggcggatgccggggagaggaagacccaggagccgccgcagcaaggccagggcctcatcctcttactcgccaacggcagaggcaggtctggaatgttgccgatgtcaaacatgtcagctaatccttcacagcttacaattttctatggcggatcagtatgtgtgtatgactcagtgccaccggaaaaggcttaagcaatcatgcttatagctgcagctgcagcggcagcggcagctaccaaaagcagt

SEQ ID NO: 57449 - DNA, 436 bp, Zea mays
  Clone ID: LIB3069-038-Q1-K1-E3
acagcattctgtttattgtctttatcatctttcttatcgtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaaatggtttgctctcgcgtgcaacaggagc

SEQ ID NO: 57450 - DNA, 460 bp, Zea mays
  Clone ID: LIB3069-038-Q1-K1-E4
cccacgcgtccgcccacgcgtccgggctgttcgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtcccaccgtcccagaccacccgcgaaccagtccgctgcaggctgcaggccaccgtccctccagttcgccggtcagattattaaccattcagataccccagctccgcctagacgcgaatcctccgccactatggtggcagcggtgtccctgccgagccaagcacaggccgtgcttcggagccggctctgcgacccggtcttcatccacttccgcctcagtagctccctggacactaattacagcaagctgaagtac

SEQ ID NO: 57451 - DNA, 442 bp, Zea mays
  Clone ID: LIB3069-038-Q1-K1-E7
gccacgcgtgcgtccacgcgttttggttgcagtgtgtaaatgatgctgataatgatgtaactagaacaggacctcacaagaaagaaaaagaaaacacctagaagcaataataccaaccatggacataggagaacataagcgccggcatgctgacaagtaaaacattgatcaaccatggtcattactttatttataacaatcttggaagcttgaccatttacctttcacttatgcgtccgctgtctggtatagacactatcatccgtcatcgccgaaccttgttgtgtatccacgaactagaatacacacaagaaatgtgtttctgccccccatcgtgttgggagagttgagtttatcatcagagtaaggaccgcgagcttaaatctgtaggtgtcatttcataagttatttgatgtagcattgtgcttgaacttgtgtaatt

SEQ ID NO: 57452 - DNA, 460 bp, Zea mays
  Clone ID: LIB3069-038-Q1-K1-E8
cagaagtgcattctcattagtgcgaatttttttgggtagactgtagagtaacttgagagcccgtttacaattgtcggcagaaaattaaatttcaagcaataaatgtctgtctgcctgagttacaactaaggttttggttgcaatggaatggatggacatggttgggaagcctaagagaaactccaaaaatatttgctatcaggtttaaaacctgagatctggtgttatatatgcatctgcagggcataccttgcggccttcaacttcaaaattgttatccttctggccagtttgtaaatctggtggctggttctaatttcactcccatgttttgtttccaggatttgagaaggacatgttcaagctgaagaacgagaagcaagcaatggagcaagaagcctatctttggtctgtctctgatatgtgatcccaactgctgctccttacgagaggaatacag

SEQ ID NO: 57453 - DNA, 388 bp, Zea mays
  Clone ID: LIB3069-038-Q1-K1-E9
cccacgcgtccgcccacgcgtccgcccacgtgtccgatttattttgactcatctgccctaccttctctgggttttaggagaattcaattgataagttcattgttaatagtaagcagcaagtgcatcggatgaacggggggtggctcggcacaccttgatttctttctttctcaatctaacgctctcgtgtttcttcttggtcacactgatcagagagcaggttttccatgacatgatggtggcgcctaattttgctggtcgtgtgtgccggatatcgcgatgtcagcagatcggcatgaaatgctgtcgaaaagggagaaagccacaaacttcaaaccagactatgatattgatatccatatgaaggtcttagctatgagtgggcaag

SEQ ID NO: 57454 - DNA, 469 bp, Zea mays
  unsure at all n locations
  Clone ID: LIB3069-038-Q1-K1-F1
cgctttcgcgtctgcgtgcgtgcgtgtgcttgcaggcatgcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagatcacttagcacccaggccgncactacgtcaagcacaccacagcctncgncttccccaccccctccagagaagactcactttggtggcctcaaagacgaggatcgcattttcaccaacctctatggtctgcatgacccttttctgaaaggcgcgatg

SEQ ID NO: 57455 - DNA, 359 bp, Zea mays
  Clone ID: LIB3069-038-Q1-K1-F11
cggacgcgtgggcttcgagccatcttccattatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctccaactccaccagtgttgtggaggtgttctcccgcatcgaccacaagttcgacctcatgtacgccaagcgtgcctttgtgcactggtacgtcggtg

SEQ ID NO: 57456 - DNA, 457 bp, Zea mays
  Clone ID: LIB3069-038-Q1-K1-F12
gcaaacaaaccctagccgccaggcgcaggttgtcagggagcgagtaccgagcgccccagttcacacgtgagatgtcagaatacaagaacgtcgttggggggaggctaaagctgaagggtaaggcactggatgtgaaggaaggtggagtcaagaagaaaaaaaagaagcatcagcttgaagagtcgtctcagattgagcacgatgagctccacaaagggggaaactctggcttaccagctgatcacaacaatgagcttattgaagctggcaaggtgggagatgaagaaaggaatctacatccagactacgaccacctcacaccggcggagcgacgctatatagaacagaagcagaagatcgacatgcaaaagctggccaaagttgccaacaagtcacacaggggaccgtatccagggactcaaccagtatctggcgaacctcagcgagcactatgaca

SEQ ID NO: 57457 - DNA, 155 bp, Zea mays
  Clone ID: LIB3069-038-Q1-K1-F2
cccacgcgtccgaaaaataaaacaaaattataataaaattttaaaaaaaaaaaaaaaaaaagggaaaattggaaaatataaaaggaaaaaagggctcacattttaagggccagaatttttttctgtctcatctggggtttcagtttttttttcct

SEQ ID NO: 57458 - DNA, 445 bp, Zea mays
  Clone ID: LIB3069-038-Q1-K1-F3
gtaagacttgctctttgtggtggtgcacctttatcaggttacacacaaagattcatgaatatatgtctaggtgtcccagcgggtcaaggctatggtttgactgaaacctgtgctggagcagctttcactgaatgggatgacacaagtgtgggtcatgttggtccaccacttccttgctgctatgtgaagcttgtttcatgggaagaatgtggttacaagatttctgattatccgatgccgagaggagacgtcgtggatggcggacacagtataacaaaaggctatttcagcaatgaagcatagacgaatgaagtctacaaggttgacgagaggggtatacgctggttctacactggtgatattggccagttccatcctgacgggtgccttgagattattgacaggaaaaaagatatctaaagcttcagcacggagaatatgtgac

SEQ ID NO: 57459 - DNA, 459 bp, Zea mays
  Clone ID: LIB3069-038-Q1-K1-F5
cggacgcgtgggcaccagacccctgtcgctctcgtgtgccggccggcgacggcgatgatggcgactggccgatcgctcgccggggtatactccgccagagccacccgccccatgcctctacgcgccggcgcacgggcgccctgcgccggtgccgccgcggccgagcctgcggccgagcacgtgcggaggctcgtggcggagttcgacccggcggtcccgctggactccgcggtcacgccgccgagcgggtggtacaccgacccggattttctccagctcgagatcgacagcgtcttcttccgcgggtggcaggctgtcggtcacatatggcaagtgaagaacccaaatgatttcttcacaggaaggtgcttacgtcttgtttcgatgcctcagtagttccagttagtagtaattttgctacgcctttcgtacatatataaataattttgctacctcaaa

SEQ ID NO: 57460 - DNA, 450 bp, Zea mays
  Clone ID: LIB3069-038-Q1-K1-F7
cccacgcgtccggctgcgggccagctgccctgcgcaggccggcgccggcgacggcgcgctcgagccgctcgacggctccacgccggacgctttcgacaacgcctacttcggcgacctgctctcccagcgcggcctgctccactccgaccaggcgctcttcggcggcggcggcggcggcggcggcggcgcgacggacggcctggtcagcgcctacgcgtccaacgccggccagtggggggccgacttcgcggcggccatggtcaagatgggcagcatcagcccgctcaccggcacggacggcgagatcagggtcaactgccggagagtgaattaattatttattacagccacgttgattgcatttgctctgggggtagtggaatagcgtgcatattttgcaaagaggcagagaagaattgaaatggagcctaagctcatatgtatacaaat

SEQ ID NO: 57461 - DNA, 458 bp, Zea mays
  Clone ID: LIB3069-038-Q1-K1-F8
ccgcccctcgccgctccgcgtgtcactcgtcgcttctcttccattccaccccgcccccatgctccctcctcgcgcgtcgcgatgaaagaggcgcaggcttgagcgagaggtccgcgctggacaccaccgcatgctagggaggcagggaggggagccgagccgaggacgatggcgctgggcgtgttgttccacggcgcgcagctagcgctggatctggcggtggccgggatgtcgctggcggtggcgctcgggttcttcgccctcatcactaccttgctctgctccgcggcgttcctccaccactccaagcccgccgcgtagtcatagcctccacagcgaccaacgcgtctcaatctctggggatcgtaatactgttgctggtataattcctccacatcaattgcagaggaggtgctttaatcaactgctttatagcacttacagatgcaaagagtagt

SEQ ID NO: 57462 - DNA, 356 bp, Zea mays
  Clone ID: LIB3069-038-Q1-K1-E12
gaatgccacacccacccatggcgctcctcttctccccgaccgtttccttcctggtctccccgtgtgctccacgccctcgagctctctccgctgccgccaatgtatcctaccccgcctcaaggctgcaatgcaagaacctgtcctcccaacagagccctctgaatgtgactgctacctgtgcttctttcgctgagaagaggctggttcttgtccatgccacggcagagggttctgaggctggtgcggagcagccagaagagccgaaaccagcgaccaagatcgaggaaatgccgctcgagtcgaagcagaagatgatcatggagcaaagagcgcggatgaagcttgccaagaaactg

SEQ ID NO: 57463 - DNA, 319 bp, Zea mays
  unsure at all n locations
  Clone ID: LIB3069-038-Q1-K1-C9
gcacaagcgcactctagcaatggcttctgttgttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgnctgctgcggctcctcgccgcgtcgggcgtgttcaccgtcgacaagcagagcacggaagaggagcggtaccgcatcagcccc

SEQ ID NO: 57464 - DNA, 424 bp, Zea mays
  Clone ID: LIB3069-038-Q1-K1-D1
ctcacctgtgctcaacactgacgacgcctattccagtcatagaagttaacgggcctgacgggaagcccattggtcctcctatgggaaatccatggatctacatgtaccctgagggcttgaaggatctccttatgatcatgaagaacaaatacggaaacccacctatctacatcacggagaacggaatcggggatgttgataccaaggagacacctctacccatggaggatgccttaaatgactacaaaaggctagattacatccagcgccacatcgctactcttaaggaatcaatagacttgggatcaaatgtgcaaggctacttcgcttggtctctgctggacaactttgaatggttcgccggctttaccgaacgttatggcattgtctacgtcgaccgcaacaataactgcacgcgctacat

SEQ ID NO: 57465 - DNA, 432 bp, Zea mays
  unsure at all n locations
  Clone ID: LIB3069-038-Q1-K1-D10
cggacgcgtgggcggacgcgtgggcggactcgtgggcagtcgcagcgcacgccatcagctagcaggtagcgcgctcctcgagcccagcagagaaaggccggcctacccactctctctctctctccagtctccaccggcagcgccaatagtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgtcgncgcggcggccatggtggaccgcatgctncgnctgctcgcctnctacgacgtcgt

SEQ ID NO: 57466 - DNA, 370 bp, Zea mays
  unsure at all n locations
  Clone ID: LIB3069-038-Q1-K1-D11
aggcaataatatgctttgttcgtttcatgttcgtagtccttattcatgtatgatgtgatgatctcccctctgatttgtgtaagttgttcacttgctaatctctttctcgcttctcagaggtaaggactaatgaagttactggtatgcacctaggacattggtttagttgatttccgttctaaaatggtagtgaatgactgaaacttgccagtggaaaccagttcataaggtggcaaggggaggcatggtgagtccggccctttccaatcgcctaggtttaggcacatcagcacatgtaaggtgaggcaaggtgatgccatatgccagagcgtaacaaggngcttgcccagtccaccagacagctcatatg

SEQ ID NO: 57467 - DNA, 461 bp, Zea mays
  Clone ID: LIB3069-038-Q1-K1-D12
gtggtccctgtctctctccttcggccgtgttctccaggcgagcaccctcaaggcctgagctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcatgcccgttttggaactcctgcctacgagctaagttgcggagtgtggtttgctcgttagagcttattttcggacatccaaaaaacatgcttcctatgtgggatgatggctatctttatatttgtatgttagttagtctctttgctgttaaatttcgtgtcagttggtcctgccgatggagaatcgagcagtcctctttatttggtctatcaactatgctgtaatgctggctatgtatcggaaaa

SEQ ID NO: 57468 - DNA, 443 bp, Zea mays
  Clone ID: LIB3069-038-Q1-K1-D2
acatcgatgacacggaagattacatcaatttccagcttgataaccaccgtaatcagttgattcagctagagttattcttgagttctggtaccgtctgtctgtcgctgtactcattagttgctggagtctttggtatgaatattccgtatacctggaatgacggccacggatacatcttcaaatgggtggctcttgtatcagggcttttttgtgcctttatatttgtctccattgttgcttacgcacgacacaaggggctcgtcggatcctgaatagctgaaataaccgcgtacttgctttcctcaactgtaaatttgagccagtgagcatcgactttgcggggtgattcatctgttgtaccaaattcggtagtatcaaattggggatgtcgaataggaactgtaataggaaaaagttaatgcaaaagaaatatgctatgattg

SEQ ID NO: 57469 - DNA, 467 bp, Zea mays
  Clone ID: LIB3069-038-Q1-K1-D3
gtgctgatgaacagggcccctgttatgccttgagttattatgattcggaaagggagcgtatgtttgaccatgacctaaggcgagtgaaagggttggaaatcagaaagatggccgaagatgggaactgtctattcagagctgttgctgatcaagtttatggagacgcagaagcttatgacatggctaggcagatgtgtgttgattatatggaaagggaacgggatcatttctctcaggtcataactgaaattgaaaggtttacattatactgtaagaggaaaaggagagataaggtttatggcaacaatgttgagatccaggcatttgcagagatgtacaatcggcccattcacatatattcctacagtacagagcccattaatatttttcaaggaagctatctcacagacgttcctgcaattagattaagttaccatcatggtaatcattacaattcagtggttgat

SEQ ID NO: 57470 - DNA, 287 bp, Zea mays
  Clone ID: LIB3069-038-Q1-K1-D4
cggacgcgtgggggctcttcaggttgagattgaatcatttaaagctcatgacaatggattggcaaaatcagagttttgggagcctacttatgaagactgcttaaacatgattgctcggctttcaccagtggcttcttatgtttaccggagaattttcaagggtggggaaatcaatataaaactgacaattctctggattatgcggcatatttctcacacatgctttggtttgatgaccctaaaatggctgagcttatgcggctctatgtaacaattcacactgatca

SEQ ID NO: 57471 - DNA, 464 bp, Zea mays
  Clone ID: LIB3069-038-Q1-K1-D6
ccgctccggtcacccgtcacttcacgcaattatgtcgaggaggaagaccagggagccaaaggaggagaacgtcacccttggacccactgtccgtgaaggagagtatgtctttggtgttgctcacatctttgcatccttcaatgacactttcattcatatcaccgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggaggcaacaagaccaagacccccggacctggtgcccagtctgccctcagggcgcttgctcgttctgggatgaaaatcggacgcattgaagatgttaccccggtccccacggacagcactcgcagaaagggcggta

SEQ ID NO: 57472 - DNA, 399 bp, Zea mays
  unsure at all n locations
  Clone ID: LIB3069-038-Q1-K1-D7
cccacgcgtccgcgctggaccgccagtgcttgcgccttgccagtgtcatggccagcaacatcccgaccagtgacatcggtgtgatcactagcgcggaggggaggaagagcatgctgaagctggccgagaggatggtgatgagcttctgcggcggcgtgacggcctctgcggggcaccagtggactacgctgtccggcagcggcgctgaagacgtccgcgtcatgaccaggaagagcgtcgacgaccctggcagggccgccggcatagtcctcaacgctgccacctcgttctggcttcccgtcccggccaagcgtgtcttcgacttcctccgtgacgaaagctctcgcagcgagtgggacatcctctncaatggcggcgttgttcaagagatggctcaca

SEQ ID NO: 57473 - DNA, 338 bp, Zea mays
  unsure at all n locations
  Clone ID: LIB3069-038-Q1-K1-D8
cggacgcgtgggcggacgcgttggtctagttcgcgacgcgcccttttttttgtttttttatgttcaaaaaatgtccacacgaatgctggcgagcagagccgattcaacaaagcgaatgcaggaaaaagaacagaaatcaatgctgatcagtgatcactaaagccagtatctccctaccagatcgtctgaagcgcgaaagatgagagaacgcagcggctgctgacaagtgacgacgactactgccacgagaagggcatcgacgacgaggtgccgncgtccgaagagccctcgccgacggcgcttgccgcgccgacgtggaacattccgccgtagttcat

SEQ ID NO: 57474 - DNA, 405 bp, Zea mays
  Clone ID: LIB3069-038-Q1-K1-D9
gtgacccccttgaccctccagaggaagcgttctagaattgctgacaagaagaagaggatcgctaagaagaagtctgaggctgctgagtaccagaagcttcttgcccagaggctgaaagaacagagggaccgccgcagtgagagcttggccaagaggaggtctaagctttctgccgccgccaaggcttctgctgccacctctgcctaagaatgatcagtgctttgagatgttttcaaggcctattttgttacagcttataagtaccttatgctgccctggctgtgttgcatcagtcgaccctccctacttagacttatgagtaattggtgcaattttgtatggacatggtacttgcttgtccggattttttgagtaccaaaggttggatatgtggtttaatctggg

SEQ ID NO: 57475 - DNA, 432 bp, Zea mays
  Clone ID: LIB3069-038-Q1-K1-E1
cccaccgcctccgccgccgacaacagcgttttgtagtgtatttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaac

SEQ ID NO: 57476 - DNA, 426 bp, Zea mays
  Clone ID: LIB3069-038-Q1-K1-E10
agaagatcgcgtccaagctggctgccgacttcaagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggtggcgccggcggcatggacgaggacgctccggctggaagcggtggccctggccccaagatcgaggaggtggactaagcggattgtgtcagtctcgtgtgtctgctgcagtggctggctggcccagtcgctgctcgatttatcgtcgtcgtcgcggtgtatccgcgttagaaccttttgttggtgaacaatattatcgtggcacgccgtttaagtatacggtattctggttcgggtt

SEQ ID NO: 57477 - DNA, 281 bp, Zea mays
  unsure at all n locations
  Clone ID: LIB3069-038-Q1-K1-E11
tgcagatgcagatgccgccgncgcagcacgtggtgctcgcggcggcgagccccgactacctgttcggnctcgacaatggcttcgtccatccccccgcggtgaaggtcaaggacccagcgggcgatccttccgcggtcagggagagcgtgcccgtggagttaccagccaaaaacgaggaccgncatcccattcccaaccccgcgggcgacaacgtggctgtctcccctgcggagtaccagcgccagatcccggggctcgagaagctgcaggtcgncgacaac

SEQ ID NO: 57478 - DNA, 461 bp, Zea mays
  unsure at all n locations
  Clone ID: LIB3069-038-Q1-K1-C8
cccacgcgtccgcccacgcgttcgggctgctcgacgtccgtgagggcgtgccggctggccgcgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtcccaccgccccagaccacccgcgaaccagtccgctgcaggctgcaggccaccgtccctccagttcgccggtcagattattaaccattcagataccccagctccgcctagacgcgaatcctccgtcactatggtggcagcggtgtccctgccgagccaagcacaggccgtgcttcggagccggctctgcgacccggtcttcatccactccgncctcagtagctccctggacactaattacagcaagctgaagtacc

SEQ ID NO: 57479 - DNA, 431 bp, Zea mays
  unsure at all n locations
  Clone ID: LIB3069-038-Q1-K1-B2
ctccaacaatactgtgcaaggtccagcgcgttctatgattgctgatctgtgcggtcatcatgggcctagtgcagccaactcaatcttctgttcttggatggcgctgggaaacatcctaggctattcctctggttccacaaacaactggcacaagtggtttccgttccttatgacaaacgcgtgctgtgaagcctgcgcaaacctgaaaggcgcgtttctggtggctgtggtgttcctagtcatgtgcttgactataaccctgttcttcgccaaggaagtgccctacagaggaaaccagaacctcccaacgaaggcaaacggcgaggtcgagactgaaccttccggcccactcgctgtgctcaagggcttcaagaacttgcccacggngatgccgtccgtgctcctcgtaactggactcacctggctctcgt

SEQ ID NO: 57480 - DNA, 365 bp, Zea mays
  Clone ID: LIB3069-038-Q1-K1-B3
cccacgcgtgcgggactttccggaccccttgtcgtggctcgaagagatgatcgagacatacgtgcagactatcgccaagggcgtccgtagttatgaggaggccaagaagaggatgtatgctactagtgcgaccacttacgttggatgtcaggctgtaatgaccgaggaatatgtcacagaaattactctggtgaagcactggagtagtattcattctgcctagattcatatacatatgcagaaacaaacgagtacggaagacacatatatgactattgtgtcatcagtccatgaccaccagctgttcattataacagaccatatagaactgtcaggaaccgtgtctacccagggaactaccatta

SEQ ID NO: 57481 - DNA, 221 bp, Zea mays
  Clone ID: LIB3069-038-Q1-K1-B4
tttccgcggacgctttggaaaaaaattatacaaatttttaaaaaacaaaaaaaaaaatgaggaacttgggacaacacaaataaaactaatgtacttagaatggcactggaaaaacattctaagctattcctttggttcccacaaacaattggtccaaatggtttccgatccttatgacaaaacgcttactgagaaaccttggcaaaccttaaaggcccctt

SEQ ID NO: 57482 - DNA, 429 bp, Zea mays
  Clone ID: LIB3069-038-Q1-K1-B5
cccacgcgttcgggacttccttgaccgcattccgtcgcgcgaagagatgatggagacatagctgcagactctcggcaaggtcgtcgggagttatgaggaggccaagaagaggatgtatgcttttagtacgacgacttatgttggttttcaggctgtaatgaccgaggaaatgtcagaaaaatttcgcggtttgcctggagtagtggtcattgtgcctgattcatatctatatccagaaacaaaggagtacggaggagacaaatatgacaatggtggcatcactccaagagcaccatctgatcattatagcagaccatctagaactgacaggaaccgtaactactgaggaaactaccaggatggccattcacagtaaggaaattaccagaacaaccggtcttcaccagaacgtggttacccagaacaacc

SEQ ID NO: 57483 - DNA, 65 bp, Zea mays
  Clone ID: LIB3069-038-Q1-K1-B6
tggacgcgtgggaaaaaaattttccaaaatttaaaaaacagaacacgaataaagggaccttgggc

SEQ ID NO: 57484 - DNA, 457 bp, Zea mays
  Clone ID: LIB3069-038-Q1-K1-B7
cggacgcgtgggcagaggatgataaagattatggcaagaagaatggcaactttaggaagcatccaagggaaagcagagaaccgtgtgtggaggacccagatgaagaagaagaagaagataataaaagacctaaacatagacaatttgggagggagctcagcagatctggtacatcacgtctacagcctcagacatttatgtttcagagttcaactgttacatatggtggtccaaatggagcctgttatacatcttcaacgactaggaagactggtgcaaacggagtaagtatatatcatcatctcatgaatgtttttcttcatctgccgcagtttatccctttcccagaccccacacgtggaagctttggcactgggtctgccccttttttttgcatatttgtagggtgaagggcaagcctggtgaagtggtgagagttgtctcattgagtactcat

SEQ ID NO: 57485 - DNA, 375 bp, Zea mays
  Clone ID: LIB3069-038-Q1-K1-B8
cggacgcgtgggcggacgcgtttgcgatgtgagagcaatgcaagtggttcagctagctaggatagtagccaccgccgacagacccaccaaacggatcgcagcctactgtacatgcatacaccgatcgatcagtgcaggagggcagcagcgcaatgaattatgaatgcgatgtaccagcgcgtcgtattggcacagttaatttgcccattaccccagaacatttcgccgggggtaaataatcttccggtcggtcacgggagcgagagtgagaaaaaaaaagtaagagtactgtatagccagctattcatgtacttgctgccttggccttcccttcatcgttatacggtggcgtcgctttatgcatggtttatttat

SEQ ID NO: 57486 - DNA, 334 bp, Zea mays
  Clone ID: LIB3069-038-Q1-K1-B9
cggacgcgtgggttgaaatgttggaaatatatcgcgggctagaaggacgatggccagactatgtactctactactctgcttcatccttctcagtaaacttcatatacatacatatcggacaaaaatgatcctacagtctattatggcactggcatacatgggcatgacaaaaataacggcgtagacattatgaacaagatattgactaatgaaagctatgctatacatatgaggcacaggaagaacattgagcagatcaagatgatcgatacgatgaccatgaatttgctctacatgctgaattagatgttgctcaggatctaacatggacaac

SEQ ID NO: 57487 - DNA, 444 bp, Zea mays
  Clone ID: LIB3069-038-Q1-K1-C1
cgcttcgccgacctcaccaacgacgagtactgcgccacctacctcggcgccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcgacttgatctccttatctgagcaagagcttgtcgactgtgatacttcgtacaatcaggggtgcaatggaggtctgatggactatgcgtttgagttcatcatcaacaatggcggaatcgacaccgagaaggattacccttacaagggcacggacggacggtgtgatgtcaacaggaaaaacgcgaaggtgtcactattgaca

SEQ ID NO: 57488 - DNA, 365 bp, Zea mays
  unsure at all n locations
  Clone ID: LIB3069-038-Q1-K1-C11
cagacacatgggccgacacaaaaggaaacttgaagacaaggtcttcggccccgatgccttcgctgctcacctcacccgcctgcctacccttcgccgtacactctgctcgactnctgcatcggagctctccaccgtcgcggacccttcctgcaccaccgcgacgccgactcggtgcacttcctcgcgccgcgcaagaagacccgaccgcccctcgcgatgagctggcttgagaagctgggtctgagcgggcttggaggtagcccgcgcgcgtccgacgcgtcggcagcgctggcgcacgggcccgacgaggaccaggccgcgccggggaacgagatcacgcaattacgcgccggctgcttctgggg

SEQ ID NO: 57489 - DNA, 372 bp, Zea mays
  Clone ID: LIB3069-038-Q1-K1-C12
cccacgcgtccggggtatatccttggttatgtaacgtcgcatcaggaccgcaacgcggtgtccttggtctgccgggcatggtacgacattgagcgtcatggccgccattcggtgcttgtaagaaactgttatgcggtgtgcccagagcgtgtacatatgcggtttcccaacatgcgcgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatca

SEQ ID NO: 57490 - DNA, 461 bp, Zea mays
  Clone ID: LIB3069-038-Q1-K1-C3
aaactaagcttcctggagcacccaagttttttttgtgtgttctagcggaaagaaagaattctgatatttatgggccttggaagaagaaatgccttgctgaatttgggatcgttacacagtgtgtggcaccaactagagtcaatgatcagtatcttacaaatgtcttgttaaagattaacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcgaaatacagagcatctgtccgcacccaatcaccaaaaatggaaatgattgactcgttgtttaaaccacgggaaactgatgacgatggtctggttcgggaatgtctg

SEQ ID NO: 57491 - DNA, 438 bp, Zea mays
  Clone ID: LIB3069-038-Q1-K1-C4
caacttcaaaaaggttcgggtttcagaggttgtaaccttgtgcataccacacctggtttgtgctttgaaggatggaaatgaggctgcccaagagagcgtgcttgacaccctttgcttgcttaaagaatcttggccgcaaatgaatgaagacatcgctaaagcccagtccctgatttcagctgaagccatacctgtactacaaatgcttatgaagacatgtcctcccagttttcacgagagagccgatagtttgcttcattgcttgcctggttgcttgacagtgaccatcattcgtgggaataatctgaaacagacaatggggggtacaaatgcattttgttgcctgcaaataggaaatggtcctccaaggcaaactaaggtggtaaaccacagcatgtgcccagcttggaacgagggtttcacttggttatttgacgt

SEQ ID NO: 57492 - DNA, 445 bp, Zea mays
  Clone ID: LIB3069-038-Q1-K1-C5
cccacgcgtccgcagtgtactgtccaccctctccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgct

SEQ ID NO: 57493 - DNA, 464 bp, Zea mays
  Clone ID: LIB3069-038-Q1-K1-C6
cggacgcgtgggcggacgcgtgggcgacgcttgccgccccgacgacgaccccgcctggttgtgcctacgagtcggttgcgaccagagccatgagcaggtcgaccctgaggccctggacaggagcttctttatgcgggtcatggcggcgagaagccccaacgtgaggctacagaaggctatcagcaagaagaaccagagctcgatgctgaaatgcccgcactctgcgccgccgaagcaaccgagagctcggttcgcgaggctgagcgcagagactgagactgcggggaaggcaccggcggagcccaagccaagggtcgagcggatctgcgccatgcaagcgtccccaattcgcaccaagacagccagggtcgaatgtcccagcgagaggaagaaggcactgaccacgccgcggagcaaggccgtccggccgaggcaggagctgtttcacagtgtgaagcaccaga

SEQ ID NO: 57494 - DNA, 447 bp, Zea mays
  Clone ID: LIB3069-038-Q1-K1-C7
gcaaagaataacagagataatgcaaatgattctttattttacggtggttgctgttggccgttgcttgaacagacaccgtcacgctaaaacgttcttgacatttgacatatacagccccgactaagaggaatcttgcagaactggatggcaagcgaagttttggatatcttaagtttgtttcgtcccagtttgaagagtttctagtcaaactaggggatatgcattgtaggcagaatgcaggtcacatcttttttttttgggtgggtaggtaggaaagtgctgctttgcttactgtgtggcttgtaaagccagaatgtaggatacatgggcggcagcttacgttaggatagattgagccagtcttaccattcttttgaaaggaatgcattttgcatctgatgtaaagctatttttggtggccattctctggtataatccatactgaag

SEQ ID NO: 57495 - DNA, 383 bp, Zea mays
  Clone ID: LIB3069-038-Q1-K1-B11
ggagaaggacgggtgcctgaccctggggttgcatacgcgcccgctcatcgccacctcggcgtggcgcgtcgccgctccgtgacgtccccaccgccccccgtacctcgccggcacagcacagcacaaaagcacagtggaagctaagacgtcagtgaacgctgctgaactgcagatagcgactgtggggccacaacggtcctcgccggagcgacgagatggacacttggagtccgaccggatcggcctgtgttcgttcctgtttccggtcccccccttctctcttccccgttgttccttcaacccgtcaactatggtagcccgtagccctactgctacgtttaaatgtgtattactattacgtgtaattcctcccagcgctgata

SEQ ID NO: 57496 - DNA, 377 bp, Zea mays
  Clone ID: LIB3069-013-Q1-K1-C9
acctttagcctagaaccacactctcaaacgaatcgaacaggaaggagtttggttcccccacggaaatattgggactccatacggaattaaaaattaacgccggtggcaggctactcctataaagtaacggctgtggactatataagcttaataagtgcgaaaagtctgatcctaactactcaagattgaagaaacgaaaaacggcgcctgagccagtctccgcatctcgcccgcagtcgcatttaaccggttactcgtcgtgcctcgctgaccacactcagagagtcggcaattacgcttacgcgattacgcggtacgtacctccagcgagaccacgcggcgacaactaccccctccctcaccgacgcgcctcatct

SEQ ID NO: 57497 - DNA, 302 bp, Zea mays
  Clone ID: LIB3069-013-Q1-K1-D1
ggacctttgggctgatttatgtgcttgggtctaccaaactagccacagcccgcccgacggcatgcgtcatctggacaattgcagcaacctcagagtcaacatgcgtaataaattttgatccttgggaggggtgtacccaccagacaaaaggtcgatgtgggtctcgtttgttgacttgacgacctacgacaatccgatggactgtatggttcctgcgttggtgatgtactacctaaaccctcgtttcactaatccctgacggcaggacaggggttcattacggcggcgatgggcgatggaga

SEQ ID NO: 57498 - DNA, 213 bp, Zea mays
  Clone ID: LIB3069-013-Q1-K1-D10
taaaaaaacaccgggtagccgtccacgtcacgggggtaggggagttacctcttacgccgttcatagctcccacttcatcactatattaactcaactcatccgaggcactttaggtctagtcgatcaacgaagttgatgaaaagtccccgacccaactaacatacccacacatctaacctaaggatacctcaggaactcatcggatcataccac

SEQ ID NO: 57499 - DNA, 337 bp, Zea mays
  Clone ID: LIB3069-013-Q1-K1-D12
ctaacacgatcatcggattatcgtagcgggagccgtcgtaaagggtgagggtcatagataattacgcgcgtcgcgtcctcccgcgcgtcggcgccttaccccttccaatccctacccggtactaccccgttagccccacgtcccaaaacgccaactgatcgcccggcgttaatcgcccagcgtaatacgtggattagtctgagacattagcgtaggccacgccgtccggggatatcttatctccgccggattcgcaagccgattcgagacccttacccatctcttcccaacctcgctagcgattaccgtccactcagtccctagatcgacatcacgt

SEQ ID NO: 57500 - DNA, 398 bp, Zea mays
  Clone ID: LIB3069-013-Q1-K1-D2
ggacctttgggctggtttatgtgcttgcttaatcggtgacgtaaagaatatccgcgaagcactcgaccaagaggaatactacgggaacacacgacgcggacatatgcgtcacaatatgaagaccaagagaagacggcagctccaccggcgctccgagcatcgactagctctcgatagataacgagccgccagaaacggtttaaaagcggaaaaccgccggagccgacccgaccagcggcgctatacgcgacgtcttacacgaacggctggataagatcgacctagaacgggagcccaagagggacttgctaagcgaaatcccctacgcggccgttcatgatcccggcactaagtacaacaccccgagatgaccgatactacacggacgtaaaacaata

SEQ ID NO: 57501 - DNA, 388 bp, Zea mays
  Clone ID: LIB3069-013-Q1-K1-D3
ggacctttgggctgatttatgtgcttgtttatgtgcttgcgtaaaacttattccccacgttcgtaactacgatcttcggcggcgtgtccgactctgtaatcgcatcatcgggaaactgcacaactcctaccggttaacacaccaatctttaggcggtttaatgcgcgacactatagtccgcaatatccgtcgttactgacgaagaggtcgacacctcgacacactccaatcgtttcggcggaagctctcacctgactccagtgacccacgaccgtacgcttcggacaaagtttaaagccgggatagcgcgtcccggcgccgccgtcagctaagtagtaaccacttccgtaagcggtgagaaaggaacgtgtcacgtaacgttaaacgt

SEQ ID NO: 57502 - DNA, 460 bp, Zea mays
  Clone ID: LIB3069-013-Q1-K1-D4
ggacctttgggctgatttatgtgcttgtggatgtgcggggcctaataccacgtccattaacccaaaaacagagtctatacatccgtacgtacccacgccgccttcaccgaaagaacagacaacaaaataaggtcacgaaacgacaggggtaacacggcttacccgtccgcgaggcgagaaacaaaagaacgaaaaacacagaccagcgtcgcccctcgaacctacccgacgaaatcggcgccgcctcccgaaccgcccaaaaatgagcgtcacccttcgaatatcactctaaatcagcgccgccctacggaccttttttccgctggagaagaactcctaccccaactatcgactccattacccagaactcaaaatccgactacgcagcgctctattcactagcctctaccacgtctcctcccccacgtcctagagcccacaccgtcaaacacgagcaaag

SEQ ID NO: 57503 - DNA, 327 bp, Zea mays
  Clone ID: LIB3069-013-Q1-K1-D5
tttgggctgatttatgtgcttgatcccggggaatagacacacacataaaccacctagactccgcggtcgcgtcaacgtacatcggtcaccgtctgttcatgcttcttttctttttactcgttacttaagagtcctacgtaatcgcctaagcctcattattataagagagccacatcctaataccgaggaataatgcatgtctatgcgtccggggcgtcgggaccggccgcagtccttgtacagaatgtcgtcgtacagccaagaaaggcggcggtattaccgactccgaattatgttccagctatatactagtcgcggagttcatat

SEQ ID NO: 57504 - DNA, 461 bp, Zea mays
  Clone ID: LIB3069-013-Q1-K1-D6
tttgggctgatttagtgcttgactacagccaataagctcaatgaggatccgaagtattcgaaaggaacaatagtgatacacaggacgatgagcaaatccttagctaggtatctcatacacgcactagggaccccatacttgccgaaggcgccctccgaaggggattgcacatgtcactcactagaagacgactaaatcaagccgcgctgcgggctcatagacaagaccatcgtaacccatcacgatccggctctcgaagccgctatcgcggtaaggaaaattgagctcctgacgtaaagatcgtgttaaggcctataaaggtgagccggagtcagcatagacgttctatacaatactacactcgacatagataagactcgtacgtagtcactctccgacacctaagagcatgtatgaaattcctgcgtgacaggaacagatgtgagagagaccgaccttca

SEQ ID NO: 57505 - DNA, 451 bp, Zea mays
  Clone ID: LIB3069-013-Q1-K1-D7
ctttgggctgatttatgtgcttgtccgagtcaaaggaaatctctcttcgaccccgagccaccgaaacactgaatctacacgcagacgccctgaggtagacaccgacaatagcggccttactgatcacggagagccttcagtcgtaatcgcatactcgaataaagctgagtgagatgataattctcctgtagtacctctacatcccgacaaagatggtagtggacacaccatctacgacgagtcataaaaagtacgtcaagaacctggcacagaagacgtatattcagaagacactacttacgatgccgactaggataacgacggctggactgatcataatgagcccgcaataacgacgtagaagggaaacaatttatcagggaaaaaggggtatcgttagacgagtcccggctccatagaagtaccgaagtccggtcaaacggtacgacta

SEQ ID NO: 57506 - DNA, 398 bp, Zea mays
  Clone ID: LIB3069-013-Q1-K1-D8
gcttggcttggacctttgggctgatttatgtgcttgggtggagcctaggcctgcggttggtggcccttgtatttgttctattcctcatagtcttcatcattatattaaggctattgatggttctctgtctcgtggttttgcgtcggattaggctaaggccgcgttcgctaaggtgcagcgaaacgtactgtgagagtgttgagcgatggctcgtctcgtctgatgctcgcagtcgcgtcttctgcgaccaggagtggtgggccgtgaaagcgcggctgaacctcggatttccaggaacgcgactacggagcgtcgagtcgcgtgacgcgtcgcactgaaacccagctgactacgcgcctctcatatgcccgtaacccgtgcccctaacttggcaccga

SEQ ID NO: 57507 - DNA, 307 bp, Zea mays
  Clone ID: LIB3069-013-Q1-K1-D9
aagaaggaggcgtacctatcgccgaaaccagcgtcgaaacgtctgttaattccggtacctttcgaactacctccggatatctcgaaaggagagtctcatcgggacaactaaacgagccttccgtacataaagccgtccgcgtctcgctctagggatcaaaggctactgtacgcgcctccgatatttccgacgaaagtgaggtctacgctaattatagacggcgtcgtcgtatagataaaagttaccgtcgagtagactaaagatcggagtaatgtaccctccgttcacgaattaaatcgggtcaccg

SEQ ID NO: 57508 - DNA, 376 bp, Zea mays
  Clone ID: LIB3069-013-Q1-K1-E1
ggacctttgggctgatttatgtgcttggttaatttcaaggcataccacgagattatcggtttagagactcgggaggacctaaaggggaaggcggacacatctaccggcggaaccggaataggtgggataacactcggcgtcggttgcccttctaaggagaaaaacctcggaaccaaggccaccggcaccgagttcctcgaaagcaatacatctcttggcggaaaattcggcttatacaagacctagggaaccggcgtaggacccgccttaaggaatccggacagtgacacctccgacgaagcaaccgagacactaagcgacgaagtcgccgagatagtaaaataaccggtcgcctaggaaagaccatcggccggaa

SEQ ID NO: 57509 - DNA, 407 bp, Zea mays
  Clone ID: LIB3069-013-Q1-K1-E10
ccacgtcacttcgccgtccctaacacgatcatcggattatcgtgccagggagccccgtaaagggtaagggtcatagatacttaggcgcgtcgcgtcctcccgcgcgtcggcgccttaccccttccaatccctacccggtactaccccgttagccccacgtcccaaaacgccaactgatcgcccggcgttagtcgcccgccgtaatacgtggtttattctgagacattagcgtatgccacgccgtccggggatatcttatctccgccggattcgcaagacgattcgagacccttacccatcacttcccagcctcgctagcgattaccgtccactcagtccctagatcgacatcacgtattattatataatcaacctcgcattcgccgcgggccccgttaataactcgc

SEQ ID NO: 57510 - DNA, 304 bp, Zea mays
  Clone ID: LIB3069-013-Q1-K1-E11
gaaaaaaagaaaaaaaaaaaacaaaaaccccatactcaaaaaaaaaaaaaaaaaaaaaaaaagaaagaaccaaaaaaaaaaaaagaagagattaaaaaaaaaaaaaaagggtaattgtcccaaaggacttaaatccatccatgtccgtccgtcatgctacaatcccctcacaaggctattaaaaccaaaccaatcgtttgcttacaaataatactccgatcggaaaaatttcgaatccatttaatccaactgtcccctataatactttttccctcttagccggagcaaaagtaaaaaggtttta

SEQ ID NO: 57511 - DNA, 189 bp, Zea mays
  Clone ID: LIB3069-013-Q1-K1-E2
ggacctttgggctgatttatgtgcttgtttatgtgcttgggtcatccttctgctagccgccgttagtaattttcatgcattacatcgcttgggctgattatacattactccggttcggatattcgggtcgttctgtcttgtccatgtgtctgtggatgtgttgagctgttggttgaattagctggttgc

SEQ ID NO: 57512 - DNA, 296 bp, Zea mays
  Clone ID: LIB3069-013-Q1-K1-E3
ggacctttgggctgatttatgtgcttgtttatgtgcttgtctatgtgctttgccccagagtcgaaaaagcacacgacggactggagaatcaggtaatagcctccatccgaagtcgtttactgccgctaagaggtcgggtctcacgataaagtcgcggaaacctataaacgagcaggagttcccgttacggtctcctagataacaaataagcgtccgctcgacgtaactcgcgttacggtatggtacacgtcagacggtgagagctgcgtcgtcgattcaacctacctcggtaacga

SEQ ID NO: 57513 - DNA, 310 bp, Zea mays
  Clone ID: LIB3069-013-Q1-K1-C8
cttggcctggaccattggtctgctttatgtgcttgattgaatgcatgagaatgaatccgtaccaacagtgtacggacgggtacgtactcgtatgcgtgtacgctttatgatgagatgggaggacattattgcgcagcataagcacaccaacaacgaacgacagcacgcatattcagggatgacatcagtaacggtcacagacgagggtaaatcaaaaagagcgtagggctaatatacaagacactcagactcatctccatccgtctgactacgtcacgatcccggcgcggcacattgcgctccaaacgta

SEQ ID NO: 57514 - DNA, 168 bp, Zea mays
  Clone ID: LIB3069-013-Q1-K1-B12
ttatccagtaccgatcacgacatatcgtagatcaccacggtgtacaagtcctagtcacccgatacacgttattattactcaacggaaagcgtagtagatccatcagacccattgaaactacacaagtaattcgtaggactcatactcgaacggagtcgtatgtccatc

SEQ ID NO: 57515 - DNA, 407 bp, Zea mays
  unsure at all n locations
  Clone ID: LIB3069-013-Q1-K1-B3
ggacctttgggctggtttatgtgcttgcacaatctcgtattttactggagatctggagctgggggtgttagtgctctgttctgttgctagtagtagtagtagtcgtattcttaccttatggtccttgctgcgtgtcctgctcgtatttataaaggtgatggtgatggtagggggaggagacgaagtcgaagtagtcggagggttctccgggcggttcgatttagcctcttgattttaaggcatcgtcgatcgtgttattgnntattgttttattctccgggcggttccctccctccttccctctgcatttcgtctgaccctgttctgtttaattttgataaaagggaaggggaaaagtggaagagcactcgatccccgttattaacggtgcgcccccccataatgag

SEQ ID NO: 57516 - DNA, 324 bp, Zea mays
  Clone ID: LIB3069-013-Q1-K1-B4
ggacctttgggctggtttatgtgcttgtggatgtgcgggcactgtcggcaggcgacactaccttcttagaaacgtcctagaagccgatacactcggtcactagatattacttctagaccaagtgcgccgatattgcctgagtacatattcccggggcgtcccatcccgccgaggccgataccgagtccctagaggatccgttatccaaggaggtatatgttaccggagaactctcttaaactaagaccgaggagtcattcgaagccgagtgagtacctgcctattcagaccctgaacgcgattacaagttggagtacctaacct

SEQ ID NO: 57517 - DNA, 462 bp, Zea mays
  Clone ID: LIB3069-013-Q1-K1-B5
cttggccctggacctttgggctgatttatgtgcttgggttcatcggcctagggatacgtcctacaagtaccgagactcttagagttgagttcgagtatggaaggcattaccccgcctagtcctgttcagcgcccgggacggtttaacggcctaaacttggtctagcgttcggtcattaaaacgggaataaaggatagtcattttgactaaccgcgacgccgcgcgcccgcgggcacgcctctctcggagcccgagtcgcggccaccccactgcgccggccgactgcgcccgaaacgtccaacctaggatcgcgatactctgagccgccccaaaaaaaaaaaaaaagggtggttgtctcagaggacttaagtccatgcatgtgcgtacgtgatgctacagtctcctcacagcgctattcaaacctaacctatcggttgctgccccataatgctgcgatcggga

SEQ ID NO: 57518 - DNA, 461 bp, Zea mays
  unsure at all n locations
  Clone ID: LIB3069-013-Q1-K1-B6
ggacctttgggctgatttatgtgcttgtttatgtgcttgtagatcttctcttgtctcacatttctttcattctgttgctgttgctggactcgttacgggggtgcataagcatgctctggagccacggagaaggaagtaacttgatgcgacgtggcctgcctaatgtgcgtgtcgccgggagcataggtagtagttggttactgcttgttctataaggtttatttgttttgataaggtttgttgttctggtcctaaggttaagtaggggcacgccgcccattgtgcttgcgcgaggtgcggcggtaggaagaggttcgcgttgaagggcaccgctcacggtaagtttaagtattagggcactatttagtctaagccttagaggaataagagactcgccgtcgaggaatgggtcggatgaaagtccggcggatctagggcctctaatcntcatcgggcgaacg

SEQ ID NO: 57519 - DNA, 290 bp, Zea mays
  Clone ID: LIB3069-013-Q1-K1-B7
ggacctttgggctgatttatgtgcttgtggatgtgcaggtacatctgcgcctggcctacatgtgtaacattccggttaaaaagtccgggtcactaccaaagtgacattggatgacgcgtagcacttaataccgatctaagttcacgatacatcacaatactaacacaactctagccaggcgcatcgtatctagtgtatcaccgtaatttcgagaacgtcaaaatcttatgataggttaatacatactgtacgtaagataaataccggcactcagacgatcctacaaccgc

SEQ ID NO: 57520 - DNA, 445 bp, Zea mays
  Clone ID: LIB3069-013-Q1-K1-B8
ggacctttgggctgatttatgtgcttgtggctgtgcgggactaggaaggagtacccgaagacgatacctgctaaactttaagacatgaaaccctggtggatggacgagttcgagaagtaagacgccgattttacgggcttccccggcggaacaacgacagagcgtggaattaactaattcaccgagaaagcgtccgtagtcgaagacgtagagcgccgcacccgttcactggtccacgacgatagcgtagagccgtgtgaatcttttcgcgggtattacccttatcgtattcgcactgacaagcggtcctatactaacgtaatacgtttttcgcgtaagcataatacctggaaaagtagtagcagtagcggaagcgaagaagcacgaacgtagctcgtccgataacgtaaactcggcctaatcctcgcctttgcgtcaacgcaat

SEQ ID NO: 57521 - DNA, 391 bp, Zea mays
  Clone ID: LIB3069-013-Q1-K1-B9
tttagtgcttggagtccagaaggatagcagcactcaccaccggcttttcgcctcgagccaacgcggtccacctcaatcagagagacaaagggtggtgtctcagaggacttaagtccagcatgtgcgtacgtgatgtacatcacctcacagcgcattcaaaccgacctacggttgctgcccataatgctcgatcgggaaaatttcgtgccatttaatccaactgttccgtagtatactttttccctgttatcggtgcaacagtgaataggtttgtattgactgtttccgttaatagccgtctagttcgaacggtgaacgggatgtgtttcgcagtggagtaccaagtgtggtcggcgcggcggccatgtgtagtgcgattgccatatccgtt

SEQ ID NO: 57522 - DNA, 429 bp, Zea mays
  unsure at all n locations
  Clone ID: LIB3069-013-Q1-K1-C1
ggacctttgggctgatttatgtgcttgtttatgtgcttgtagtacgccgaggaggtagagagaacgggcacagataacacggacgcggaagtttctaagaagacgaataaaaataagaagtcagcgaagaagtcggtaaagaagcattacgtcccttccgtactcgaggtcactaccaagtaaaccttctgctcctccggcttcggctccaataaggtaggaaaacctttcattccggcgatatattaggaactttccgagcttaaggccaatgagataaaggtcatagccaagccttagtcgaagaaggcgtcccgtacgggcgccgtcgccggtaatcgtggtacggacgagaagtagactccttagaacgcgtaaacgagcgctaatccntctgcgctgtctccgaaaaagaaacggtagaacgcg

SEQ ID NO: 57523 - DNA, 424 bp, Zea mays
  Clone ID: LIB3069-013-Q1-K1-C11
cccgttggacgtgtttatgtgcctgtggatgtgcgggtggatgtgcgggctacccacctatcgtgttaagagccttaagccgtggtcggagatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaaagctg

SEQ ID NO: 57524 - DNA, 357 bp, Zea mays
  Clone ID: LIB3069-013-Q1-K1-C12
tctcgttaagtagtactctcctggataggtgtcttctagacgagcctacggacgttaatacttagtccgtctctgccgccgtcaggaagtctaaagagtctaaggggatcaggctccgcacagcgcccttcgactaattcgaaaaatgcagggtactagagccgcctaagatagtcacagatatgaccgagggcgcaattactagtctttcggacgacccatttatcgatttcgctaatagtcctcctaaactaacaagaaatatttcggacctcgatcctctagacgataacgaaggcagacggaaactcgacgaattattactgccacacactcctactaatagtagtatgtgcg

SEQ ID NO: 57525 - DNA, 420 bp, Zea mays
  Clone ID: LIB3069-013-Q1-K1-C2
ggacctttgggctggtttatgtgcttgtttatgtgcttgatctgcgtcggagaaggttgctatgtttacggtgtttggtgttggtgtgtagcttagtgttcatactcatgagtctcctaatgaggattcttgggtgggttttgcgctggaggtgaatcggggttcgcctcatgggaatggtattttggcgcattcttcgtatgcgcttggcgtggatgggccttcggggaatgatatgatggattggattcctcgtgcggttgttgatgatgtggattagaaggtggcgtaggtggttacggatcgggtgcgtgggtttgggtgtgttgatcgtatggtgacatagtttgggtaggtgcgtcattagtttgatgatgcgtgtagttatgtgctgcctgtgcctgatgttcatcattagct

SEQ ID NO: 57526 - DNA, 258 bp, Zea mays
  Clone ID: LIB3069-013-Q1-K1-C3
ctttggctgatttagtgcttgaaaaaaaaaaaaaaacaaaaaaaaaaacccaaaccaaaaaaaaacacataagacataaggagaatgccttaacgggcgtgttcccacaggccttacgcccctgcatttccgtcacgtcatgacacaatctcgtcccagggctcttcaaacgtaaaaattcggttgcagcctaatactgctgcgatcgggaaaacttcggccccgttaaacccagctgctccgtagaatactttatcc

SEQ ID NO: 57527 - DNA, 436 bp, Zea mays
  unsure at all n locations
  Clone ID: LIB3069-013-Q1-K1-C4
ggacctttgggctgatttatgtgcttgggaggaggttggtgatggtgatagtacctagagttctgtgtccggggtgtccgataatagtcctccagctggtggtgttgggacataggcggctaagaatccttgttatggtccgtatgggaagggtgtgctggcgaagactctgggaggttgcggtggtagcgggagtgtccacctgatgttgaagaaggtatcgtcgacgtgtggtgagatcaatacgtcatcgacgagtttaggagaggtctcgtaccttaacggcgcctattacgccgatgccgagatcgggaaggccgctgtagaacggtggcccgagaaggacggagtcgacactataacgtgagataccgttaacgatagtaagggagtgtagccggaatttcntgggctgatacctccgggttcggacgat

SEQ ID NO: 57528 - DNA, 474 bp, Zea mays
  unsure at all n locations
  Clone ID: LIB3069-013-Q1-K1-C6
gcttggccctggacctttggtctgatttatgtgcttgtttatgtgcttgagtaaattaacaaagcacgagagggggagagatatagaggttctatcgtatatatcgctccgctctctagctttagagtccctccggactgtgaggaacttatcggaaaccccgtaaccgcagcagagaatcgcactgcttgatgaaggcgtacggcgccggttacgggctatggtagggaatagagatgagtaggctggtgtctcttttttagtctaccgacttcgcttctgtcacaaggcagcttcgtggcggttcttgaaccctatctgactgaatatgatacgaagtggttatgtggtgttagctttttctcggtcgtgacgattaacttgaatgacgacggccatggtgcggctgggacggaggtggatgtagatgtggatgtggatgangagacgacggtgcgtggtggtggtngggag

SEQ ID NO: 57529 - DNA, 399 bp, Zea mays
  Clone ID: LIB3069-013-Q1-K1-C7
cttggccttggacctttgggctgatttatgtgcttgtttatgtgcttgcgaacgaataaataacacacaatgaacggacgggtacgcacactgctacgtgtacgctttatgatgagatgggagcacattatggcgcagcagcaccacaccaacaaccaacacagcacgcttattcccgcccgacatcatcaagggtcacgcaccgaggtaaaaaaaaaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccct

SEQ ID NO: 57530 - DNA, 423 bp, Zea mays
  unsure at all n locations
  Clone ID: LIB3069-013-Q1-K1-B11
tgcctggcgggacgttagataatccacagtcctccgtccgnagttactactttatctagtcatggggagagtatccctagcggtcgcggggacttaagaaggtccctgcagcgtaatacccgtaatcgtatcagctcccgtacgcgcggccacgtacgacgtccccggagcctggccatacgttggaaagtaggtagaggcgtcgaactaaaccgctcacgagtcgttagaggaatatttaccactagagataaagttatcgtgcgaaacttccggatacatcgccttctaagctgcggttggacgtacttccggaacttctacggtcgctgccacgtccccgctctctgggaggctccagctaagcgccgcctatttcacactctgtcggcgacggtcataaagtacaaaaatacgactcct

SEQ ID NO: 57531 - DNA, 183 bp, Zea mays
  unsure at all n locations
  Clone ID: LIB3069-012-Q1-K1-H4
aggaaccgggtgcggacccacgccgtcnncgcaaattgtattctttcatttagatnnctgtctgagtgttgtataacttannaatgganngcagtagtattctatcagtgagttggtacccctgggttactgagtatttaattttgttttcataatcttatcctnntacagacgattgcactt

SEQ ID NO: 57532 - DNA, 202 bp, Zea mays
  Clone ID: LIB3069-012-Q1-K1-H6
cggacgccttggccgaccccttggggcaacttgttagactgggagatagagagaggagagggagggtttcctcaaagagaacctgaacccaaacccaagcagagaacactagcgttccctcaccaaggcgggcgtccatcccagcagccatggcgatggcgtacaagatggtaaaaccttccccgcgctccggccatgcgcc

SEQ ID NO: 57533 - DNA, 409 bp, Zea mays
  unsure at all n locations
  Clone ID: LIB3069-012-Q1-K1-H7
ctcttcttcacctcactaacaccagctagctactttttcttttctgcaataaagggcggttggttcttcttcgacacccaagccgaccccaccgacgtacactcccacaccgaagccgccggccaccaaagccgccacctacacttcgacgccgccggtgtttnacacccccagcccgccgncaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctcctctttgtgtgctgccatccgtccccgttagacgatcgaggagagaataacgcagagc

SEQ ID NO: 57534 - DNA, 384 bp, Zea mays
  unsure at all n locations
  Clone ID: LIB3069-012-Q1-K1-H8
cgagcacactgatgttgctgtcctgctcgacaatgaggccatctatgacatctgccgccgctcccttgacattgagcgcccaacctacaccaacctcaacaggcttgtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtnaccgggtgatgt

SEQ ID NO: 57535 - DNA, 340 bp, Zea mays
  Clone ID: LIB3069-012-Q1-K1-H9
cccagatggagtcttctgttggtgtagcagatatacagtatagatattctcggtactaagtcatttgatggtgctaacgacatggcagttgaagcaactattgtctctgttgatcaaaatggcgaggactctgtagttcctgctgaagcaggtgtagagcctgaaacatcagagcaaggtcggcgccagcaaaaccagagaggcagaagaaaaggtggtatgaaaagaacacggtctgttagtgctgtagttgaagatgctaagatgatacttggcgaggtttttgaggagaagactgatgatcagggagatacagtcaaggtgggcgctacacgaaagc

SEQ ID NO: 57536 - DNA, 403 bp, Zea mays
  Clone ID: LIB3069-013-Q1-K1-A1
gacctttggtctgctttatgtgcttgggagcttcgaatttaattgaacttctccacccatcacttattatacgactcacttcacaatggcggtagcctcatactaagcacctatagtccacggacccgcggagaagaccgctataccctaaaagctagtcggcccctaagtctccacctagccctatctgtgttaagaagtcgcggaagtacccggcctcccgtacggaacgaatacacacgacggccgtcgttagtcagacacctaacacctaaactctagcgaatcgtaagcttaccataataatgattgactcagagaccctataaacttactaccattcatagaataatgtttcagggttctctagtaagtccacttcgacttagtcaactctcacgtt

SEQ ID NO: 57537 - DNA, 269 bp, Zea mays
  Clone ID: LIB3069-013-Q1-K1-A11
taaagggttgctgtctcagaggacttaagtccatgcatgtccgtacgtgatgctacaatcactccacagggcgattcaaaccgaacctatcggatgctgccccataatgctccgatcgggcaaatttcggtgccattgaatccaactcttccgtagcataccttttccctgatagacggtgcaactgttaataggattgtattgactgtgtccgttaatagtcgtctagctcgaactgttaacgggatttctatcgcagcggagtacca

SEQ ID NO: 57538 - DNA, 335 bp, Zea mays
  Clone ID: LIB3069-013-Q1-K1-A12
cccttccgtaattgaccgctcactttttctttaattaaagattgacggtgtttaacgctgagaagaagtttgtggtgaacaagttggcggaggaggagtttgtggttgagaagatgattgttgggaagaagtttaaggtggagaagtgggcttttgtcggtaagcttgttggtaaggagggtggtgagggtaagtgcggtaagaagaagggtaagaagagtgcggagatgcataagactcatactcctaaggcgtcgaagtaggcgtatttggatactggtactcttcttaaggttacgcttactacgaatcttcctactaatgatactcctgag

SEQ ID NO: 57539 - DNA, 362 bp, Zea mays
  Clone ID: LIB3069-013-Q1-K1-A2
gacctttggtctgatttagtgcttgaagtaccggacgtcttcaccccttacgccaatggcgacgacccggaggtcgccgcctacgctcgcgagtctgttgtagaacggtgctagataccctacctagacgcagcggcggataccgcacgtcattggtgacccggttacaacgaaaccgacgagttgcttcctatttaattcaagacgcataaggcgaccaggaattacgtaagcgtgtcagagacccactaaaggaagccgccagagctcgggaagactctaaaggaagacaccgacaggccaaatataaaggctagtatcacatccaacgaggaaccctagaatagtaaagatcacgcctt

SEQ ID NO: 57540 - DNA, 402 bp, Zea mays
  Clone ID: LIB3069-013-Q1-K1-A3
catgaaaaaatatatataggggaggggaaaacccctctgctcctccttttgcgtccgttagtcgttgaagctggtgagtctcttgaaagtggtggtcacgggccttagttaggtagacaagttatcgtgatgcactgtggtgctgcctgaggagtctgttgttgctgttaagtagtactttgtggcgtttacggatgtcggggttcctctgtgtgttcgtcttaatgctcttgcttctcctggtcgctctggtactgtccctaagcctgtggagacggatcatgctgtgaaggccgacgacccggcggaggtgcttaagctaaccctaataccgttcctcacggccgagtgagatacctagattgatatcgctaggaaattagggagttacataaggaactc

SEQ ID NO: 57541 - DNA, 193 bp, Zea mays
  Clone ID: LIB3069-013-Q1-K1-A4
tttggtctgatttatgtgcttgtttatgtgcttgtttatgtgcttgatgcccatcattggtggtgagtgtgcttggatgatgccttttgaagttagtgttaggggctggttgttaattattccgttggttttaattaaggaaaagggggaaggttttgaaggaaatcctaaggttgcttggttgcttttggaa

SEQ ID NO: 57542 - DNA, 369 bp, Zea mays
  Clone ID: LIB3069-013-Q1-K1-A5
tgcgtgtttatgtgcttggatcagcctcacgattcgtagtctgtggaggttacggcggagcctaataagaaggataggactcctaattctagaggtgctgtttcgggtaatttggcgtcggagcctgtgatggatcctaatgtttgagttgagcatcctcggctgtatggttctactcttgatgttattcattgtgcgcctattcttgttcgtaatcatctttggcatgctattgagcatcatggtggtctgtcgctgttgtcgcgtgtttgggcgacgaattaggcgatgtgtgagattagttgtcctgctgataagcatgatgctatgtctgatgctcgttctctgctggcgtctctctagcttaag

SEQ ID NO: 57543 - DNA, 476 bp, Zea mays
  Clone ID: LIB3069-013-Q1-K1-A6
acccctggccctggacctttggtctgatttatgtgcttgtttgctcctctcttgtatctgacatttcacttccgatcagtcttgactcggcatgagacggttggtaagacgaaggagccagatggtgttagtttcgttaagactcctaccggtgggtctcttaaggacataagtacgagcatacctaaagaataccccgggaagcacggggacacaaccgacgtcgctacaacgaaggattgtcatatataaaagtttagaggtcccggtcccaccatccccgtcgactttatcgccgccgatagagcgaccgatgacgaatacgccactaacggaaaattggccgaaaccaagagaatgactttcaagggagtcgtcttcccgaaagaccctaagatgaagaagacccccgccggcggaccatttctagtctcaaaaggagacgaacctaaggaaactcccctaagcccgggaag

SEQ ID NO: 57544 - DNA, 471 bp, Zea mays
  Clone ID: LIB3069-013-Q1-K1-A7
ggcctggaccattggtctgatttatgtgcttgttgatgtgcctgtttatgtgcctgtggccgtgcggggcgtccgcgatccgtcgcgagcctaagcaccggcctgaggagaagacgagagaatgtcatagtaacgtcttaaatggactcgtctaatacgttcggctgattgtttcagcccgcgcggctcatttcagatagaaccactcgtcgcgccggtccgcgcatcccgaccgcattttaagcaccccgaagcctcgaatccaccctcgtcaaccggcgctcgaagcggacaaaaaaaaaaaaaaagaagaaaaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatcca

SEQ ID NO: 57545 - DNA, 432 bp, Zea mays
  unsure at all n locations
  Clone ID: LIB3069-013-Q1-K1-A8
tttggtctgatttagtgcttgataccctcagagagtcaagaatgccgcactacaggacaccagggaaagtataggaatctcctcccccttacgaatccagtttcggaagtcgtcctccttccttatacggcgtcaggacacacaataaatcgacggatcctacgtgataatagcatagagacagaggacattaagaggcgccgagtttaaacacccataacacgtaatcacgggaaatcctcggatatgttgtanatcacaaggagaatacgcccgcccccgagactgagaaataggaacccggatccaagttaacgaaccgcttaggatatcgctcaacgcccgtcaacagggcctggctgcatagagagccgttctcctgtacggtcgaccccggagcgtcctacagaaacgagtccagcggcgtctcca

SEQ ID NO: 57546 - DNA, 369 bp, Zea mays
  unsure at all n locations
  Clone ID: LIB3069-013-Q1-K1-A9
tgcttgtttatgtgcttgtttatgtgcttgttgcccttcatgagtagctgtatgtaagcgctaagagatgaaatggctgatacggtctgtatgtaactcgttgcagtggctgttgcggcggttgtggcgtcgtcgtcggtagtggtggtgatgattctggaggttgttactattcgtgggtaggcgagtcttgttactgtgtttcgttctcttcatgtttgtggtatggggcttggttttcttgtgcttcgtcgcagtggtgctaggaattctaagagtgttgntagtattgttgntgataggtgtgttgatcgtaatcgttctaagaatgttgntaggggtgctagtggttctaatgttggtaatgtt

SEQ ID NO: 57547 - DNA, 285 bp, Zea mays
  Clone ID: LIB3069-013-Q1-K1-B1
tttgggctgattagtgctgttatgtgctggagcgcaatatgtaggtccccaacagcttcgaaatcgtcagtcgccgtaccatcggtcatatcaagcgacaaacaaaaactactcacggaaccacaatacaaaaaaaacgatcgttggcgcatgtctcataggaccaaagtccatcgtacgtagtacgtcatgctacaggctacgcaatacgatcgtaacacataggttgtcggtcgataatccatcaatcggcaatcagacacaagtcattagtatgtcttccac

SEQ ID NO: 57548 - DNA, 191 bp, Zea mays
  Clone ID: LIB3069-013-Q1-K1-B10
aagtttgtcgtgaaaaagttggcggaggaggagtttgtggctgagaagatcattgttgggaagaagtttatggtggagaagtgggcttttgtcggtaagcttgttggtcagcacggtcgtgagggtaactgcggtaagaagaacggtaagaagagtgcgcagatgcataagactcatactcctaaggcgtc

SEQ ID NO: 57549 - DNA, 335 bp, Zea mays
  Clone ID: LIB3069-012-Q1-K1-H3
gcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccg

SEQ ID NO: 57550 - DNA, 360 bp, Zea mays
  Clone ID: LIB3069-037-Q1-K1-H4
cccacgcgtacgggtgggttggcttctcctgcccctccggttcgggttcgggttcgtgaggttgttcggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcg

SEQ ID NO: 57551 - DNA, 147 bp, Zea mays
  Clone ID: LIB3069-037-Q1-K1-H5
atgattgatattggtagggagacgatcaagctgaggacccccaatccttatctttggagcgaagaccatacttttgagtctattggcactccgaagaatgttgtatgccagcttcattagccactcccatacagtgtgtcctgaaat

SEQ ID NO: 57552 - DNA, 432 bp, Zea mays
  unsure at all n locations
  Clone ID: LIB3069-037-Q1-K1-H6
gcaggatcttctatatcctatggtccccatcctccgccaaggtgaagagcaagatgcttgatgcaagctcaaaccaaaaattcaagagtgggctcaatggcattcaggtggaactgcaggctactgatgcaagtgaaatcagccttgatgagatcaaggatcgggctcgctaggcatcatgatcatgcatcatggactcggcctactactgtggatttgtatgccattatagacttggtgctgtgaaagactgcttgatgatttgcgggtttgttgctgtgtaaaaaaaggtcccatggctcccagaagaccatgaaggttcggatctatcatgtaattccttggtatctgccaattatgtatggactatggacatgtgttgcgctgntcaacttactactacaaataagtaatcgatatgttccctttccc

SEQ ID NO: 57553 - DNA, 261 bp, Zea mays
  Clone ID: LIB3069-037-Q1-K1-H7
gaagatcgtatgatgatgtctggaatgcatactgcttctgatatcttatgtgtaggctgtggatccattgttggatggaaatatgaggctgctcatgagaagagccatagatacaaggaatgaaagtttattctggataggtacaaggtgtatcacccttacggaagcctatactggattacacaagatcctgaattgggtggtagcgacgccgatgatatatgaagcgtcaagtaacaagttcaaaccatgttgtcattg

SEQ ID NO: 57554 - DNA, 427 bp, Zea mays
  unsure at all n locations
  Clone ID: LIB3069-037-Q1-K1-H8
tcgtccacgcgttcggagagtcctgccatccacaagttcttagcttttgcgagattgagatgcggctgggacaaacgacagaagaggaagaacagaaaaatggggatggaagatggatcttcanatgggaaccagcaaccggtgcataaagaatacgagatgagaccacaccacttcttccagtcaaggtggaggangacgaggggtttcatgagttcaatggagcttcattctctggggcagttttcaatctgtcgaccaccatagttggggctggaattatggctcttccagcaagtatcaagatgctgggcatcatcccggngattctgatgatcatccttgtggcactgctcacagaggcatccatcgacatgcttgtaaggtgcagccaccatggcaagattacatcatatgggtggttgat

SEQ ID NO: 57555 - DNA, 431 bp, Zea mays
  Clone ID: LIB3069-037-Q1-K1-H9
aagagagaacaccagaaaggacaaacaagagaaaaatcttaacactgaaattgccatgaagaatcaggagaatcagacagatgatgtgcaagttggtcatgggggtgtagatgagctggttaggagaaaagaagaaaatgacaagagcaatatttctcggagtagaacagaagggaaacgacacttggtacagcaccttgagacggagattgagaaattatccatccgatccagcccacttggtaaagacaggcagtacaataggtactgatttttcaagcgtgaaggaaggctttttgttgaaactgcagattccagagaatggggttactacaacactaaggaagagctttgaaacggcaactagagaagttttacagtaagataagttgcatgctacagtaatgtcctagagaaacgatcaaaagata

SEQ ID NO: 57556 - DNA, 375 bp, Zea mays
  unsure at all n locations
  Clone ID: LIB3069-038-Q1-K1-A1
ncgccacgcgttcgccaagagccagttgttctttgccataaagaaccttataccagaagttcttttatgctgtgggaactaatttctctacatagttaagcacatggtcgtgaccacgtatgtcgtggataccatttgcgcttncttttcccattactaaaaatattatggtcacaatttgcactttaagttataatgcagcacagtgcttcactgtctgagtctacaacaacaacaacaaagcctttttggtccaagcacgttggggtaggctagagatgaaatcccatatgaaaacctcagagctcaaccccaaagaaaagaaaagggagataaagggcaaagagaacccgaaaacgacgaaacggggaaaca

SEQ ID NO: 57557 - DNA, 327 bp, Zea mays
  unsure at all n locations
  Clone ID: LIB3069-038-Q1-K1-A10
attacagctagctgcaaaaatcgttcatgtattataagcatcaggcagacttaaaaacatggtagtcttagaacattgttctatatccttgcagagcaactagaaaaaactctcaacacagcacattcagaggatttatgcgttggcagcagcctgggcagcggcatcccgcttcctttgctcttctatgatgctcagcttgattcccttgcccttgggcaggctcacccacggcttattacccttgccgatggtgaacacgttgcccatacgggtggcgaactggtngccccaggagtcctncacgtgaatggtctcaaaagctgc

SEQ ID NO: 57558 - DNA, 340 bp, Zea mays
  unsure at all n locations
  Clone ID: LIB3069-038-Q1-K1-A11
cacgctgccgtcggaggtcacccgcgcggtgatgctggtgcgcatcaacaccctcctccagggctactccggcatccgcttcgagatcctcgaggccatcacgaagctgctcaacaccggtgtcagcccctgcctgccgctccggggcaccatcaccgcgtcgggcgacctggtcccgctctcctacatcgccggcctcatcacgggccgncccaacgcgcaggccgtcaccgtcgacggaaggaaggtggacgccgccgaggcgttcaagatcgccggcatcgagggcggcttcttcaagctcaaccccaaggagggcctcgccatcgtcaacggcacg

SEQ ID NO: 57559 - DNA, 312 bp, Zea mays
  Clone ID: LIB3069-038-Q1-K1-A12
gccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaagggcatcccctacctgaacacctacgacggccgtaccatccgctaccccgacccgctcatcaaggccaacgacaccatcaagatcgatctggagaccaacaagatcaatggac

SEQ ID NO: 57560 - DNA, 338 bp, Zea mays
  unsure at all n locations
  Clone ID: LIB3069-038-Q1-K1-A2
caacttcaaaaaggttcggttttcagaggtttcaaccttgtgcataccacacctggtttgtgctttgaaggatggaaatgaggctgcccaagagagcgtgcttgacaccctttgcttgcttaaagaatcttggccgcaaatgaatgaagacatcgctaaagcccagtccctgatttcagctgaagccatacctgtactacaaatgcttatgaagacatgtcctnccagttttcacgagagagccgatagtttgcttcattgcttgcctggttgcttgacagtgaccatcattcgtgggaataatctgaaacagacaatggggggtacaaatgcatttt

SEQ ID NO: 57561 - DNA, 270 bp, Zea mays
  Clone ID: LIB3069-038-Q1-K1-A4
atcgccgtcctcggcttcgccttcaagatcttcgactactagaagagccggttcgtgaaccgcgtcgtgtgcgtccatgttcaacaccgttgccggcaagaagatcgccgtcctcggcttcgccttcaagaaggacaccggcgacaccagggagaccccgggcatcgatgtctgcaagggcctgctgggtgacagggcccagatcagcatctacgaccccaggtgacggatgaccagattcagcgggacctagccatgaacaagttcgac

SEQ ID NO: 57562 - DNA, 436 bp, Zea mays
  Clone ID: LIB3069-038-Q1-K1-A5
gtgacacaaggagcatacgactcacggaatatcttccagtcactagatcttgcatggacattgcttcggatcttccctcgcgaacttctccaccgtatcccggcgaagaccttggaccagtactatagcagagatgcctcccactgaatcactgatcgttgatcagtgttccaatagtttggcaagtgttgaatcaattgaacagattggcttcatggccttttccctgtatttatgtgtagtcaggtccaattcttttctggtgatgagcgcaaggttatcgtagatgactcgcggtcacggcaatatttgtgatattgaggcatctgtggactatgggttaatttcagttatttggtttctttcacctttcagaactgttagcaagaacattctgggccaggatgctcgaacacaactggctgtatgtacattt

SEQ ID NO: 57563 - DNA, 465 bp, Zea mays
  unsure at all n locations
  Clone ID: LIB3069-038-Q1-K1-A6
attcgacggagccaaccaacctcaccaagttataccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtaccgctcaggctaagtctcgtcactcaaatgggcagggacgctggcctgtcaaatctgctagattcattctagaccttctcaagaatgctgagagcaatgctgaggtaaaaggtcttgatgtcgataccctctatgtgtcacacattcaagtgaaccaggctcagaagcagcggcgcaggacctaccgcgctcatgggcgcatcaacccttacatgtcctncccgtgccacatcgaactcatcttgtcagagaaggaagagcccgtg

SEQ ID NO: 57564 - DNA, 455 bp, Zea mays
  Clone ID: LIB3069-038-Q1-K1-A7
agcgcccaacccgccggcggacccaacgcttccgacagtagcacagccacctccgccacggcgccggccaccaagatcgcctcagacagaacctccacccctggcaccaccaccttctggaattcctgtcgaaccttccccaaccagtccctcaccgacgtccgcagatccttcgatccccactccctctagcccctcgtctccagggacgacaccgtccacaccaggctctggtggcactccatcggtgccagccccagcaacgccaggtgactcagttagcccggtaacaaccgggggccaaggttccaacaagtcgtcgagtccagcctcgcagagcagcagctcctcagtagacagtggtggactgtcttctggtgcaaaggcatgcattggggtagtcgttgccattcttgtgcttagtttggttggagcagcattttggtacaagaaga

SEQ ID NO: 57565 - DNA, 349 bp, Zea mays
  Clone ID: LIB3069-038-Q1-K1-A9
ccccgatctcgtcgagaggaagcccaatttcgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgtccaaggccatgtccatcatgaactccttcatcaacgacatcttcgagaagctggcgg

SEQ ID NO: 57566 - DNA, 192 bp, Zea mays
  Clone ID: LIB3069-038-Q1-K1-B1
atgaactggaagccgaacttgaagaactgtttggagcttagttggaatctcagcttctggagcctgttgcagctcctccggtgcatccagtgcatgccccagccaacaagcaaccagcgcgccctgctccacagaaagctacagctgaagatgatgagcttgctgcactgcaagctgaaatggcattgtgat

SEQ ID NO: 57567 - DNA, 407 bp, Zea mays
  Clone ID: LIB3069-037-Q1-K1-H2
gttagatattgatctggctatcactgatccctgtcccatcgctccggtcgacccggtgcaggaagagaacgagagcgatgatgatttcaacgctcgtgtgcgcaatcatgcaccaataaagatgaagtatgacctttacaaggtaaaatgggatcaatcgaaccgcaagtgtctgatggtgattaagagctctattatggatacaatcaggggagcattcccagcatgtaccaccgctacagagtatcttagtaaggtggagagtcactctactatctcttcaaaggcttatgcatgcacaataattgaaaggctacttaccgataaatacactggcggtggagtaagagagcatatattgaagatggccagcatggctttcaagctaaacctatggaaatggcgct

SEQ ID NO: 57568 - DNA, 423 bp, Zea mays
  Clone ID: LIB3069-037-Q1-K1-F9
ggctgatgcatgcccaatcagggcaatgaagttctctgtctcccctgttgtgcgtgttgctgttcagtgcaaggttgcttccgaccttcccaagctagtagaaggtttgaagcgtctggcgaagtccgatcctatggttctgtgtacaatggaagaatctggtgagcatatcattgctggagctggtgagcttcatcttgagatttgcctgaaggatctgcaagaggacttcatgggaagtgctgaaattattgtttctcctcctgttgtgtccttccgtgaaaccgttcttgagaagtcctgccgcactgtcatgagcaagtcacctaacaagcacaaccgtctgtacatggaagcgcgccccctggaggagggtcttgctgaagcaattgatgatggccgcattggcccacgtgatgatcc

SEQ ID NO: 57569 - DNA, 462 bp, Zea mays
  Clone ID: LIB3069-037-Q1-K1-G10
ttcctctggcgaaccacgcgtccgcccacgcgtccgcccacgcgtccgcccacgcgtccgcccacgcgtccgcccacgcgtccggcattcctgccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggaagctcgg

SEQ ID NO: 57570 - DNA, 455 bp, Zea mays
  Clone ID: LIB3069-037-Q1-K1-G11
ttccctgtggaaccactcgtccgtttggagaacggctatttaactgacgatggtgttttctgttctggtttaagcaactcgtgaagcggcaagttctttggtggcaatcaactaagccacagcacgccaaagaaaccccaagagaagttcgatgctggtgttcctgagacgtcacgctcttattctgctgcagtccctgctggtacaagtagcaagcggcatgctactaggaagtggaagcgctcgctcagtgaccccttccgttcacggccgcacagtgctccggaattggtgtcaggatgcaagggatcaccgcccgtgcctgtggctccagaggagaggtagccgatgagctacagaagacgtatcgtgttatgttttttagcataaattgcaaatgaattatgaatattggtatctgaggcatcatggatgtgaaaaaagtactatgcaaa

SEQ ID NO: 57571 - DNA, 434 bp, Zea mays
  Clone ID: LIB3069-037-Q1-K1-G12
cccacgcgtccggtttaagctatttatgagctttttattaaagtaatgtttaataatgtggttcataactcattaaccttagatatataacatatatcttctctaaaaggttaaaaaggtttaatattgttctaacgtgttttatcatcctataaactcttaatcttagacatatgtgatatgtctaagattaagagtttataggatgataaattggtgaacctaatatttgtatattttaattaagatatttttaagctcatgtcttgttttataaagtatagaacacacatttttgaaaagaatacttttttattataacctttgcgtgtaatgttttcgaaaagtgaatactctttctgttaagctttcttttagctatgcgtatggtgaatgtcgtatgttattgagtggtgtttgcttcttcttgtttt

SEQ ID NO: 57572 - DNA, 353 bp, Zea mays
  Clone ID: LIB3069-037-Q1-K1-G2
tcgggcaagcgtacctgtattaacaggacatttgtctgttgcttcagctgcagtctgtacccacgaggactcctctgccgtttcgtaagccctccaatataccgagcgcaccaagtcaaaagcatctgatatctatgcccacacctagatcaacctgtctgttgccatacacgcagaggctttacaacagactttgaaagagaaagctcgtctattgcaggaacagacatggttcgctacgaaatcacacgactactcacacaatgatgatgtatctagcgctgagaaggctgctggtaaacaggacctgcttagcatagaccacaaggctaacgccaaggacgtccaagaca

SEQ ID NO: 57573 - DNA, 423 bp, Zea mays
  Clone ID: LIB3069-037-Q1-K1-G3
ccgcagaccgggagtagtcgacgcgccgtcactgaatcctcagatcacggctagccgtagtcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattact

SEQ ID NO: 57574 - DNA, 439 bp, Zea mays
  Clone ID: LIB3069-037-Q1-K1-G4
gcacatgatgtcagcgctggacgcgcattataatgctcgctgagcacacactaggcctggtgcgagacgacacggtgactaccgcggagcagagtagcatcttgcttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctgtacaccgtgacttcatcaggaatatgattactggcactttccaagct

SEQ ID NO: 57575 - DNA, 201 bp, Zea mays
  Clone ID: LIB3069-037-Q1-K1-G5
cctacccctacggttcgggttcgggttcgtgaggttctccggggttcggtttcgtgggtgagcggatcgagatggcggcgtcggatgttgagtaccgctgcttcgtcggcggcctcgcctgggccacggacgaccacttccttcacaacgccttcagcacctacggcgaggtcctcgagtccaagatcattctcgatcggg

SEQ ID NO: 57576 - DNA, 395 bp, Zea mays
  unsure at all n locations
  Clone ID: LIB3069-037-Q1-K1-G6
cggacgcgtgggcggacgcgtgggccgcacgaaccgacgcactagaccgacccgcgaatcccccgcgcgcgcgccgtgcggtcaccgtccgaggccacggcaccgtcggcccccgtccccggcccggccgtcaagagcaaaggcaaggccgacgcttcctcctcgtcgtcctccttcttcactccaccgaagttgcgccgcgcgcttgccgtcgtgatggccgcgtcgctgctcgtgctcgccgtggcgttcttggttggctctggctccggngggatcgatgggggcgcagcggctcccgtcgaggtggagggcactgaggtggcctacggtagtgtgatcaagctgatgcacgagaagacgaagcaccgtctgcactcggacgatgtgcccta

SEQ ID NO: 57577 - DNA, 283 bp, Zea mays
  Clone ID: LIB3069-037-Q1-K1-G7
ggtagtcgagatagccttggaactgcacattaatattaactgtacatgtataaatagttgtcgtgagcgcacaccatgtaatcgtcgaaattcatccatgtgttgtgacattttttgagcacagttgaacatgtgatggagcctggaggcaagtcattctcaaaaaatactacttctacactaaactgatgttgcaacgcgcgcttgacgtcgagatggccatgtcgctgctcgtgctcgacgtggcgtacttgattggctatggattcgaggggatcgatgg

SEQ ID NO: 57578 - DNA, 85 bp, Zea mays
  Clone ID: LIB3069-037-Q1-K1-G8
gtgatttatgattggtgctaccttgggctcaaaaacatgtgaacagtcgttctatgaaaggcgatgtgtacacacatgttctttg

SEQ ID NO: 57579 - DNA, 462 bp, Zea mays
  Clone ID: LIB3069-037-Q1-K1-G9
attcccttgtggaaccactcgtccggccggaaaagagattgcaggagcaccttttatgcgcgtattcaagccaaggaaatggcgcgctaccacggcgtgtccgcggacactgaccaagacctcgaggctggcttctccggccactcctcctcccctctgaagcccgcggcctcgccgaggcggcccggccgcatgttctgcgacccctgcgacgacggcgacgagctccacggccgccaccactacctcgacatctgcttccgctgccgtaaactcctgtccggcaacagagacatcttcatgtacagaggtgacctgccgttctgcagcgaggagtgccggcaggagcagatcgagatcgacgaggcgcgagagcagcggctgaagcagacggtgcgggccgagcagcagcggcagcggcagcagaagcagagcccccagaggatccccatctggggcggt

SEQ ID NO: 57580 - DNA, 441 bp, Zea mays
  Clone ID: LIB3069-037-Q1-K1-H1
tcgggatgagctacaggcttcgcaggattgttgacaccttcaaggaccttgtggaagaaatgagcacctttggattcaacaagcttgagcccgaggcaacaacgacatggaaggagtggcgtgagacggattctattatcgttgatcctgaaaatattgttgccaggtctagacatgatgagaggaagaaaattgttaacttattggtcaatggtcatgttaccgatggtgatcttatggtcgttcccattgttggaatgggaggactaggcaagaccacactcgctcagctcatctacaacgaccctcaggtcaaggagcactttcatctactaaagtgggtatgtgtgtcagatgatttcaatctccgtaatctttccacaagatatgcaatgtgtcagagacaatccctgaagatgccctatagaagcttcaggaaca

SEQ ID NO: 57581 - DNA, 438 bp, Zea mays
  Clone ID: LIB3069-037-Q1-K1-H10
gttccccaggaagttctggcctgaagggaaaggaagggagttcttcctctacgccagcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaagtgctgcggaagatgttccccggcaaggacgtcccggacgccaccgacatccttgtcccgagatggtggtccgacaggttctacaagggcaccttcttcaactggccagttggcgtcaaccgctacgaatacgaccagcttagggcaccggttgggagggtatacttcaccggtgagcacaccagcgagcactacaatggctatgtccatggagcctatctttcagggtatcggac

SEQ ID NO: 57582 - DNA, 407 bp, Zea mays
  Clone ID: LIB3069-037-Q1-K1-H11
cccacgcgtccgcccacgcgttcgcggaagagagcggaagcctcggttgtgggatgtcggacgagggcactccccttgtgatggtcgggaagaaggatccaaatgacccgtcgatcgaatcgagcaccaccaccacaaccaccacttctttgagcatgggcgatcagagcgtcgcgagtatggactcggatgggctgacgcctagcgccgtcttctcacagatcatgaaccccaaggggcggtgaggtaaagctggtcccattcgttaccttgcattcattcagcatgtttttttcacgagttcgtgctgttacggttctctcgaattaagaaccagacgttcgagaattgtttcatactagatattctgccttgccctgtacttcttccccagtattgcaacgact

SEQ ID NO: 57583 - DNA, 422 bp, Zea mays
  Clone ID: LIB3069-037-Q1-K1-H12
gttacgcatgaagttatgggctgaagggataggacgggagtccttgctgtacgccatcgggaggagaggctactacggagagtggcaggagttcgagaagcagtaccctgacgccaatgtcctgctggtcaccgtgaccgacgaggagtctaggcgcatcgaacaacagtcggacgagcataccatggcgtagatcatgcaggtgctgcggaagatgttacccggcaaggacgtcccggacgccaccgacatccttgtcccgagatggtggtccgacaggttctacaagggcaccttctacaactggccagttggcgtctaccgctacgaatacgaccagcttagggcaccggttgtgagggtatacttgaccggtgagcacactagcgagcactacaatggctatgtccatggagcctatc

SEQ ID NO: 57584 - DNA, 401 bp, Zea mays
  Clone ID: LIB3069-037-Q1-K1-F8
ggactatcaaggtcgctgagcaccagctgttgagaagattagccggtgaggagccaaaggaggatgcctaggttgacccttgttttattcattcacccccgttttgccttcccgggatagatagcttcatcagacaacacagcctagctacacaatgtgcagacgacgcccaactaaaagctcaatctgacaacagagccacggctcccagagacgtcggcacgtcgcactagtcaagcagcgctaggatgttgtgcttaggcgcactcgctgaggggactgcaggccgtgacctagcaccgctgctgtcaggctcgaaccgcaggcctggcaagtccgtgctcaccctcgtgctctgcttactgatgacatacagcataaccaataagggaacagtagtc

SEQ ID NO: 57585 - DNA, 435 bp, Zea mays
  unsure at all n locations
  Clone ID: LIB3069-037-Q1-K1-E12
cccacgcgttcgaacccattggatgatgtggaccgtttgctggaagatggctcattggatgataatggggaatcttttctatcacaggatgacatgtatcctagggacaacttggggcgatgcatggatgctagtaaaggttttggtttttctgaggttgccaaagcacgtgcaggtgcagccaaagttgtctgttgccacttctcatctgatggtaagctgcttgctactggtggtcatgataaaaaggttactttgtggtgtacagattctctgaagcctaaatccttcctggaagagcactcgtatcttatcactgatgttagatttagcccaagcatgtcgcgccttgcaacatactacttcgacaaaactgtgcgggtttgggatgcagataacactgactattcactccgaactttcacgggnccattc

SEQ ID NO: 57586 - DNA, 406 bp, Zea mays
  Clone ID: LIB3069-037-Q1-K1-E3
cggacgcgtgggcggacgcgtgggcggacgcgtgggcggacgcgtgggtggacttctggttgcaggcgtgctggcggacgggttcatggcgcgtgacctgacgatcgcgaacacggcgggccccgacgcgcaccatgccgtggcgttccggtccacgggcgaccgcacggtgctggacggcgtggagctgctggggcaccaggacacgctgtacgcgcacgccatgcgccagttctacacccggtgccgcgtggcgggcaccgtcgacttcgtcttcggcaactccgccgcggtgctccacgacaccgtcctcgtcgtgctgccgcggcagctgcggccggagaagggcgagaacgacgccgtcacggcgcatggccgcaccgacccggcccagcccacggggatc

SEQ ID NO: 57587 - DNA, 429 bp, Zea mays
  Clone ID: LIB3069-037-Q1-K1-E4
gtggaatctgatgatgacgatgaggagtcagacgaggactcagaggaggagaagggcaagacctgtgaggagctggagcgtgaggcaagcaacgcggaccgtgagcacggtgcggagtcggacagcgaggaggagaggaggcgccgcaaggcaaagaccttcggcaagtcgcgtgcgccggagcgcagcagcttcaagggagcgccgccctccaagaagccaaagttcaggtgaatgctgccttcggcaattcgctcgtgccaaagtgcagcagcttcaagggagcaccaccttcaagaaggcagctctggttaatgggactccttgaagctttggcccccggagtagacgtgtctgtaggagtgtggtttgttatatctagattatctgcagtagcttagtccatctaaatgaaatgtgacagctgaa

SEQ ID NO: 57588 - DNA, 402 bp, Zea mays
  Clone ID: LIB3069-037-Q1-K1-E5
cccacgcgttcgcccacgcgtccgctgacgcgtgggggaggcagctctgcttcctagctacgatagggttggaatagagaatttcatccgtgcaaaatatgaggacaagagatgggtaccaaggaatggaacatcaaaatcttcgtccagtgttcgagatgagaagagccaagagtttccggctagtgctaataggagtggacatggtcatagatcttcatttgagcaaaaccgtgcttcgacagctcttccgagcaaagttgcacatgcagcttcaaggatatcctctcaggcatcacctcagcccccgaaggtagaaacaccagttccaaaggtggttttacctcctcagtcacagaaatcccccgccaaagttgatgcaacaccggctaaagttgagaa

SEQ ID NO: 57589 - DNA, 455 bp, Zea mays
  unsure at all n locations
  Clone ID: LIB3069-037-Q1-K1-E6
cagatcctttggtcgatggaactaggtataaactgcaagaaatacatggcatagggaactccatggaaggtgatgctaatgcaaatgatccatagaaagaatgtgttatttgcctctcggaaccaagggggatattattgtcctcccatgtaggtatatgtatgtgcagtgagtgcgccaaggtcctaaggtaccaaaccacttagtgcccctgcagccccatctacaggcagcctgttgagagtcgcctcgagatcaaagtgaacaacaaatctgaagattagtagctgacgccctaatcaccaccgctcccagagctgcggtgtagtcgtgatcaaattcaggtctgatgtattatatggctctaatttgcgagacttcaggccttccctcaaggttngntctctcatttgagcaacgtggaatgtaactgatancttttccttagcatatgt

SEQ ID NO: 57590 - DNA, 228 bp, Zea mays
  Clone ID: LIB3069-037-Q1-K1-E7
gaggcgactccaggttcgtgggcgatgctgcgcgcgggaggtaggcagctccttgccccggggctccggcggctcggtctgggcaccggcgccgtcggtgaggtgggcccggccgtcgcggcggcggggatgaaggcgtaccacgagcgggtggtggaccactacaacaacccgcggaacgtcggttccttcgacaaggaggaccccaacgtcggtactgggctggtc

SEQ ID NO: 57591 - DNA, 330 bp, Zea mays
  unsure at all n locations
  Clone ID: LIB3069-037-Q1-K1-E8
ataggaaaatcagccaggactttttattatccatggatgagagtgaaacgccgcgtcgcggtcgccgtcctggcgggcaaaacctcgcgcgaagcgcctctctctcactccgttcgtctcaccccaaattagcgagacctagaagaatcttgaaagtgatcgctccagcgcgtgccgccgtcgtcttctnctnctcttcctcatcctnctccacggaacagacgaggactggcctagccaagccacgccacgccaagagcgtatactgtacgtacatcgtttgccgagcatgtggcatagtactactatacgtatatatagaaaaaaaca

SEQ ID NO: 57592 - DNA, 387 bp, Zea mays
  Clone ID: LIB3069-037-Q1-K1-F10
cgcattggtcgtagtggtcgtttcggtaggaagggtgttgccatcaactgtgtgacccgcgacgactagcggatgctgttcgacattcagaaagtctacatcgtgttgattgaggagctgcctgccaacgtctctgaccttatgtgatcattttgaagaaaaacagaactaaatgaacggtggtggtgatgatctggttaggcttggttttgccgaaatattgttggggaggagtgataaggtcggtggggctgctatgttaaagtcgctgtctatggcaatatgcgatttttctttatgccatgtcatgggaaattatgtagctgcctacgccttgtgctgtcgtggtggttcattagcatgaatactaaagctctgctggctatg

SEQ ID NO: 57593 - DNA, 369 bp, Zea mays
  Clone ID: LIB3069-037-Q1-K1-F11
agattccataagcgcaatcatgtcaatactaatggtggtgtcatcaactgtgtgacctggggctaactgggaatgctgatcgacatttagaaattctacaacatgttgattgaggatctgcatgccaacttctatgaccttatgtgatcattttgaatataaacagaactaaaagaacggagctggggatcatcatctaaggattggtcttaccgatatattataggacatcagtgaaaatgttgtaattattgctatgtcaaattcgctgtcattatcaaaatgcgatttttatatatgctatgtcactgtaaagagtatatctgcttacaagttcaactgtcttgacatgtaattaatattaataca

SEQ ID NO: 57594 - DNA, 420 bp, Zea mays
  Clone ID: LIB3069-037-Q1-K1-F12
cccacgcgtccgccgacccccaaccatggatgaggcgctttttgtggagtcaaaggatgggaccatctgggttgcttctgcatttgctggttatcaggaagctgtgcaagacagggatcacaaattcttgacaaaagcagtggaagaagcatatcgaggagtcgattgcggtgacggaggtccatttggagcacatgtcgtctgtaatgacgaagtagtagtcagctgccataacatggttctgaagcacactgaccctactgcgcatgctgaagtaactgcaattagagaggcttgcaaaaagcttgggaaaattgagctctcatactgcgaaatttacgcgtcctgcgagccatgcccaatgtgctctggtgcagttcatctctcccgaatcaagaggctggtttatggggccaaggc

SEQ ID NO: 57595 - DNA, 455 bp, Zea mays
  Clone ID: LIB3069-037-Q1-K1-F2
ctcaagggacttcaacgacgggaccacccgttcagtgacgtataacacggaagctgacgtgagtcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcaaggggttggatcggagtcgctgtaaatgtggtgggcgatggtaacggcaaggtaagcaagaaggctgattactaagggttctttttctctc

SEQ ID NO: 57596 - DNA, 326 bp, Zea mays
  Clone ID: LIB3069-037-Q1-K1-F3
gtcacgcgtccgattaaagctcacatcatgttactgaaggcacttagttcactctatggagcagtttcagatgctacgtatgacgaaatttgtgcatatgatgatgagtgtgccatctgcaggggaccaatgggtcgagctaaaaagttggcatgcaaccatctatttcatatagcttgcttgccgtcatggttggatcaagggctaatggaaggttactactgtccaacttgtcggagaccggtcttattgtcatctgaaaggcaaagaaagtctacaactgctgaagtagcatatgctcatcgaattgccgaacaacttactat

SEQ ID NO: 57597 - DNA, 287 bp, Zea mays
  Clone ID: LIB3069-037-Q1-K1-F4
cccacgcgtccgcgacgcatgcattgaattctaaggaacgcactaaaaagactctatgggggagtttcataatctaaatatgatcaaaatcagagcctatgaagataagtgagccattcagaaaataacgaaaggctctctcaaagtcaccgctatgcatccgtatctttcatacaacttgcttgccattatgtgtacatcaattgactaatgatgaggctacttctgaccgacctgaactggaaaaaccttattgtcaccggactgacatccatggtctacaattc

SEQ ID NO: 57598 - DNA, 400 bp, Zea mays
  unsure at all n locations
  Clone ID: LIB3069-037-Q1-K1-F5
gcggagcaacaccacaccacccttggtccggcactagcactagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttncagacgcggggctcctacctcttcggccacttcagcatgcacatgaagctcgtcggcggcgactccgcgggcaccgtcacggccttctacctgtcgtcgcagaactcggagcacgacgagatcgacttcgagtt

SEQ ID NO: 57599 - DNA, 457 bp, Zea mays
  Clone ID: LIB3069-037-Q1-K1-F6
cggacgcgtgggcgtcggttcacttctccaggaaagggttcgtactcatggcgccgtcgcagccaaagtcgggcctcttcgttggcatcaacaagggtcatgtcgtcaccaagcgcgagctgcctccccgcccgtgccaccgcaaggggaaatcaacgaagagggtgtctatggtcaagggcctgatcagagaggttgctgggtttgctccttatgagaagcgtatcactgagcttctgaaagttggcaaggacaagcgtgccctgaagcttgctaagagaaagcttggaactcacaagagggcaaagaagaagagagaggagatggcgggcgtcctcaggaagatgaggtcggctggtacgcacactgacatgaagaaatagagagcatttcaagttcatggagcctgccagagattatgttccagtgtctgattttccatacatgtagaacctaa

SEQ ID NO: 57600 - DNA, 393 bp, Zea mays
  unsure at all n locations
  Clone ID: LIB3069-037-Q1-K1-F7
gctgctcccacctctagcccgacaggtgaagccgccgccgctgcagtgtccatagccaccgtacgagactgagatggggggttttgtcaagacccacaagagcaatgcgtacttcaagcgtttccaggtgaagttcaagagaaggcgcgctggcaagacagactacagggccaggataaggctgattaaccaagacaaatacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgnctactgcactggccttctgttggc

SEQ ID NO: 57601 - DNA, 430 bp, Zea mays
  Clone ID: LIB3069-037-Q1-K1-E11
cccacgcgttcgcccacgcgtccgcccacgcgtccgatgcactctctcatggtgactccgaaatttcacagccaaaacgcaagcagcaaaggagcactactcagactttgagagtggttggaggagaaattgattccaactgcagcccatcagttctagaagaaaaatgttcaaagaatgaacatgatgcagtcccagttggtttatgtgggaagggaccacaaaatccccaagcagagcattcagaggatatttcagtgtctgcatctgaaccgtcgaacggacctggtgttgtggactctgaggacaaggatgaagcagatgaggagtctgacgatgaaggcgaggacgaggaggaagagaagacgtcatcggcgaagaagctgtggcgtttcctcatcacatgatttatttatctttgtcgtacgat

SEQ ID NO: 57602 - DNA, 391 bp, Zea mays
  Clone ID: LIB3069-016-Q1-K1-H12
cccacgcgttcgcttgctgctatggaaggttctagactggctggtgcatcaaggatcatgggcgtggtcatcaacccagcagaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgacttcgaatgtgtccacgacggctggagtgtcgccgtgctggtgggtgtcccgctcaatgacgaccagttcaagacccaccccatgaacttcctcatcgagaagacactcaagggcacctttttcggaaactacaagccgcgcaccgaccttgccaacg

SEQ ID NO: 57603 - DNA, 431 bp, Zea mays
  unsure at all n locations
  Clone ID: LIB3069-016-Q1-K1-H2
ggaactttgggctgatttatgtgcttggaggaacggaagtaattggtgtagttctgcagtttctggtgttgtagataatctatttggtggcggtgttgtcggttccttcgtcggggaagcggtgtggtgaacgtgagggtagtccttttattacacttcgtccttggcatggtgaggagtcttcaccgctgtactactttcttaagttagcgactctgcatatgtagaagatgcggaagatggtgctcggtgagttgacgtatgttgagagtgggcatcggtggtttcgtttcgatggtcttgcagatgcggctactgtctagagtatcggttctgttgaggcttagaaggggctacccgacgtcgaaaagaaaatagcgatatcttaaagtgaatctgcanggaacgtactaaaggcgaagtagactatg

SEQ ID NO: 57604 - DNA, 436 bp, Zea mays
  Clone ID: LIB3069-016-Q1-K1-H3
ctttgggctgatttatgtgcttgtggatgtgcgggtagtggtattggtgcgccttcgttccggatggctggtttgaagtggcgtaataagtattccttattgtgtacttagaagtgttggcctctggtgacgacgctgtttactgaggtgtagggtcgaggatttgtttgatgctacgctgttgctaaattgaatggttaagactaagcaggatttggcgtaatgagttattgcccaaccttcagggcctccggagcgcccccccccctctctctgctgctgagctaaaaaaagaaaaaagaaaagaaacggctaaaatgtgtggatagcgagcccggatgctcgcgcaccctggcgattcgcgcccccccccctctcggagggtccccggcttgtacgcaacccagttgggcccgcgatccgcgatcccgcgagc

SEQ ID NO: 57605 - DNA, 389 bp, Zea mays
  unsure at all n locations
  Clone ID: LIB3069-016-Q1-K1-H4
gaacctttgggctgatttatgtgcttggtgtgagatcgtttagtagccgtcactataccccgagaaacgaacggcttaccggtagcgcgtcagtagccgtttagtagctgccgctcagcgccgagacgcgagtgttacaggtagcccgttcggcgcaacaaaaacgggcgcactagataatgcccaaactccgacgaaattgcgcaccgtattcgcggcacactgttaaatcccatctacctagtaccacattataggcgtaacgtcgaacgagcaaagcccggtgacaaaaaaaagaaaaaaaagggtggttgtctcagaggacttaagtccatgcatgtgcgtacgtgatgctacagtctcctcacagcgctattcanacctaacct

SEQ ID NO: 57606 - DNA, 436 bp, Zea mays
  Clone ID: LIB3069-016-Q1-K1-H5
ggtcggaacctttgggctgatttatgtgcttgtcctcctccgacgccatcttttcgctatcaggcaccgagatgtctggcggcactcctattagaccgactaatagaaatatcataacttttataaagaaaagctaggcgcctctaatcgtcgtcgataattagatttaagcgggcacttgggcgccgtaaggcgagtgcgaaacggtcatagataataagtcttccggcgaacccgattctgcgggtaccttattcgttttaagaggtccgttctagaccgaggccatacctgatactgacgttaacggaaccgcgattgctctagttaaagacaaggtcattgggaaggagtagaatactattacatgacttctgggcgggtcgctagaggtcgatacttagaagacggcgtaagaagtcgagtcgtacgttta

SEQ ID NO: 57607 - DNA, 452 bp, Zea mays
  unsure at all n locations
  Clone ID: LIB3069-016-Q1-K1-H6
tggctctggacctttgggctgatttatgtgcttgtggatgtgcgggtggatgtgcgggggagtatagagtcagtcagttagttagttagtagtgagtccgtctgttgtgtttgcgtcctccttctgttcttgccttgccttgccttgctttgtttgttgttgttgttgtacctagggacggagacgaagaagactgttcgtgttgcttctgctgttgttctggtggttattgcggtgtctgttgtggaggtcttggtcttgggttttattagtggtcttcttgttgctgtgtttgttgctggtgttgnttctggngttgatgctgttcttcctcctgttcatcatacctagcgagttggttgtggttggctgtttggaggttgaagaagagatgaagtgggagagagagcgatacggtcgtgtgtaccttgacgtgcgggtacgcccccccc

SEQ ID NO: 57608 - DNA, 441 bp, Zea mays
  Clone ID: LIB3069-016-Q1-K1-H7
tggctctggacctttgggctgatttatgtgcttggtgttggttacggtgtctgtccctgatgagcctgggtgttttcctactacttcgtgggagtaggagaagaagatgtgttccagggggtctgatgtgtagaaggttaatactgttctggttaaggttgctgtgtggacttcttgtatgctgtccggatttaagggtacggacaagacgtcttagctttttgatggtgatgctactactataaacgacggagtgattacttcggagtagacggacgccgataattagacagtaaagtcgacggcggagtcgctttgcagctaagatcacgaaactggggacggcattattggggcggcagctacggtaggggtctcctctgagtaggtcgagaagtcctcggagtgcggcacctattttaccagggcggtcgaaggtca

SEQ ID NO: 57609 - DNA, 455 bp, Zea mays
  unsure at all n locations
  Clone ID: LIB3069-016-Q1-K1-H8
ttggctctggacctttgggctgatttatgtgcttgtcccctaccgtcctagctatgtcgcggctccttaaggatattaatcttcggaagtcactggggttactggcatgagtgcagggagtgcgggaggccttacagaggtcacggcggcgggtgcgacgagcaccatggtaacggtggtggtgggcacggtcattgtaggctcttgttcgttacgcatctccttcatagggagagctgggaccaccactttcttcataaggatagttgggatcatttctttcatagggatggtagggatcatctcttcatctatagggatttctgggatcatcatgaaagtaggggcggttggggtcatctgttgntcatccacggcggcggcaggctaaggagggattgactggccctattgcactggacgttagaaaggcgtcatggcggaagttgtttttt

SEQ ID NO: 57610 - DNA, 435 bp, Zea mays
  Clone ID: LIB3069-016-Q1-K1-H9
ctagggttttgctgctctccgaccccgagctccgaaggccgcagcatcaggcgaggcccggctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtatgatcaggttctactgctgggataccgcatggcaagagaagtttggtggcctcagggatggatactatatccatggccagtgtgcgatcatcatgtttgatgtaacctcaaggcttacttacaagaatgttcctacgtggcatatggatctgagcagggtctgtgaaaacattccca

SEQ ID NO: 57611 - DNA, 423 bp, Zea mays
  Clone ID: LIB3069-017-Q1-K1-A1
cccacgcgtccgatcccccgctgtcacctctccttccatcgccacaggcggcccttctccggggaagccggcgggccgccgcctaccttacccctctcgccgtgctcctccgcaccgtcattccctagcattccccacgggcgagtggcggcttggtcgagatgggcgatgcggttgatgacatcatctgtgcaacggatgcggcggtcgccgtcgaggatgcggccagtgggaagcccgcaatgctctctagcttaggggggcacggtgaggaagagcatgaggagaaggacaatgacgacaagtcacgcgagagcgaggtgatcaacccgccagaagacgctggcggggaggccacctcacccctggaagggttgaagcctcgcctttccaaggggaatcaaagccatggacctaatgctg

SEQ ID NO: 57612 - DNA, 290 bp, Zea mays
  Clone ID: LIB3069-017-Q1-K1-A10
ccgtccgaatgcttcagggatattagttgctagtcttggtgtatgtgatgcagctcacgtgacggatgacaagtgggacgggtcgtctcgtgcatagaaagattcaggcgtttcgctgaaccagcactttccatgtccgctgaagtatttcacaggtagctccagggaaagtatgtggatgctgaaggaaacgtgtgaaagagtttccagtggtgttcttggatggcaaggtatgcatgaccgtccctgagcaagtcaattctacattggttggacggcaattgagcgaa

SEQ ID NO: 57613 - DNA, 399 bp, Zea mays
  Clone ID: LIB3069-017-Q1-K1-A11
ctagtcttccctcctgctggcggcgtgcttatggccggaggccgcgtcgacaagaggaggtgacgtttgcagcggggctgggttacgccctgatcgcgctgggccctgccttctccctcttctccggcgtcgacgacaggaagcccttcctcgtcctcaccctcctctgtagcaccttatttaggctcataagttagatagtcctgtctgcaatatggagaggatttcgtactataaagtcaggagctaggcgggcatatgtgattctgatccttacatgtgtcgcattgcaagaaagcactcgtattgtgtcttggatgctttacaagataatcgactagatgctagatgcttttgctgatagaatatgtaagccacgtcttagatcgactgacaaga

SEQ ID NO: 57614 - DNA, 339 bp, Zea mays
  Clone ID: LIB3069-017-Q1-K1-A12
acgcaagattatagaatgacatattgtcttgttttccatcaaggaagatgctcttgatgccgggcgagccttatgaacctagtggatcatgctacgtatgctctgagaccccacttgtcctggaggttaatactaacacaacatagctacgggaagacattgaaaaccttataaaaagcaaacttggaatgaacctccctttgataatggttggtgccacgctagttttggaaagatggcaggatcgataagactatcagacggtagattatgctttaaacctcgaaaaggtcttggctgaacttccagctgcaggtctaaatggtacaacacttacag

SEQ ID NO: 57615 - DNA, 343 bp, Zea mays
  Clone ID: LIB3069-017-Q1-K1-A2
acgcacacgcgctcaagaccgcattataaccaataattccaatctcacaatcgggcctagtacagggaaaacggtaaaccttctggtaccttacccctctcaacaagcttctagggaccgtgattacataacatgaaccaaaggctaatgacgtccatgaacgacaccggcgatgcacgatgaggacattaacattgcaactgatgcatgcatatgcaggaaatgatgccaacagccagaataccgaaatgctctttatatgaggtaggtcaagtgaagaagagcatgaggataacgacacagaaaacaagtccagagacaactaggcgatcaacccgacata

SEQ ID NO: 57616 - DNA, 241 bp, Zea mays
  Clone ID: LIB3069-017-Q1-K1-A3
ccaataggcatcggtttagcattaatttaaacgtctttgagaaaaatcatcgtagatgtgcgccatccgttttcatgagttgctaatataccagaaattgttccatgtcaaaagccttgagaagatttcccacggtgattttcatacgctttactatgccatgtaccttcaagtcagcacaatcaatcagggcccttaacttacacggtctcgcaggctcgcaactggtcatttgtgtacc

SEQ ID NO: 57617 - DNA, 430 bp, Zea mays
  Clone ID: LIB3069-016-Q1-K1-H11
cgaggacaggatcctcaccaccaacctgttttccgctgagctctccaagctcgccgccagggcgttcttggcacagaggatctcctctgtcaatgccatctccgctctctgcgaggcaaccggagccaatgtctctgaggtggcttacgccgtgggcaaggacacgagaattggccccaagttcctgaacgccagtgttgggttcggtggctcatgcttccagaaggacatcctgaacctggtgtacatctgcgagtgcaacggcctgcccgaggtggccaactactggaagcaggtgatcaagatcaacgactaccagaagagccggttcgtgaaccgcgtcgtggcctgcatgttcaacaccgtcgacggcaagaaagatcgccggtcctcggcttcgcctttcaagaaggacaccggttgacaccag

SEQ ID NO: 57618 - DNA, 386 bp, Zea mays
  Clone ID: LIB3069-016-Q1-K1-F8
tggctctggacctttgggctgatttatgtgcttgtttatgtgcttgtttagtctgtctgctttcactcgactaggctgagtattcagcagtgattcgtctgactactagcgcagagcgctggcaggcgctcgctctctccggcggtcggccgtaatggctacggtgatgctgctctgctgggcgtttccgtcgtcgtcgcgttcgggtgcgtcggcgcttcgtcttcctgtggtgggtagtccggattaggagtcggatactatgcggggtgatgggtggggtaaggcttccgataatgggtggtcgtcgatgtcgctgtcggattgtatgcttggtcttgggccttagctttggtatgagcattcgcctggtaagactgatacgt

SEQ ID NO: 57619 - DNA, 216 bp, Zea mays
  Clone ID: LIB3069-016-Q1-K1-F9
ccatactcgatctcatagatccctatggaattctttaaaaggccttgggcgatgaaagtcgtaagtacggcttgtagggagatctttcctatacttcgagatccaccctacaatatggggcctaaaagccaaaaaaataagcgattcatttttagcccttataaaatgataacggattcttgaacctattacacgctcatgtcacgtctaggtact

SEQ ID NO: 57620 - DNA, 430 bp, Zea mays
  unsure at all n locations
  Clone ID: LIB3069-016-Q1-K1-G1
ctttgggctgatttatgtgcttggagtgataaacaagggccttctgggttgcccatcgattattcgatgttcttagtctcacgagctggttcttaatgatttgtgtagtaaagtagttggcttctttgttgttgttgttgatacgggtgggggttgtgtgtaggcgaataaggtttataagagttgtcctgtgcttaaggtcctttgttatatgtataagactgataaggctaggagtgggaagctagagattagttattgtgttgtcgcaaagggggtttgtgttgnttgtacttagtagagtaaggtgacttgcgacaaaaaatgcgtcgtcccgtcgaaggagaagtgtctgctaatcggattcctaagtgtattatgtgctaccgcctctgccggttccctcctactaataaacgctggactatcc

SEQ ID NO: 57621 - DNA, 272 bp, Zea mays
  Clone ID: LIB3069-016-Q1-K1-G10
catagataagtcgtgttttgaagggttcttgtgaataagataaaggcttagatacatttggttgtatgaacgggttttttttaggtgtatctagtgtttggagaaccgcaacatgatgtctatgttgtacatgacctaagtgcatttctctaccaccagcactcttgcccaagcatggtagaccatttgtgtttaatgttcattacatgctaataaaagatactggtgggaaggttaaggttatggttttaggcacaccaaacaagagggag

SEQ ID NO: 57622 - DNA, 449 bp, Zea mays
  Clone ID: LIB3069-016-Q1-K1-G11
aggtggcgagagcgagagcgagagcaaagttctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggtgaggaaattaagaacaagaggcaattaagtcagtacctaaaggcacaccctggaggccctgctgtttcagagtttgattggggaactggtgataccccaaggcgttctgctcgtattagcgagaaagtcaaggtatttgatagcccagagggcgagaagatcccgaagcgcagcaggaactccagtggtaggaagggtaagcaggggaagaaagaaacccctgagaccgaagaagccaaa

SEQ ID NO: 57623 - DNA, 385 bp, Zea mays
  Clone ID: LIB3069-016-Q1-K1-G12
cccacgcgtccgcccacgcgtccggcatttagaaaagctggagcagtgaaaatcagtacgtggacattggcgcggcttaatgcagaggaagtctcaaaggcagccgcggaggcaaggaagaaatccaaaatcctgaaaccagttggaaaacatggcgccccagagaacagcagcaaaccagaccatttgcctagctacaagagacggctagacaggagaggtttccctgctgaactctctcttgacccacttgcaactctatccgcaagcggcaccgaaagcaactacagcgacgcagcaacagaaatctgtggcagtctagccccgttacagctcgaagcgagaagtgctttccaaccgagtactgcagcgtccacaagaaatg

SEQ ID NO: 57624 - DNA, 403 bp, Zea mays
  Clone ID: LIB3069-016-Q1-K1-G2
ctttgggctgatttatgtgcttgtggatgtgcgggcgaatactaagggctcgcctgattcgattcgctagatcgccgtcgatacgactaagggtaagatattagatgagacctgtaagattcctaacactaagaacgatcctattttcgaggaggaagaggagacttgtagggagaattagcgggttcctgagcaaggaggcgtcggactcaccgacgttcaagcccggcggcgctcatcatcacgctcatctcacgccgcttcaacggccgcaagcaccccgggagctatcccgtccgtgaacgctctgtgcaagatccacgcggctaacggctggccaccaatccaccattacgaaagtatcccgctcgtcgtttcaagaggcccagctttacccgtacca

SEQ ID NO: 57625 - DNA, 445 bp, Zea mays
  Clone ID: LIB3069-016-Q1-K1-G3
aacctttgggctgatttatgtgcttgtgtcatcttcacgtagaaaaggcctccaccctagcagaactcgaaatctagggtaaccggcgttatgagcacagaaaatcaaaggtgaaggctgagataacataaaaacgctaaaagtattctacgggagaggactccgaaatgccgaactctaaagagtcctagtaatcagagtagtagtcggagagcctatcgaaatacactagaattaggaagagttagtccacgtctgagctaaccctggagtcttaatggaaggagaagctgtcgtaggaggagaataaggcctcgtagaaggagtctgtggagaagtagaaagtttagtggaagtaagcgtaacggggttaaatttaatagtagattagcctgctccttctgcgtcctacgacaagggaagtcgttttaataataaacaaccc

SEQ ID NO: 57626 - DNA, 424 bp, Zea mays
  unsure at all n locations
  Clone ID: LIB3069-016-Q1-K1-G4
gaacctttgggctgatttatgtgcttgggtagtgggagtagtagccttgttctcggcctgattttattggtgatccttatattcatggtacttctcggaattttaagtatgctactcctacggcggatgatacgtttactagggatccttgtaattcggagagtaagggggcggtgccttttaagagttagttgacgtggtctcatcttagttcgcggaatgtggatgatcgggtgatgtagggtgggtgtgctaagatggatcggctttatgtttttcctcttgttcttcattgtgggcctaaggttgatgtccgtgctgttgctgtgggtggttggatttgtcgtggtgttattgctggtattgagggtattggtgtttttgctcttgctgntggtgttggggatcggcataattaggagtc

SEQ ID NO: 57627 - DNA, 192 bp, Zea mays
  Clone ID: LIB3069-016-Q1-K1-G5
aacctttggtctgatttatgtgcttgataagaatcaagacgtgcctttcccagacccaactagaaatacaggaaattagggccatggggtacataaaatcggacgtcgattacttgatttcacacacattacgaaagtcgtcatagatgcataactatgtactgcagaagttcaaatatatccactcagatt

SEQ ID NO: 57628 - DNA, 443 bp, Zea mays
  Clone ID: LIB3069-016-Q1-K1-G6
tggcctggaacctttgggctgatttatgtgcttgtggatgtgcgggaaagaaagcctcatacgcgtaaagtactcttcgtcgggtcttcagtcgtaccggattccacagttaggtaatctcccacgaagagacctctcacacggtcggctagtcggggtccgatttcttcataacgaagtctcgctccggaggcttaagagtggaatcagaaccagtatcataaaatagcgaagtcgcggttaacgttcccagtcgtctaactcacactctggtaacatatccctcggcgcatcgtctcgtctagccgatgcttagcgagaaggaagaaaccgaatagataccgaagagcctccacaccatctgcccggactgtctaaaaggcggactacgcttaatcgcctcgcatgcacctgtactagattccttgaaaggagtatgcgcg

SEQ ID NO: 57629 - DNA, 405 bp, Zea mays
  Clone ID: LIB3069-016-Q1-K1-G7
tggtctggacctttgggctgatttatgtgcttgtttatgtgcttggaacaactctcctcctattctatcaatattagtcagtaatctccctcgcttcgtaacaacggttgtctgtcttcttcttctttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggggcgtgtctgtctaatagttgtgtgctgctggtggtggattggtaggttattcgtaatcgttctaagagtacgatgggttggtctggtggtggtgctagtac

SEQ ID NO: 57630 - DNA, 444 bp, Zea mays
  Clone ID: LIB3069-016-Q1-K1-G8
tggcctggaacctttgggctgatttatgtgcttgtttatgtgcttgtttatgtgcttctttatctgcttggatttatgtgcttgtagaagcacgattcccttaattcccggggcggctagcgtaaatttcgacattgcgcccgaagcggcttctgactccgacaaatacaagtgacacgagcgggacacgccgatagtcgacccggagccggcggaaagaaccgacggacatcatgacgcggcccacggaattcacgaatttaaacacccaaaccggcggaaacttaacaaggaccccgcccctctctgataacggccctgcggataagacggagtacacattaccccgtagatcttcgtcggctacaataaaagattcttaaagtacggtcatgagtgaataaagactaatttactaatacgggaaacaaggatcccgcacat

SEQ ID NO: 57631 - DNA, 333 bp, Zea mays
  Clone ID: LIB3069-016-Q1-K1-G9
cccacgcgtccgcggacgcgtggggcagttagcggagggtgcccaactcgtcggacccgcggcacaaccgctgaagcgcctgccattcgtgctgcttccacggttccacctctgctgttagttatacataccgtacctctggtcgcatgctttttggctgcacaatgtggcttggtattcagacttcagagaatttaattgcgtatacgagagtaaatgtagctgattttggtctagctggtttgccgtttcgagcgcttgtaaacacaaattcgtcggcagtttacaccgggccgtgtgtatataaatttcctgaagtctgtgtcttcgctc

SEQ ID NO: 57632 - DNA, 435 bp, Zea mays
  Clone ID: LIB3069-016-Q1-K1-H1
tttgggctgatttatgtgcttgtttatgtgcttgttagattattgtcccttctcatgagcatgctgtcaaaggaagtacttcggatacttcgcgcagttaggaggaccctttgtcggactcatgtacgaggactgtgactaagattgtggaagtgccgtagcattcgtacctgctggaaatcggtgctattggatatggtagtgctctggtgcttattacatcttctgataataattctgcattgaagtctattgagcctctgaggctacgcatgtcgcctaagaagagtgagatcatcctcgccgccggcgtcggagcgacgactatcggtagttcctcagagaaagtctcgaatgatgatttgctttgtcatggtctggcgccgacgaattcggagagtgatgcgcataggcctggtggtgcttcgacggtgt

SEQ ID NO: 57633 - DNA, 323 bp, Zea mays
  Clone ID: LIB3069-016-Q1-K1-H10
gcccggtgaatccacctcgcccgcagcgttgtcggcgagcagcacccccgtagacgcctggggggagccgatcccgacttggtcggtgctgatggcggcgtcgaagcacatcgcggtccggtgccgcccggagaacgttgccttcctcaactgcaagaagaaggaccctaaccccgagaagtgcctcgagaagggccgccaggtcacacgctgcgtcctcagcctgttgaaagaacttcaccaaaagtgtcccaaggaaatggatgaatatgctggttgcatgtattactacaccaacgaattcgacttctgccgtaaggagc

SEQ ID NO: 57634 - DNA, 427 bp, Zea mays
  Clone ID: LIB3069-016-Q1-K1-F7
tggctctggacctttgggctgatttatgtgcttgccgctgcgttcataagagtagggcgggttcagctccacggaatactcttattcgtccatcgtcaaagtcccgttcacaaaaccgcaatgttataaatatcccataaggtcctcttccggcgaatcattatattcgggaaacgtcccaccctccccgcattgcggagcggtccgtactcacgccacacatcggcgttacagcaacccctagaagtatagcgaagagcccccaccacccctacccccgccgcatctcgatacgcgagtttcacaagcacggtaaccccggtatggccccgtagcagaaaaaaaaaaaatcgaaaaaaaaaaagggtggttgtctcagaggacttaagtccatgcatgtgcgtacgtgatgctacagtctcctcac

SEQ ID NO: 57635 - DNA, 439 bp, Zea mays
  Clone ID: LIB3069-016-Q1-K1-E3
gaacctttggtctgatttatgtgcttgtttatgtgcttgtttatgtgcttgtttatcctgcttgggtacgtaaaaacggattcggggtgaccgatcggcataaagggtcgtagttcccagcgagctacgtcagaataaagggcctcataagggccaaatcctatagggaaccggtcgtaccgtcggaagaggagtccctctgtaggggaatcctagcgccattagtgggcgaataacccgggaaacggaaaggatcgtaagaaagtatcgactgcgagacagcgcggttattaacggccaccgccacgaacattcctccggaaaaagacgaagacgacaagcggaagggtacgggaaattaagagtcttccgaccaccccggagaacacgaagtaagcaaagtatgctacgttcacggctttctcgggtattgcggcac

SEQ ID NO: 57636 - DNA, 435 bp, Zea mays
  Clone ID: LIB3069-016-Q1-K1-E4
gaacctttgggctgatttatgtgcttggggagtcatcagagaaggcctagaagattcatcattcggctagttctgccgataatgatcgatgcttagggggattcgcccgtcgttcctaagactcgaccacgtctctacggctcgcaccgccgcacggccggatttaataacacctccgtacttttgatcataggctcgactgttacgaaagtcctcgcctacccgagtctgggggagcttgtcagctccaccccctccgaccctctccggtccctcggaattacatgaactaacaagaaacgagtcgcgcctatcccttaaaaaaaaaaaaaaagaaaaaaagaaaaatacaataaatacaaaaaaaaaaaaaaagggtggttgtctcagaggacttaagtccatgcatgtgcgtacgtgatgctacagtctcct

SEQ ID NO: 57637 - DNA, 375 bp, Zea mays
  Clone ID: LIB3069-016-Q1-K1-E5
tggctctggaacctttgggctgatttatgtgcttgtggatgtgcgggtcccggagagtcaggtaccccgtcgggcgtcgcttacggcacggcggaggtctcgcccaggaggcatatagaataaggaacggacgaagagctggttcataaaaatatcgctgagggtacaatcgggactactctgaaaattactctaaagaaagggacgtccgaagcgcataatctcccgagtgaggaaggtaaaaaggagcctaataaggtccacagtgtactgccccatttacgtacggacacatctcatgaacgtcacgaagacgcggttctcggaagcgaaacttggagtgcggcgccggtcgggtggatgccccacgagaaa

SEQ ID NO: 57638 - DNA, 440 bp, Zea mays
  Clone ID: LIB3069-016-Q1-K1-E6
tggctctggacctttgggctgatttatgtgcttgagaaagggcttgaactgaacttgcggcgcatcgttttccttctttttataagttgttggtgttgttgcgaggatcttggtgaacggtgctttgtgctgttctgggttcttcttgttgttgtgttggtgttatatcaggttcttcaaggagccacgtatacgctagaagtcataatagctaatccctagtcccggccctcgtcatactcgaacgtctaaactcgttgagaagacgtcaccatccattcaactttctcttacattaagcccggagcaggctacccgtcctagataatggagataagcccgaggtcgccgcgtttcctacgggcgaactcgcaatcgacggaatctccgtcaatcctccaaagaaattcggagatagagctgaggtcgacgaattcaca

SEQ ID NO: 57639 - DNA, 418 bp, Zea mays
  Clone ID: LIB3069-016-Q1-K1-E7
tggctctggaacctttgggctgatttatgtgcttgtacagagacaagcggcggagaccggattactctcggtaattgcccggacccatacgacttcagaacaccggtaacggtcgtcgtctaatattgcccatccgaagatgagcatgacgaacacatcgtaataaataacaatgtcgtcgcgccccgttgtctcacaccctcgaccccgacggtttcctcgtcttcgaggtacataccgattaccatcaatagcgacgacgaagacgacgtactcgtcacccctctgtcaccctccccgagagttgtcggacccccgtcgttacgtcacaccacggtccgggtcaccagcactacgtagtgctaaagataaagataggaagaagtaacgtcgccattaatggaagcggtgactacct

SEQ ID NO: 57640 - DNA, 432 bp, Zea mays
  Clone ID: LIB3069-016-Q1-K1-E8
tggcctggacctttgggctgatttatgtgcttgtttatgtgcttgtaagggtcggcccaacgccctagtaataagccagcgtaagacccggcaaacgttcctccgaatccagtggaaataacgttactaccgccacggacgacgcagacacttagtcagtcgcgtgactcgctccgcctgtcgtcgccggcatagtaggataatgtcgtattatacgctgcaggtcgacctcctacgagaatacacactaaattccttccgactagtccgccgaggcacataaataagcttgaaccggggacttgccggagaaaggtattccatcgggattatcgtatatcttcgtcctaaaagagaatcccccgaaaggtacctagatcactaaactctagggagggaaaacttcccccggaggactcgttaccgaactag

SEQ ID NO: 57641 - DNA, 441 bp, Zea mays
  Clone ID: LIB3069-016-Q1-K1-E9
atcactgttctccttcctcctctccgcttttttgccgccggccctgcgcccccgccccggctccccgccacgccgaccgcgccctgcgcctctacacctcaaatctgctttgtagcataagctcgctgcttgttagggtcgatggcagagagggagcatcgaacagtatttgtcacggtggggaccacgtgctttgatgcccttgtcatggccgtagattctccggaagtgaagaaggctttactgcaaaaaggttacagtaatcttctcattcaaatgggccgaggaacatatgttccatccaaggtcagtacgcttgtacctctgtagtaaactaacaactatttaattcctgtctactagtttgcattatgacaatctgtactctttcttatagggatgttcgtaactggtgatttaagtcatcctaaatgaaaaggc

SEQ ID NO: 57642 - DNA, 441 bp, Zea mays
  Clone ID: LIB3069-016-Q1-K1-F1
tggaacctttgggctgatttatgtgcttgtagaaggaatgggaaacggagtgagtaaaccacaggtccgtcgcctagagagtcataagagaagtatacgaaagggtacctgttgaggcctgagtcaaggtcgaaagaacagtaccagaaaggactattctagtatgctaaagagtacttgtagaagtttatgagaaagaagagaaggtaattgtctaagtagtctcggagtaggtcctaagggaagtcagaacgaaagtagaatgcgtagttgccgagagagtaatcgtcgaagtctgggagagggtaaccgaaaaggtaaaagtcgtcgtagacgtaaaggagtgaaccgggaagcctaggcttctccctaaggacagccccaaagtattcaactaggataactaatacgaggtactactctagaagatggtccacaaca

SEQ ID NO: 57643 - DNA, 162 bp, Zea mays
  Clone ID: LIB3069-016-Q1-K1-F10
cccacacatccgaaaaaaaaaaaaaaaatttaaaaaaaaaaaaaaaaaaaaaaaaaaaaaagaaaaaaaaaaaaaaaaaaaaggaaaaaaaaaaaaaacaaaaaaaaaaaaaaaaaaaaaaaaaaaaacaacaaacacaaaataaataaaaaatcagcaccc

SEQ ID NO: 57644 - DNA, 452 bp, Zea mays
  Clone ID: LIB3069-016-Q1-K1-F11
cccacgcgtccgcactcttgaagatgcaattgggttatttgtcaagggtgatgtagataggcattcagtttatgccactgcacttccttcgtcgcatcctagtttttctcttcaacaagtccttgagatgtcagaaaagtggaggtctcggccactaccaaaaggccccgtttcccttttcattggaatactgtctgcatcaaatcatttcgctgagcgcatggctgtgaggaaaacatggatgcaggctccagaaattaagtcttttgaagccgtggctcgattctttgttgcactgaattcaaggaaagaggtcaatgtaatgttgaagaaagaagcagaatacttcggagacattgtcattttgccatttatagaccgctatgagctgggtgttcttaagacaattgctatctgtgagtatggggtccagaacttgactgctgcaaaca

SEQ ID NO: 57645 - DNA, 439 bp, Zea mays
  Clone ID: LIB3069-016-Q1-K1-F2
gaacctttgggctgatttatgtgcttggccctctctctgctgtgtaatactagagcctaagtgaggaatttagcttagctttgggaacggagcgtgcaccgggtgcggccggttgtgatcctgtgtcggcggtggttgatatccttgttgcgtagagcacctctgcttataagattgatgaggataaggcgacggcgtctgatctgtaaaagtcgacgggtgtcctaggggagttcggcgactgggcgtaacccatggagcctacatagaagaattcatattcgcattagccttggaatattactttgtctctaattgttgttgttgttaatcctatatgtggtgaatctgttatagtttcctgtaagaacttacacacggctaacaccacctccggcggccacgacaaggacgccggcgtcctttctcatcatactga

SEQ ID NO: 57646 - DNA, 434 bp, Zea mays
  Clone ID: LIB3069-016-Q1-K1-F3
aacctttgggctgatttatgtgcttgtggatgtgcgggcctgttgttgctgttcgcctctcgccgttgctgttacggggagaagggtcgtgagacgtcactgttagactaagaataagttacattttaagcttaggcatcgttgcggcgctttcgattttaagactaggactcatgacgccggtacgaagagaaagggcgccgacgagccttttcatcgcgcgtattccgctctccgggagaaggagaacgctcttagcgaggtctccgaggtcgtttgcaccgttcgtaataagcatacgattaagctcgtaggaaaggacgttccttattcctgggcttgggcctattttccttacgcttcctgcactaataagacgtccctgcgcgtcggggtcgacaggtcttagatcggaacgaagggcgttcccggta

SEQ ID NO: 57647 - DNA, 443 bp, Zea mays
  unsure at all n locations
  Clone ID: LIB3069-016-Q1-K1-F4
gaacctttgggctgatttatgtgcttgtggatgtgcgggtcagtataagtacagcgcaggggtccggtattcaagcaaggttcgagagttacggtacttaaggttgggtctcctccggtctctaattcttcgcctcctatggcggttaatgttcgtggtagtcgtttgattttaatgtttttggctgagttattgatgctgttcttcgtcgtcattttatttttcctgcttagtggtaagcgtttgtcgaatgtgtctaagcctggtgcgcgtgttgacgcgtctggttctgctaaaggtgaggccggtaaggcgttcgttgagttgcgtcgcatttctactaaaggttccgtggatcctgaagttgttgctcgttctcgtatggntactaaggttaatgcgtctggtgctgctactgacgcttttactaagtctagtgtttt

SEQ ID NO: 57648 - DNA, 446 bp, Zea mays
  Clone ID: LIB3069-016-Q1-K1-F5
tggctctggaacctttgggctgatttatgtgcttgagagaaacggtcatttaaggacgagcgggaattcacaaactttccatcggccggacccgggtaaatcactcgcatcttatcgaggtttaaacgtgacaagcgcggtactaataattcccgtttcctcgtccccaaggaactactaagtttaaccttaaagtaaaagaaaataaggctcttacagaatctcgatcgcgatccgctcggtattgatgcgagacaacaccccgggccgcttgctggcggcaaacaccacgcggcccttccccggctagccaccgccggactattccggcgttgcattaccggtacccggtaagctacgcacactaccccgcacattggcaaaccgcctaagatggcacgaagatatgtccactcattagccatcgcaaaaagcatcggcaaaaa

SEQ ID NO: 57649 - DNA, 441 bp, Zea mays
  Clone ID: LIB3069-016-Q1-K1-F6
tggcctggaacctttgggctgatttatgtgcttgcgcaatcggaagtgaggctctggcgttgccgtttctcgttctgcatgcttctggtgtcgtgggagtgcgtaccgccgagtgagcgtggttaagtaatgtgggtctgaggagacgacgtcgagtgggtatggtggtgggaggtgttcgcctatggtgctgtagcggtaggagtctgagtattaggtgtctactcctaagcatacggttctgggtgtgtttgcgttgtatgattctgcttcattgtcttgttctgttattggtgctgatattgtgtttctttctgttcctttgttgtagttcctgttgctgtcggtgcatcggggtcgtcatggtgtgggggtgttgcctggttgtaaggtggtggaggatatggagttggcgtggcgttggtggatggatggtaagaa

SEQ ID NO: 57650 - DNA, 442 bp, Zea mays
  Clone ID: LIB3069-016-Q1-K1-E2
tttgggctgatttatgtgcttgtttatgtgcatgagtctatgcgggtggatctgtgcggccatagacgttctgagcaaaccgggttaggatttacagagtaacggttattttaacgccccgaacaaaaaaagaaatcttaatctgacctacagacctctatctagaatcgtcgtatgctgtagcgtaagtgcgccgtcggtcctgtttagtcctcccccccgttcgcgacccgtatgatacccacacccaccgaaactccgtagaactgtccgatgacgaacaaaaaaaaaaaaaaaaaaacaaaaaaaaaaaaagggtggttgtctcagaggacttaagtccatgcatgtgcgtacgtcatgctacagtctcctcacagcgctattcaaacctaacctatcggttgctgccccataatgcctgcgatcgggaaaatttttt

SEQ ID NO: 57651 - DNA, 323 bp, Zea mays
  Clone ID: LIB3069-037-Q1-K1-C8
cctactcctgcgatatgctacaggcttttttgtcttgctgcttatctgcctattgtgagggccgtacttattaggatctgggcctgcaagaaccggcacaactgcaacagctgtgatcgcttgcagctgactcatcgcattaaacggccacagagatgtttatataatggaactggcctcatactaattcatcgagctgaatgtatgtctccatagtcttgcacccaacttcgaactcattagctctttattgttgcagaacagttgctgtcagactgctatactgtgatgatatgatccattctttgtggacacagagatta

SEQ ID NO: 57652 - DNA, 422 bp, Zea mays
  unsure at all n locations
  Clone ID: LIB3069-037-Q1-K1-C9
cggcaagcgcaggggggccgcgggcgatttggtggccgcagtcgaggtctcgcaggtcgtcggcgtccggacgaggtccaggtccgcggcggcgaccggcggcggtgtcgcgaaggtcgctccgccgaggaggaagaaggcgctgctgcccgccgcgaacgagacggcgtcgggggagcctggtgccgtgggcggtggtggtggggacggcggaagctgctgctacatccacctgcggagccgcatgctgttcatggcagcacctcagcagcaaccgtcggcggctccgacacccgcggaggctgctggtgcggcacagcagggcggngtggtggcgctcgcggctggcctctcgcgttgctccagcacggcgtcgtcggtggacgtcgggggccagcagcccgcgagcgggagccacgcct

SEQ ID NO: 57653 - DNA, 429 bp, Zea mays
  unsure at all n locations
  Clone ID: LIB3069-037-Q1-K1-D1
tcgcggacgcgtggggtggcaaatgcagtttcagccagtttttccgttcatagcagcacagtgagaggattgagatggcttggcaactcacgtcttgtttcattcacatataatcaggttaatgantaaactggtggatacaataataaacttgttattacatgcttaagaagtgggctaaatcgctcattccgtgtgctccaaaagcctgaacgtgcaccgattagagcattgagggcttcttcatctggacggtaccttctaattctgtttcgcgatgctcctgttgaagtgtgggctatgacaaagaaccccatgatggtccttggcgctttcttttacagtattagaatggacactgtcagctgcaccttcgccaggtcaaaatgcatcatctaaacagtcttcaacctccaaggagcgatcagc

SEQ ID NO: 57654 - DNA, 455 bp, Zea mays
  Clone ID: LIB3069-037-Q1-K1-D10
ccctttcgacccacgcgttcgcccacgcgtccgcccacgcgttcgcggactcgtgggctctattttgaattttgatgatagggctttaattgaaattgcggatatgttgaacataagtcttgggagtaataaagaagaaattaaatcaaatcttaagtctatcaaagaaatggagaaagataggcaaaataataaggtctcggaacctgaatctaaattgaaaagattggaacaggatagagataaacttttagaaaatgaatgtgaaggagatggaggagatgattcaaagtttgttagaaagtgggtctgagaaagaagttgaggaaccattggacaaagaaaaaatggtcagaaaagagaaaaaagtttctcttagaaaaaaaggaaaaattattcccccaaaataggtgtaaaccaaataaagggaggaaacataaacaaaaaaatatcag

SEQ ID NO: 57655 - DNA, 100 bp, Zea mays
  Clone ID: LIB3069-037-Q1-K1-D11
cccacgcgtccgcggacgcgtgggcaatgatccacagcatcgttgatatatataatatagagagaaaattctctgcacggtcaatgcagttttatccggt

SEQ ID NO: 57656 - DNA, 434 bp, Zea mays
  Clone ID: LIB3069-037-Q1-K1-D12
gttatgctccccagccgccagaatagtatccagccgccaggaagcatggccgacggcgcggttctcatcctttctctgtttctgttcttgcactgccaggccgtgccctttcccactggtgatggcgagtagctcaactggcccttaccgccaacgagtgcgtccccatgtgagggtgcgcggtcgtcggtcggtggccggtgagagctcggctagcccaaaaaaaaacaaaaatatgtcggccatcggcttttgaaccttgcccgacgaccaaaaccggccgcctctcctctctgttcatgctctttctaatctctgtttctaagttccagaccgctcacccaagaaccggtcgccacgagcttgggccgaccgagctatccttttctccctgctccttttggccgttcgccccttctccttctttgattctg

SEQ ID NO: 57657 - DNA, 371 bp, Zea mays
  Clone ID: LIB3069-037-Q1-K1-D2
actggttcctgactatgcaatgtcattcatcaagggcaaatcactcaagccgtttgggcggcctgtggtgggacgagacagttcctacagttgtaaccagagcagagcctcacaaccaggttataattcatccgactcaagcaagggtcctcactatccgggagaacgcaaggttacagggcttccccgattactaccgattgtttggcccgatcaaggagaagtacattcaagttgggaacgcagtggctgtccctgttgcccgagcactgggctactgtctggggcaagcctacctgggtgaatctgaggggagtgaccctctgtaccagctgcctccaagtttcacctctgttggaggacgcactgcg

SEQ ID NO: 57658 - DNA, 413 bp, Zea mays
  Clone ID: LIB3069-037-Q1-K1-D3
gtcgaacctccactgagcacaatgttccctggtatcgctgatcggatgagcaaggagatgacttcccttgcaccaagcagcatgaagatcaaggtcgtcgcgccacctgagcggaagtacagtgtctggataggagggtcgatcctagcctcgctcagcactttccaacagatgtggatatcaaaggaggagtacgatgagtctggcccggcaattgttcacaggaagtgcttctaggtttctgccaagttcgtcaagtgcttttagggtttgccatgttcatcatcgctacctagtcttaagttatgcccccttcatttgctgagatatgtgtggcagatttgcatcgttttggtatttcgtggctccatgtgtgagcatgctgtgtcctataacctggtttatgagatgag

SEQ ID NO: 57659 - DNA, 380 bp, Zea mays
  Clone ID: LIB3069-037-Q1-K1-D4
cccacgcgtccgcccacgcgtccgacacattccaccggcaccaacccagcgcggcgccaccggcgacccgtacccccttccccggagagcgatggcgacggagctgacggcggcgcagctgcgcgcgtacgacggcaccgacccgtccaagcccatctacgtctccgtccggggcaaggtctacgacgtcaccttcggccgcggcttctacggccccggcggcgcctacgccgtcttcgcgggccgcgaggccagccgcgccctcggcaagatgtccaaggacgaggccgacgtcttcggggacctctccgggctcaccgacaaggagctcggcgtcctcgccgactgggagaccaagttccaggccaagtaccccgtcg

SEQ ID NO: 57660 - DNA, 284 bp, Zea mays
  Clone ID: LIB3069-037-Q1-K1-D6
ctagttctagatcgctacggacgcctttttttttcttctatttttcaccttttaacgccgttttttttaattgtttcatcttcatttattttttctttattttcagaaacccccattaaacccccaactccaaatctcctttcaaaaaaccttttgaaaattctaatccaacttccagtactaggcttttaaacattaccaatacattcccaaaaaaaaaaccaaacaaaaccccagccggatatatacacgctctactgattaacatatccttttccaggcca

SEQ ID NO: 57661 - DNA, 173 bp, Zea mays
  Clone ID: LIB3069-037-Q1-K1-D7
ccactcgtccgcgcaacggccgcctttttttagatccgtgtaatcacccgcttaggtggggatttttgccacagtggaggctatattttcgacactttttattgcaaaacgctatcgaaactcaaacgtcaaatcagcggtgtgaaaaccttttgaaaatgaagatccagcag

SEQ ID NO: 57662 - DNA, 442 bp, Zea mays
  unsure at all n locations
  Clone ID: LIB3069-037-Q1-K1-D8
ctccgctgggccaccagctttgaccgccgtctcccttcccctccgctactgctcctgcggaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaagacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggagggatgggcggtggaggatcccatgttgatccatttgacatnctctcatcat

SEQ ID NO: 57663 - DNA, 438 bp, Zea mays
  Clone ID: LIB3069-037-Q1-K1-D9
ctccactcgtcctcccactcgtccgcccactcgtccgcccactcgttcgcggacgcgtggggggactcggggaagctcgcttatccgagcgcatctgctaagtcgtttgctcttcatggttatctgaaggttttttatttcaccttgaatattgactactgacattaccattacctttttgttgggactaaagtttagtatattcgtcttattgtttagtccttatctgtataattattttatttttatattatatgtaatacttctaaatatcattcaaatatttgatgttctaaatatcattcaaatatttgatgtgaaaaccataatttttttatattttcataaaaaaaattttttttataaatctaaaatgaaaaatctcttttatttttcaaattaaaatatttatttttttttgaaaaaatatttattatt

SEQ ID NO: 57664 - DNA, 336 bp, Zea mays
  unsure at all n locations
  Clone ID: LIB3069-037-Q1-K1-E1
gaactacggccgcgtggcgaacaaacctgcccaacccagcggcggttgtccactggtcaggcagcagggcgtctcgcaggtgaagctgttcgacgccgaccccaccgtgctgggcgccctcgcgaacaccggcatcaaggtggtggtggcgctgcccaacgagcatgtcgcggcggctgcgtcgcgcgcgttctacgcgctgctgtgggtgcgccggaacgtggcggcgtaccacccggtcacgcagatccagggcatcgncgtgggcaacgaggtgttcgcgtcngccaagaacgtgacggcgcagctggtccccgccatggccaacgtgcacgc

SEQ ID NO: 57665 - DNA, 412 bp, Zea mays
  Clone ID: LIB3069-037-Q1-K1-C5
gggatgcacatggccgaaagatgtcaaaatcacttggtaacgttgttgaccctcttgaggtgataaatggcatgtcactggatggtcttctgaaacgtttggaagaaggcaatctggatccaaatgaattaaacattgcaagagatgggaagacgaaggattttcctgatggcatagcagaatgtggtaccgatgcgctccgcttcgcactgatatcgtacacctcccagtctgacaggataaatcttgatatcaagagggtggttggatatagacaatggtgcaacaaattatggaatgccattcgttttgcgatgggcaaactgggtgatgattacattccgtcggcaactgttgatgtgtctcttatgccaccaatatgcaagtggatactctcagtgcttaacaaggg

SEQ ID NO: 57666 - DNA, 438 bp, Zea mays
  Clone ID: LIB3069-037-Q1-K1-E10
cggacgcgtgggcggacgcgtgggcggactcgtgggctgtcgcgtgggtgacacaccagggtcctctggtcagtgcatactcatcattcgtgagtatggctggtgttggctatgatttggatcaccagcgaaggaggatggaccctgggacaaatgagccattgttcacaaattgcacaagggattttaccggtaccctagattacatattttacacagcggattcattgactgtagagtcattattggagctgttggatgaggatagcttgagaaaagacacggctcttccttctcctgaatggtcatcggatcatatagcgctcctagcagaattccggtgcaagcttagagttagacgatgatactttaggaggagctgtaggggagggattcttgacaatcgcatgagatgatgagaatggtaccctggccgaa

SEQ ID NO: 57667 - DNA, 455 bp, Zea mays
  unsure at all n locations
  Clone ID: LIB3069-037-Q1-K1-B10
attcctacttggaaccacgcgctccggcaacacctgcggatgcagcggatctggcggtggaggaagcggtggcggaagcggatctggcggcggacctaccagcggtccttgcagcgtggactcgctgaagctcgccctgtacgccaacttgctcaacaggctgatcaacgcgaccatgaagacgacgctcaggacgccgtgctgcacgctgatccanacgctgacgcacctgcaggcggacctgtacctctgcaccggcctcagggccaacgtcctgggcatcaacctgaacctgaccatcaacctgagcactatcgtcaactactgcggcaagcacttccgctcgggcttccagtgcttctgactatgacactcacattgatcgatcgatctgcaggctaaacaatatgttcaagctagtatacgtacgtggatacatacatgatgtaatatta

SEQ ID NO: 57668 - DNA, 438 bp, Zea mays
  Clone ID: LIB3069-037-Q1-K1-B11
cgcaagagccttatcttattctttctggctggcattgatccagtacactgatgcggctactgcttcagctgctagagaatccttagatggaaggagcatcccaagttacttgcttccggagcatgtaacatcctgctgcctgcgaatttctttttctgcacataaggatttgaacatcaagtttcagtcgaaccgcagcagtggaaatttgcgcatgttacattcagtaagccagaatacctccaagattcagatattgtaatgaacagattccatagacctgtttatggaggttgggaacaacaccttggattggagcatacaaccactaccccaaaaaggtcctacttaggcaacaaccagaaccgccattcttttgagaaacctgtgaggatttacaactaaagctgggaatactttttacatgtgatgaaatga

SEQ ID NO: 57669 - DNA, 60 bp, Zea mays
  Clone ID: LIB3069-037-Q1-K1-B12
aattcctactggtaccactcctccgaaaaaaaaaaaaattaaaaaaaaaaattttttaac

SEQ ID NO: 57670 - DNA, 410 bp, Zea mays
  unsure at all n locations
  Clone ID: LIB3069-037-Q1-K1-B2
cccttatcgccctcgttatttacatcgctgccaccctcctctccgccgtcgccgccgccgtcggggatggggggagcgcaattncccggcgacaacgacgtcgcggaagtagacgcggaccgcgacggataggtggaccgccgtgacgtgggcaagatgaagcacgggtgcgagcattaccggcggaggtgcaagatcgtggcaccgtgctgcaaccaggtgttcccctgccgtcactgtcacaacgaggctacggcttccggagatcggcatacaatatgtcgtcaggatgttgaaaaagtagtttgcctactctgtgaaacaaaacagccagtgtcacaagtgtgcataagctgtggagtcaatatgggagagtacttttgtgatatatgcaaaatttatgatgatga

SEQ ID NO: 57671 - DNA, 439 bp, Zea mays
  unsure at all n locations
  Clone ID: LIB3069-037-Q1-K1-B3
cccacgcgtccgcggacgcgtggggaaattgatgatgcgtgatctgaaagttcatcctgcgtggaagctgcttcattcgccagatcagcccatctgtaactttaccggatcaaggtctccagaatagaagaagggaaaataacttgcttctttgtatgagctgatttgagcacaataaggctttgcttcgtacttgagtgattcaggtgttactagtcctactgttaagatgaattgtagccagagacacctatttttacctcaggaagggatcttttgagcaggtagatgctactacagctagacgcacttgcaaagcttcctaaatatggtcatctagtgttaacagagacttatggtgctgtgagcaatatngaaaattggttgcaatctaattgcttacaatatgatttagatagcgtaagtttctgaagatgat

SEQ ID NO: 57672 - DNA, 222 bp, Zea mays
  Clone ID: LIB3069-037-Q1-K1-B4
gtcattgctcgcgtgacgcgtcggctacttcatcaggcgtcccatcatagggcattacggagggtagatgcgttatgctacagatcatgtaaattcgacctgatcgcaactagagtacctactatatacaatgtgaacctacctagactgtttagatcatctgacatagagcaccactagcttatggatcagacttctatgagtcaggagttactcttgcta

SEQ ID NO: 57673 - DNA, 361 bp, Zea mays
  unsure at all n locations
  Clone ID: LIB3069-037-Q1-K1-B5
aaacgaaagagcccgtgtgaaccggagaggtgaggaaaagaggaaaagggagacataaattggaggccattatcaagaaaccatgagttctaagttcgcaatccctaatcctgatctcacttaagcgctcgtgagctctctccagtggctaaagattgcagatttgagttatagtccaagaaacgggtggtggtccgccatggaagtgaagtccgagcaagggctgatggcggggaaggatctattcggtatgccaaagagcccgccggcgccggtttccgggccgtcggcgtncgccgtcatgcagagcgtgcgcatggcgtacacctcggacggcaccgctgtgttcgctccgatgagc

SEQ ID NO: 57674 - DNA, 380 bp, Zea mays
  Clone ID: LIB3069-037-Q1-K1-B6
gaagcagaatcctgcttacaaaggcaagtggcatgcacctatgattgacaaccccaactgcaagggaatctggaagcctcaggagatacccaaccctgagtactttgagcttgacaggcctgattttgatccaatcgctgctattgggattgagatctggacaatgcatgatggcatcctgttcgacaatatcttgattactgatgatgagaaagttgccaccttcattctcgagaagacctgaaagcccaagtatgatgttgagaaggaaaaggagaacgctgaagaggctgctgctggtgcagatggtctctctgacttgcagaagaagatttttgacgtgctgtacaagattgctagatattcgttcttggcaccct

SEQ ID NO: 57675 - DNA, 202 bp, Zea mays
  Clone ID: LIB3069-037-Q1-K1-B7
gacgcgctggcttctcttcaccctcctgttccttgtacggatcatgaggtactccgaggtccggttaccgggtcacccgatcgagactcaatcctgagatgttgaataccgatgcttctgacgctgactcaattgctccaatggcgaccaatagctccacaacgcctgcatcacctactgataggtacatgcatgcaatatc

SEQ ID NO: 57676 - DNA, 296 bp, Zea mays
  Clone ID: LIB3069-037-Q1-K1-B8
ccagcctccagcgccttcaccctgctcgtcgcctcactccctctgaggtcgcagatacggccggttagacgaagccgcccgcacgcatggcctccggtgagctcgcctgcacctacgccgtcctgatgctcagcgacgacggcatgggcatgaccgccgagaagatcgtcaccatcgtgaaggcgggcaacatcaagctcgagtactactggccggcactcttcgataagctcctggagaagcgcagcgtcgaggatctaatcctctccgatggatctggtggtggcgctgctgca

SEQ ID NO: 57677 - DNA, 323 bp, Zea mays
  Clone ID: LIB3069-037-Q1-K1-B9
gaccccctcacttcattccctatgttcgccgccactccctgacatcgagaccggctgcgccgaccccggtccggcgatccctctgcacccctttctttgcgctgccagccccaatctctcgcatacctgtcaaccatggcggcgtcagcaggcggaggcgcggtgcgcgcgctgtcccagaaggagcaggacatacagatgatgctcgcggccaacgtccacctcggcaccaagaactgcgatttccacatggaccggaatgtctttaagcgtggcaccaacggcatctacatcatcaacctgggcaggacatgggataagct

SEQ ID NO: 57678 - DNA, 404 bp, Zea mays
  Clone ID: LIB3069-037-Q1-K1-C1
cccacgcgtccgaatataatggatcttactttggagattcatggctgggtagagtccttgcaagatgctttgacacagttcactgctcctgaagatttagatggtgataatatgtataaatgtggaaggtgttctgcctatgttaaagctaggaagcaactgatcgtgcatgaggtgccaaacattttaacagttgttcttaaaagatttcagtcacgaaaatatggctagatcaacaaatgtgttactttccctgatatgttggacatggttgccttcgtgactgggtctggtgacaatcccactctctatttctagtacgccgtggttgtacatgtcgatacagacaatgcatcattctctgggcactatatatcatacgtcatagatatgcacggtacatg

SEQ ID NO: 57679 - DNA, 471 bp, Zea mays
  Clone ID: LIB3069-037-Q1-K1-C10
gtcccgaattcccttggcgaaccacttcctccgcgttggttgccaggacggcgtgacgaatgtgacatgtggcgctgtccatggagatggggacgccggttgccaagatgtcgccgcgaaattggcagcagaagccatgggatcagatcgaaacccaaggtagccgataccagatgtaatggtcgctagatcggtgagggattggagaggggtatcgatgggcaggaacaccggccgggggcctctgcccacggccgagcaagaggagggtttgtcccttctaattcttgcctactttatttctcatccattgattacataaataggctagctagccgtccctatctaactagagatccttatctgcttaaaactctcctaaaaactctcaacaactactatctgataaccttcctagataatctcaactaatctcctagataatctcaactaatcttctaatcttaatct

SEQ ID NO: 57680 - DNA, 426 bp, Zea mays
  Clone ID: LIB3069-037-Q1-K1-C11
ggttcccccttcacgtttgctactactttggaacaggagtacaagagtgatatctttggagagcgaggcatcttgctgggtgctgtccatggtatcgtggaggctctgtttaggaggtacacagaacaaggaatggatgaagagtcggcctacaaaaacactgtcgagggcataactgggatcatctcgaaaaccatctcaaagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggccttccagcttttccgatgggcaacatcgaccaaactcgc

SEQ ID NO: 57681 - DNA, 296 bp, Zea mays
  Clone ID: LIB3069-037-Q1-K1-C12
gcttgctactgaacagggaatctataacgctacgtaaaggtcgttcactggacgaggaattactacatagtgactgtaaaaaatcagtcgttaccgaattaaagtgatcatcaggacatccatctttaagaaggcgacggttgatggaagatgcacatgagagacgaacgctctaacaggtgcacaatctgtatgaccaatgggacgcacccatacacggttgttctatatgaatggtataacagggtacgctctgggagatcgattctgatatcagcgctctatagcccgctgct

SEQ ID NO: 57682 - DNA, 325 bp, Zea mays
  Clone ID: LIB3069-037-Q1-K1-C2
tccgctcgttcgaatataatggatcttacttagtagattcatggctgcgtagagtcctcgcgggattctttgacacagttcactgctcctgaagatttagatggtgataatatgtataaatgtggaatgtgttctgcctattttaaagctcggaagcaactgttcgtgcatgacgtgccaaacattttaacagtcactcttaaaagatttcagtcacgaaaatattgcaagatcaacaaatgtcgtactttccctgatatgttggacatagttcccttcgagactgggtatggtgacaattcgactatctatttctagtactccg

SEQ ID NO: 57683 - DNA, 380 bp, Zea mays
  Clone ID: LIB3069-037-Q1-K1-B1
cccacgcgtccggttgcaggctgggctccccgagggtgttctgaacgtggtgtccggcttcggcccgacggccggcgcagcgctctccagccacatgggtgtcgacaagcttgcgttcacgggatcgacgggcacggggcagatcgtgctcgagctggcggcgaggagcaaccttaagccggtgacgctggagctcggtggcaagtcccctttcatcgtcatggacgacgccgacgtcgaccaggccgtcgagctcgcgcaccaggcggtcttcttcaaccagggccaatgctgctgcgccgggtcgcggacgttcgtgcacgagcgcgtgtacgacgagttcgtggagaagtccaggcgcgcgccctgaagcgcgtcgt

SEQ ID NO: 57684 - DNA, 384 bp, Zea mays
  Clone ID: LIB3069-037-Q1-K1-C3
tcggttgactggtcgtagattgttgtacgaccttttttggtacaatgacgattacatcttgtacgattacttcttggagaaagaaaagttacacaaattcagttttgctcaatctaggtttaatttcataacttctcgagttatggttcctgtttttaacgtttgggttttactaaactgcttctgatttaatatctttctggtctcactcttagtcttcgttcgacctttgcaaaattagatacaattttctgctcgttccacacaattttgctcctctcttggtggtttagatgtgagtttccttagatcaatacgtgtagcccaagcacattaaagtcaacatccatgttgcttggtcatacacaaaggttagtctttttt

SEQ ID NO: 57685 - DNA, 169 bp, Zea mays
  unsure at all n locations
  Clone ID: LIB3069-037-Q1-K1-C4
tccacgcgtccggcttcttgctgcaggtttcatctgctcggggagttcgataaggtgaagcggagctgcaggaagcgcctcgatggacacaaccgtcgncgtcggaagccgcagccggaccctctaaaccccgccggcttgtttggcaatcaccacggagtgacaagat

SEQ ID NO: 57686 - DNA, 132 bp, Zea mays
  Clone ID: LIB3069-036-Q1-K1-H2
attcgctggtttccacaaaataagattgtcaatatctactacgtacttatgctattctgcatgtgatgtacgagtgtgcatcttcaagaatctttaagttgaatggtcccataataatattgataacaatgt

SEQ ID NO: 57687 - DNA, 280 bp, Zea mays
  Clone ID: LIB3069-036-Q1-K1-H3
cccacgcgtccgcccacgcgtccgaaatataaatataaaaaaaaaaaaaaaaaaaaaaaagaaaaaaaaaaaaaaaaaaaaaaaaaaaaaaaaaaaaaaaaaaaaaaaagaaaaaaaaaaaaaaaaaaaaaaaaaggaaaaaaaaaaaaaaaagggggggcgtttttaaaggtcaaaattttggatacggttttataaaataaagatggaaaaaacgtgcccttaaataaaataacaggggcgcagtatatacacctttggacaggtgaaaaccttgggg

SEQ ID NO: 57688 - DNA, 79 bp, Zea mays
  Clone ID: LIB3069-036-Q1-K1-H4
cccacgcgtccggccatgagtccgagcgttaagtttggctggccgcttaggaactgctgggcaggttctacgggcgggc

SEQ ID NO: 57689 - DNA, 328 bp, Zea mays
  Clone ID: LIB3069-036-Q1-K1-H5
cccacgcgtccggaagactgtagatactgtgttcgataaagatagtactaacctgcatgaagatgacaagagaaacactgagagttcagaagcggaaggacaagtcaacagtggagatagtaatacagaagctaataataataagaatgaagatgaaaccaccagtcttgtagaaggacgcaagcatgatactgaatccaactctgctgctgagagtaaaagtgaagtcaattcaactggagatgaattgtcccaaaacaatcatgcacaagaggaaaacactagggaggcaagtggaatgtctcatgatgaaatagcgcatggtgac

SEQ ID NO: 57690 - DNA, 448 bp, Zea mays
  unsure at all n locations
  Clone ID: LIB3069-036-Q1-K1-H6
gtagagatgatgctcaaaggcaatttattttagaacttggtgtaccagaagaatggatgcatgaagctctggctctttatcacgaatactatggagataaacagggcgcactggagaatttgattcagtgtggcaactggaagaaggctcatactattttcgtgacttctgttgctcattctatgtttctgtcatctaaccatcaggaggtctggaggatcacaagtgccttggagaaccacaagtatgaaattgctgactgggaccttggtgccggaatatacatagacttctacattctgaagaactcaatgcaagaaagaaatgccatggatgattcggattcactcgaggagatgagtgaatcatgcagaagtttctttggccgactaaacgaatcgntgttagtctggggaagcaaattacctgttgagtcaagggcatgcta

SEQ ID NO: 57691 - DNA, 302 bp, Zea mays
  unsure at all n locations
  Clone ID: LIB3069-036-Q1-K1-H7
cacttgttccctcgcgtccatggccttgttccagcctactcttctcactcctcccccgctctgctgctgctcgcatggcctcctctacccagggttcctgaaactgcctcccaaattctcaaatggggcctgctgttccacggcgagggcgtcggaccggagcgagctggcgggtaaaagcgggggcttggcttggagagcggcggggagaaaggggcggctgcttggcgtcaccggagctgggcgaagccccttctttggcggccgcnggaggcgtatggacaagggcactagccgggtcg

SEQ ID NO: 57692 - DNA, 325 bp, Zea mays
  Clone ID: LIB3069-036-Q1-K1-H8
atcagaatgataatttgcacaagtcatctttgctacatactgggctgattgatactgatccaagtgtgaacttgcacgacaatggtggcctctctgtgtcttcgtctcaaaatccagttgtggactgtgtttctaggagagaggatccccttcgtgattggggcaatatcgcctgcagtgaaggaataattggatgtgaccataccaccaccgataatgaacacataaagctagcacacaggctgcacgataatgttcaaatgaatgtacctgtcatagttgaagacgtgactgataatgtgccttcaggcattccatcatcgag

SEQ ID NO: 57693 - DNA, 322 bp, Zea mays
  Clone ID: LIB3069-037-Q1-K1-A1
cggcagaagactggctgctcgtcgtcgccggcggcaacaacgccggctgcagagctgatcgtgccgtcagcacagcagatctagcaattccaggtggtacaaaagggtttttcatcaacaagtggtcaccaaaagaagaactgaaacatcaagatggtgtttgcttctacgttttaccattgaggatatgatggtaaactgaagtcatgtattatgctatgcattcagaagatgatgctaaactgaataagcacattaatctgatttttctatgcattgagactatgtttgtattattgttatgcaatgcaatctatgcact

SEQ ID NO: 57694 - DNA, 470 bp, Zea mays
  unsure at all n locations
  Clone ID: LIB3069-037-Q1-K1-A10
aggttttgaattaccgtttcgacaccacgcctccggatccacttctgcccatacttcctccatttatatccatcgaagtgcggtgcttgtgtcacaattgaacctgtgtgttgtgcattcttcctaagagaagggggtaactattttaagcccaagtaaatgacacacaagtaaacatatatatataaacttcttttgctacacaccttctcttatttccaatttctttagcttcctcccncagcatgtggctctccacgccgctattcttaccacgttttcttctatatttgataagattggcctgcttcttactgttatcaccaggttcgagaaaggagaggaccttacctgaggaactggatatatcttgaaagatttgctgaacaagcttctcctgcctactacagggatcaagtgttggtacgataaggtcatataggcccttcatgagagccctttggtggttc

SEQ ID NO: 57695 - DNA, 445 bp, Zea mays
  Clone ID: LIB3069-037-Q1-K1-A11
ccgccgattggcacgatttgcgcagcacattctagttattccaaatatgatgagcagcaatgaagacaacccggatataaaggatctgcagaatgcagaaactttgcgcaagttcgtcgatcctcggagcatcgagacacagacaaacccgatcgaccggtctatcgctctgctacttttccaccagtcatcggaccatgcggctgtggctgtcgacgatgcctcatcacttaaaccccctgctggtagcaaacaacaccagggccctgctgctaaccaaaaccaaggcctgatgcctgattcatcggtgtattcccctggagatggggcccccaaggatgtacagtccctggacaagttctgaatttatgtccctgctctccatgacctagttaagggcatgttcggttccccgggaatgggcatgttcggttcccccggggaa

SEQ ID NO: 57696 - DNA, 452 bp, Zea mays
  Clone ID: LIB3069-037-Q1-K1-A12
aattcctactgggaaccatcctccgcggacgcgtgggctgacgcgtgggccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaggcaagtggtcatttcgaagaagccgaggagagggaacctggaatcaagaaaaccttcagctctcctgtgtaggaggaaag

SEQ ID NO: 57697 - DNA, 392 bp, Zea mays
  Clone ID: LIB3069-037-Q1-K1-A2
cggacgcgtgggcggacgcgtgggctttaaggagaaacctatgtttacgtttgcaaacaaggcagggctggacatgttagaaacatctcttgttgccctgcaagacctgacgctagacaagatcttcgacgagtcaagaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgaccccatttttttttgtatggaaaatca

SEQ ID NO: 57698 - DNA, 120 bp, Zea mays
  Clone ID: LIB3069-037-Q1-K1-A3
aagaaaaatactggctgataatagacattttcttaaacaactcctgactgcagagctgcgcgtgccgtctgcacatctgatctagctatttcagttggtacaaaaagggggcgctcgtca

SEQ ID NO: 57699 - DNA, 361 bp, Zea mays
  unsure at all n locations
  Clone ID: LIB3069-037-Q1-K1-A4
tcggccaagggcaaccttgtcacctacaaggttcctaccatggtcgcctgcacgctcaacgcggtggccattctcctcaaggaggggctccaatgggactggttcatcaatctcagtgcgtcagattatccgctcatgacacaagatgacatacttcatgtcttctcttctttgccaagaaatcttaattatatagagcactttcngttatctggatggaaaggtaatataagggcaaaaccaattgttctggacccagggctctatctgtccaagaaatttgatcttactatgactactgagcggagagaattgccaacatctttcaaattatatactgggtctgcttggataatgctta

SEQ ID NO: 57700 - DNA, 384 bp, Zea mays
  Clone ID: LIB3069-037-Q1-K1-A5
cggacatcgtgagaaactcatacaaaacagatcttgcaaggcaaattttactcagtttcattgtgaagtcggtgcacgacagtttaggtccctcccgggctgaaccagagaggaagccaagtggatcagatgaagctagtaatgaacagaccagcgtcttaggcaagaacgcttctggtcgcaaagatccggataaacaagagaaagcggcggaggctactaagggcctgaaggatacagagggattcactgtcgtttcaaaacgccgaaggcgttcccagccgttcatgaaccccataaatggcctatattctcagccgtctatttgcacctctgtcagttaaggtcattgcgttttcgaagacctgcaatattttgcgagat

SEQ ID NO: 57701 - DNA, 283 bp, Zea mays
  Clone ID: LIB3069-037-Q1-K1-A6
ggctttggaggaggaatcggccacgacattggtggaagctatggaaagggaggtgggcttggcagacgcatcggccatggcatgggccgtggctaccgcaaacgtggagggatcgaccatggcatcagcggtggctatggaaaaagccgcagccttggtggtggatatggcaaaggtggcggactccgaggcgacattagccatggcatgggtggacgccatggcaaaggtggtcgaattgagcatgacacgggtggaagattcggcagaggccgcagtcgtc

SEQ ID NO: 57702 - DNA, 284 bp, Zea mays
  Clone ID: LIB3069-037-Q1-K1-A7
gactttggaggaggaatcggccacgtacattggtggaggctatggaaagggaggtgggcgtggcagacgcatcggccatggcatgggccgtggctaccgcaaacgtggagggattgaccatggcatcagcggtggctatggaaaacgcagaggccttggtggtggatatggcaaaggtggcggactccgaggcgacattggccatggcatgggtggacgccatggcaaaagtggtcgaattgggcatgacatgggtggaagattcggcagaggccgcagtcgtc

SEQ ID NO: 57703 - DNA, 230 bp, Zea mays
  Clone ID: LIB3069-036-Q1-K1-H12
tacgcgtacggaagggcgtagtcgaggaggtggtttggtgtatggcgggttgtgaggagctgctgacggtgctcttcagactccaccgatggcgatcaagaacatgacggcggcggcgacgacgcggtcgctggacgcggacatgacggtggacgagttcaaggagtggctgcggcggttcgacacggaccatgactggcgcatcattcgccacgagctgcagagcgccc

SEQ ID NO: 57704 - DNA, 326 bp, Zea mays
  Clone ID: LIB3069-037-Q1-K1-A8
cccacgcgtccgcggacgcgtgggctgcatatcaggtggttcctctataggatacaccatgtgtggagtctgcaacaaggttctagtctcaacttgcacatatggtggctcttgcgagttgtgacatgatcgtctgacatcaaagcgtgaaagacgttaataaatctgttcaggagaagcagtcatctagcgtggcaagcttggaattgacaatgagtgatgtggacactggtagatctagtagcaaggtcaaaggatgatttcttttaccaagtatgcttgcattcgtgaagcaaatcaatgatacattatttagagcgtgattg

SEQ ID NO: 57705 - DNA, 434 bp, Zea mays
  Clone ID: LIB3069-037-Q1-K1-A9
cgcgtccgtatggttgttacctttggtcctagtggccttactactgaggtgaagtctgttgaaatgcaccatgaggctctccaggaggcccttcctggtgacaatgttggcttcaatgttaagaatgttgctgtgaaggatctgaagcgtgggtatgtggcctccaactccaaggatgaccctgccaaggaggctgctagcttcacgtcccaggtcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagaccttttctga

SEQ ID NO: 57706 - DNA, 418 bp, Zea mays
  unsure at all n locations
  Clone ID: LIB3069-016-Q1-K1-D1
aacctttgggctgatttatgtgcttggcgaaggagtcgatggagtggactaaagcctcggacgaggagactggtgttctcgttgaggattcggattcttcaaatattccgaaagtcctcctgcttagtggtagtaatgagacgacggcgaggaatcttattaagcctgatgctgagaggtggngtaatgggagtatgaggactgagactcgtcgcgttatanattttgaggcgtcgccgcttatggcaagtgtgtcggaggcgtcgggttcggagactgagtagcgtgcggcgagtcgtcctagtgatcccggtacgtangttctccgtctataagaggaggaggaggatggcaacaacaagaggtaagcctcaagtattgatgagacaaaataggttccgccctggagcgtcggtca

SEQ ID NO: 57707 - DNA, 434 bp, Zea mays
  Clone ID: LIB3069-016-Q1-K1-D10
gcctcgtaacacccatcctcctgaaactgtcgctattgaaatgaacaatgatgctggaaggggtcagacaccacaacaattgcggttgccacggacaaaggatgttattgtaaatggggtcattgtgaaggtcaagtactgtgacacctgcatgctgtacagaccacctcgatgctcacactgctctatctgtaataactgtgtggagcgctttgaccaccactgcccttgggttggccaatgcataggattgcgcaattatcggttcttctatatgtttgtattctctacaacattactgtgcctttatgtatttggtttctgctgggtgtacattatcaagattagagacgcagaacagtcgtcgatctggaaagcaatgttgaagacttcagcataaatggttctgatcatatactgctgcatctgtgtgt

SEQ ID NO: 57708 - DNA, 447 bp, Zea mays
  Clone ID: LIB3069-016-Q1-K1-D11
cccacgcgtccgagcgaacagagcactgttgcagagcgagcgagctgtccggccaaaccgtcacggccgcctccacaatgcgcgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcagcagcgggcggatgggtggcgtggggcctgaacccgacgggcgagggcatggccggcgcgcaagcgctggtggcgctggcggaggccggggccgcggcgcccgccgtgcggacgtacaacatcacggggtacgtcccgctgggcaaggcctacacg

SEQ ID NO: 57709 - DNA, 441 bp, Zea mays
  Clone ID: LIB3069-016-Q1-K1-D12
gccctcctcgcgacgcagtgcgaccacgcttccaccttcacctgggaaccgcgaccgctggatgaagaggggatcagatttgctcatcgcgacctaccttgggggttcattttgtgttgttgggttggatggggagaagtgtcgagcacatggtgcttgcagtttggtttgtttgtgttgatgatttctctgtggggcgttgcagggaagatgggggtcgaggagaggcaggcgcagaagagctccttagaggagcattccaagaacctcatcggcgatgccatgatgctggactcccgcgctgtcaatctcgacaaggggccaccctgtcgctctggacaagggggctgccctaaggtcctgtttttgctttcttcagatgaaggaacatctatcctggagcttgttgctggaataggttgtttcactggagaactcgct

SEQ ID NO: 57710 - DNA, 434 bp, Zea mays
  Clone ID: LIB3069-016-Q1-K1-D2
ctttgggctgatttatgtgcttggagtattcacaatcttaacagccccgttacccgcctatctcggccctgaaaaggctacgtgagaaaatctgcctcccggatggtgattattggctttatctcgtagcaagaagacagacactaccgccggagagttaacagagcccgattcgttaagtccgaagtaagaagtactaatggcattttacgatctacttctcgaatggaaggggcggttggttaccatattggacgggtcggatgaggttgtttagagacggtcccattagaagacgctagataaggcttagctcgcgacggagagatcgtggaaaatagccattaattccaagtagtgccgactcctactcactaggtaacattccgccgaatcgtcgaccaggacctcccaattagtccgagccggcggac

SEQ ID NO: 57711 - DNA, 435 bp, Zea mays
  Clone ID: LIB3069-016-Q1-K1-D3
ggaactttgggctgatttatgtgcttgtatagtcagtcagtacatagatgaacaaccctcctcctattctatcaatattagtcagtagtctcgctctcttcgtaacaacggttgtctgtcttcttcttctttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggggcgtgtctgtctaatagttgtgtgctgctagtggtagattggtaggttattcgtaatcgttctaagagtacgatgggttggtctggtggtcgtgctagtacggttaatgttgataatacttttggta

SEQ ID NO: 57712 - DNA, 192 bp, Zea mays
  Clone ID: LIB3069-016-Q1-K1-D4
tgatttatgtgcttgtatatgtgcttgcatacccggtatacccgcacaacccaaaaaaaacaatataagaaaaagggaaaggctctaaccgaaaaaacgaaaagtatgacatcaacctcgttagttgtaaaaaagacacaaacgacgccgattcagtagagacctaatcgttgactctgaagtaagatgtac

SEQ ID NO: 57713 - DNA, 424 bp, Zea mays
  Clone ID: LIB3069-016-Q1-K1-D5
tggctctggaacctttgggctgatttatgtgcttgtttatgtgcttgtttatgtgcttgcttatctgcttgtggatgtgcgggtggagtaatgttgttgttgttactcctagttcacttgtgtcggatggtaataaggtgaggactggtgagtctggtgtgacgaggttgtcggcggagtcttctgagtatggtagtatggtagtgaggaaagatgtggttctggttactcctaattcgcgtatgtcgtatgagaataagctgtgggttattaagagtggggttgctgatgcgatgtcgagggttgctgttcgtgttggggatggtctcggtcttggtctgtcggcggatgagctctcggttgcttctgtgtcgtcgctgggtgattatgaggtggcggaggaggctggtgagatgggtggtgc

SEQ ID NO: 57714 - DNA, 437 bp, Zea mays
  Clone ID: LIB3069-016-Q1-K1-D6
tggctctggaacctttgggctgatttatgtgcttgagtatccccagatcaggtagcccccagccccaggtattccgaaacgctcactctatctagctacagagggcccgaagtagttctcctgtacccgtaggggaagctccgttctcccacaacccttttgaattttatccaccagggcccgcctggccacccctacttacacggaccggaggggaccgacatggacccggagagaccccgatccatcagagaccgaaatttttctaacttggtctaacatacacggaccggggccgaattgaataagggagttcgcggcgtcgggctcgtttacccacgcccacaccgggtacacagaatcagagaagagcaaacgacgccctcacataagtatcgacactgagggaacgctcacccttccccctacatctttac

SEQ ID NO: 57715 - DNA, 267 bp, Zea mays
  Clone ID: LIB3069-016-Q1-K1-D7
gaacgaaggttggctgtcttactcgtcgttaaatgtaggctgatgtacaagtcgtggctatggtagccatctcgtcgtgctcggtcgtcgctatttacgatggccctagttgtagcgagtcgtactcagagaatgcctgatcgcagtatagacttcaaggcatctaacgggtactgtcgtacacgttcttgtggtgcgtctgtatagggagtgtctgtctaatagtctcgtgtacctacgtagacgaatggtacgctattcgtaatc

SEQ ID NO: 57716 - DNA, 441 bp, Zea mays
  Clone ID: LIB3069-016-Q1-K1-D8
tggctctggaacctttgggctgatttatgtgcttgagttctccatctacgacgaagtcccctccctaagggatacttattcctcttagtcccgtgtcggaacagacgagaaactcgcgggccttcttccttagtccgcgcccgtattaaccgacgagtaccctttagacgacgtcttaccgaccctcctcggtccctgcgctacattatccgacgcgaaaatagacggcgcacttctcggcaggatgtcagacccggtactcagctccgacgcgggtctcgtcgtattttaagttctaggggacgtactcttagacgatcgtaacccgagactcgcgtcgataactgttccctaacctttgcacgagacgtattcctaggatagtgccgtagtaacggtttgctaacacgcctgcagcgctaccctcgtcgcgtaaagagc

SEQ ID NO: 57717 - DNA, 444 bp, Zea mays
  unsure at all n locations
  Clone ID: LIB3069-016-Q1-K1-E1
aacctttgggctgatttatgtgcttgttatcgtttaagagtcgatggaggagaagctgtccgtccatctacgttctgagcaaacctgattatatttagagagtaaccgttattttaacgccccgaacaaaaaaagaaatcttaatctgacctacagacctctatctagaatcgtcgtatgctgtagcgtaggtgcgccgtcggtcctgtttagtcctcccccccgttcgcgacccgtatgatacccacacccaccgaaactccgtagaactgtccgatgacgaaaaaaaaaaaaaaaaaaaaaaaaaaaaaaaaaaaagggtggttgtctcagaggacttaagtccatgcatgtgcgtacgtgatgctacagtctcctcacagcgctattcaaacctaacctatcggttgctgccccataatgcngcgatcgggaaaatttttt

SEQ ID NO: 57718 - DNA, 385 bp, Zea mays
  Clone ID: LIB3069-016-Q1-K1-E10
cccacgcgtccgcccacgcgtccgcccactcgtccgcggacgcgtgggcaaatgcgtgggtttgagacaatgtacaatggtcacactggaagaaaactgactgcgatgattttcctgggccccacatattaccaaagactcaagcacatggtggatgacaagatacattcgagaggacgtggtcctgtgcagatactcacccggcaaccagcagaggggcggtctcgtgatggaggtctccgctttggagaaatggaaagggattgtatgatcgcacatggagcagctttcttcctgaaggaaaggctgtttgaccagagtgacgcatacagagtccatgtatgcgagaaatgtggtcttatcgcaattgcttaacctaaagaaa

SEQ ID NO: 57719 - DNA, 457 bp, Zea mays
  unsure at all n locations
  Clone ID: LIB3069-016-Q1-K1-E11
cccacgcgtccgcggacgcgtgggcgcctgttcgcagccggtgcctgctccttcccgatccgggaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacatggtcacagtggaagctgcagaggctactctcaagtacaacgtggctattaagtgtgcgaccattactccagatgaaactcgggttaaggagttcaatctgaaacacatgtggaagagcccaaatggcacaattaggaacattataaatggcactgtgttcagagagcctattatatgcanaaacgttccaaga

SEQ ID NO: 57720 - DNA, 253 bp, Zea mays
  Clone ID: LIB3069-016-Q1-K1-E12
cccacgcgtccggtgacgtgcgtgaggtgtttggagtcggacggaatcgaaaaggcgacgactcattgcctggagtttcctgggagcggaagcgaaggctgtgaagggagggaaaggcttgctcgccgcgaagactacggctgccaagtccgccgagaaggacaaggggaagaaggccccaatctcacgctcctcccgagccggcctccagttccctgttgggcgtatccaccgtcagctgaagcaaaggact

SEQ ID NO: 57721 - DNA, 433 bp, Zea mays
  Clone ID: LIB3069-016-Q1-K1-C8
tggtctggacctttgggctgatttatgtgcttgtttatgtgcttgttaagccgcagccgtctcttcttgagaatttctgttgttgttgtttattggagtcttggcccgtagcctcctgtcgaaggttacggattatgataggtttccatacggcgaccggcgacggcggcgaccgaattccgccatccgccagtaatcggtaccgaacctgttgagtatgctggtcaccctgtcggaggcgacgggttattagtcatacaccctataggacttaaatcttaagtattacgggattatggctcgggacgtactaacggcgcccgctaagcccccggaaaagaacagtagaaaaggctgtccccgcttgcttaaatcaaaaggaaagagagcgaccgaaccgggagtcggtcgtggctcactcgggcctggaacg

SEQ ID NO: 57722 - DNA, 438 bp, Zea mays
  Clone ID: LIB3069-016-Q1-K1-B3
aacctttgggctgatttatgtgcttggaggagacggacctctggctagcacctaccggaaacgccgatcacgtgcgtatcttagaagaagcgtagtagtatcctaacctccgcggaatcgctaatagagccataacttcgatcgataagcccgggtaattaaaaggccccgtccatgcggaacccgcggaagccgaagtcgcctaggaagtcactaagccgaatgagctagagccgtatggctgttaatctaaggcggtattgaagaggatcaatgccttcgggacgaagtaattttgtggctgaggccctaacttgcattacggttattttcatacgaggttgcacggccacagcttccacggccacgggagaccttttagaccttgttgtttgtgaagattccacccccgaagtctggcctttacccggtagaata

SEQ ID NO: 57723 - DNA, 434 bp, Zea mays
  Clone ID: LIB3069-016-Q1-K1-B4
ctttgggctgatttatgtgcttgtttatgtgcttgtttatgtgcttgtcctccctcgttctggtatttgggttcccgttccgcgaataaaagctgctgtgccttctccggtcgacgaaacttctcctctgctcagactcgagttcttgttcgctccctggactagacgtccggcttgactgaataatggcgagctccgtctcgccacccgaccgcctcaaatgtacggccccgcccccgcgacgacgcgtaggccttgactcgccctgcccgaccgacgagccgatgtactggtctgaaatgaggtcgtacggcccccgcgttcggaggccctcgaccagtgcgcccaaggaaatcgggcgttataacccgccgtcagaagcgtctgacttgctgaaccgacactcgttgagtcgtgatgccttgggggactcc

SEQ ID NO: 57724 - DNA, 406 bp, Zea mays
  Clone ID: LIB3069-016-Q1-K1-B5
gaacctttgggttgtctcagaggacttaagtccatgcatgtgcgtacgtgctgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgattgtcatatccgttagtgtttcagtgtttgtcttccctgtccctcctttccatccctctgttatgcctgttggtcccttttgctaagtctcaaaactggggt

SEQ ID NO: 57725 - DNA, 423 bp, Zea mays
  Clone ID: LIB3069-016-Q1-K1-B6
tggctctggaacctttgggctgatttatgtgcttgggcgagaataaagagtcgtgggctggggccccgacccgccggacgacactccgccgggccacaaagtcgaacgattaacggacaccggtaccataacagatatatcaaaaacacacgtcgaaagctagaaataaaacataacagagccgcgaagaaggcacccccgataatcacgtactgcattcactccggcggtgaaactaatcctatcgacggactcaccaatttaaaactcatagcgggaatcttcgtacataccgtctacgaggcctcctcggagaaggaacataacggaaaggccgtcgacgcgcggctacgtggagcgatgttacatgcgacgtcgatgactattactttcgagacaagaaattacttacggcctccgaag

SEQ ID NO: 57726 - DNA, 224 bp, Zea mays
  Clone ID: LIB3069-016-Q1-K1-B7
cggtcggcggtggcgggtactccattcctcggcggcgggcccggccgaaggtacgggtacccgccgggttcacgtcgcgagagtgtcgcgacgcgggcattaaacaacggagtctggtccacgtgcaaaaaaaaaaaagggcacaaacagaaaaaaaaaaaaagggggggtgtctcacaggggtttaatccctacatgtgcgcacacgatagcgcacactcccc

SEQ ID NO: 57727 - DNA, 290 bp, Zea mays
  Clone ID: LIB3069-016-Q1-K1-B8
ctttaggctgatttatgtgcttgtaagcaagtcgggactttatctccccagactcgtggataggcgtcaagctccggggatggacgtaccaccaagcgggaaggacgtagtaacgtggtcacagcttctacactcagtcgtcgtcgaccactacacaattcttcaccgttagacacataattcgatacggcttctcgcaagtcgaacgtcacgaatgtctagcccctcgacctttaagccacggactatttaaaacgtcacgaagaatcctcgaagcgaaatactgatac

SEQ ID NO: 57728 - DNA, 162 bp, Zea mays
  Clone ID: LIB3069-016-Q1-K1-B9
tattctagcgcgattcattacagaagccctcgctgaacaacaccctactgcatacaaccgcattgccactcataaaggatatagatcactatgaaatatataaaggctatgatgctataaactcagcatcttagaggtcatatatgatcctgatccttacat

SEQ ID NO: 57729 - DNA, 405 bp, Zea mays
  Clone ID: LIB3069-016-Q1-K1-C1
gaacctttgggctgatttatgtgcttgtttatgtgcttggaccgagtccgctttatctctcctacgccgaagaaactaaaggttcgcgcgtcttcttattacggggcgaggagtcgtttccgctagtacctcgtaggataagcgccagcgatcgggaggttcctaggagtactgatacggacgtcgaggtaagaccgacgtaatatacgaaatgactacttgaaaaataaaggatctacgctgatgaagacgaaccgaccgtctcgaacgtccggtgctgcacaggctgttaaataagagaagtcaccaagaaaaaaccctcattcgactcatcctaaacacacgaagaataggccagggttcctaccgaaggcatcggcgatagtgatacgtccgcgtcgaacg

SEQ ID NO: 57730 - DNA, 405 bp, Zea mays
  Clone ID: LIB3069-016-Q1-K1-C11
cccgcgcgtccgtccacgcgttcgcactgtccctgcctatttcaacgactcgcagaggcagaccacattagatgctggggtgattgctggcctcaatgtgctgcgtatcatcaatgagccaaccgctgctgctattgcctatggtcttgacaagaaggcaaccagtgtctgtgagaagaatgtcctcatttttgaccttggatgtggtaccttcgatgtctccctgcttacaattgaggaaggtatctttgaagttcaaggccacagctggcgacacccatcttggtggtgaggactttgacaacaggatggttaaccactttgtccaggagttcaagagaaagaacaagagggatatcactggcaacccgagggctcttcggcggctgaggacctcttgtgaga

SEQ ID NO: 57731 - DNA, 145 bp, Zea mays
  Clone ID: LIB3069-016-Q1-K1-C12
atacctgagagtgctgctgcttaaaaggggcgttattaaacggcttagggtgatcatgaacaccatgagcatgataatgaacacgaccatgaccatcatcaccatcatgatcatgatcatgatcatcatgcacatgaccacactc

SEQ ID NO: 57732 - DNA, 430 bp, Zea mays
  Clone ID: LIB3069-016-Q1-K1-C2
gaacctttgggctgatttatgtgcttgtggatgtgcggtggatgtgcgggtggatccccgggtcgatgtgcgggcgtcaataggcagcgatcgtccaaccaccgttccccggccatccactgcgggggtagctcccttttcattgcttgagcccccaccacgccacacccgtacacctctagacacataattcgacctcgctcgtaagaagtcgggcttaaagcatgtccacaccttagacgtcgagccaaaggactatttagaccctcacgaagactcctcgagggaaaacaccgatacgatcgccaggtcagcagcaagtcataacggctctagtaccggtatagcctgagacgtacccgagaagctctccggtccatggccgtaaaagacgaacttcaacatcgaccacggccgtccgaagataccc

SEQ ID NO: 57733 - DNA, 422 bp, Zea mays
  Clone ID: LIB3069-016-Q1-K1-C3
ggaactttgggctgatttatgtgcttggagagtctggtctttcatatgatactactccggatgttgttttgtcttctgtctcttctgctgtggttgagctttctcttgtggtggtggtgggtgatggtgtgtatttgggtcatcttgatgagggtattcgtatggcggatgttgttggagtgggtgcgggtctgggtttggagtcgtggtgttcggaggagtgttggtttgggtgtactactgatactatgtatgtgcatgcgttggattcctcggtgcctgtgttgggggtcgctatggggtttccggcttattctaaggagcttacggtgaatgggcttgagcataattcgctggagtcgtggccggagcgttatacgggtatttatgctgatgtgttaggttatacgaattaaggttat

SEQ ID NO: 57734 - DNA, 436 bp, Zea mays
  Clone ID: LIB3069-016-Q1-K1-C4
tggaacctttgggctgatttatgtgcttgagaaggtagagtactccttattctggggacgagggcggtgttgttgttgcgtattattgggctagtgctgctggtgtggtgctgctgcttacggttacgggtggtggtggtggtggttggtgcgtctgtgagtgcgagtgttctgctgcggggtcttagacttcggcgtattattattattatggttggtatgggtatgggtatgtgtatgtggtgaatgcagcttcgaagtagacggcgaggttgtgtgttgttgtcggtctgtgttatggttatggtcgttatgttcctctgcgtagcccttctaaggttcgtcattctcgtaagtgggagtccagtttcgataaggatgctcacacgcacagaggcgattaggggcctcgtagtgaggagcgttggcggtagta

SEQ ID NO: 57735 - DNA, 449 bp, Zea mays
  Clone ID: LIB3069-016-Q1-K1-C5
cgtctgcattggctctggaacctttgggctgatttatgtgcttgagacaaacaaaagctcgccagtctctaagcgcaacgtacctgagtatccgacaacgactagacatataccttccctagaggaagtaagtccatcgaggcttcctgcgatctacccgccggcaatctcaggatagcgacgaccctccgtaccctcttaaatgtaggcctacgcgaatatatatcaaacataccgagacatgtcgacagggctaaaagctcccttaagggtggaaacataagaaaagagtagcttataggattaatcattatcctcagttgggacctcccgctagtcccactacacctaccgttcgtcgaagtcgaagaaaccttcaactaagcctaagagaagagattagctgacatccacaggaagggtatcgaaaaccccactcttaatttcct

SEQ ID NO: 57736 - DNA, 445 bp, Zea mays
  Clone ID: LIB3069-016-Q1-K1-C6
tggctctggaacctttgggctgatttatgtgcttgtggatgtgcgggcttcgaaatcgcctagccaatctaggttttacgtgtccgtcgccgccagcctccctggaactttcgacgttccttccagcttatccgtccccgatcggaccgaggtaaacgtatcgctaattgggagttatcgactctaggcccttatacatgagttaggccacttcgcgaaagcatcgaacaccgacggtggggtacagacattgcacaatcataggagtatccgccgctctggaataaaccgccgcgaacttcgccccgcacaacagcccctccgaacacaagtgaatgcagttcaataggttaaagcttacgcaacggggcccataatagcaacaatccgtagagcgacgcaagtgagccgccgagtagcaaacaaaacatctccgctttaaaaa

SEQ ID NO: 57737 - DNA, 438 bp, Zea mays
  Clone ID: LIB3069-016-Q1-K1-C7
tggcctggaacctttgggctgatttatgtgcttgtttatgtgcttgtttatgtgcttgcttatctgcttgtttatgtgcttgtttatgtgcttgcagcctcagactgtgagtgggtgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgattgtcatatccgttagtgtttcagtgtttgt

SEQ ID NO: 57738 - DNA, 428 bp, Zea mays
  unsure at all n locations
  Clone ID: LIB3069-016-Q1-K1-B2
ctttgggctgatttatgtgcttgtctaatcctgatgttgagaggatgatgttccctaaggagtggttggttccgctgatcttggctaaggattgtgtcggcggtgtgatgttcgttagggagtgtggggtcgtggtgatgttcggcagggagtggattgttgtggtgctgttggtgtcgagtctcgtgctgccgaggaagagtagtagtgcgtcgtttaggtcgattaggagtaagagtcccgctgtggatagggactagtagtactttaggacttttaagagtttaccttttatcgagaagagtctggcgagtcgtatagttctgagggtgatgaggagggcggttaaggaggaagagtttcttctgttcntcctcgacgacgagtctggaagtctggntatacttattaagaagtgactggtgata

SEQ ID NO: 57739 - DNA, 407 bp, Zea mays
  Clone ID: LIB3069-015-Q1-K1-H7
cggacgcgtgggctctagggtttttgattttagccgccgccgctgctcatctcagatccgtcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagcttaggatgatgatgaccttgatccttttggtgatgaaa

SEQ ID NO: 57740 - DNA, 452 bp, Zea mays
  unsure at all n locations
  Clone ID: LIB3069-015-Q1-K1-H8
gcgacagcaagaaagcggaccccaacctgctggggggcgccatggtcggcgggcccgacgggaacgacggcttcaaggactcgcgcaacaccttcgggcagaacgagccgacgctggtaggcaacgccggcctcgtcgcggccctggtggctctcaccagcagcggcaggggagtcggcgtaaccgccgtcgacaagaacaccatgttctccgccgtgccgccaatgttccccgccgcgccgncaccaccgtcatcatggaagccatgacgaccgtgaacattcatggtcatacgattttttgtgatcgatcacgtacgcgcgcgaattctcttctgtacaataccacacgtaaattaacagtacgtgtaagcaaatatatagtacgtagcgcacggtggatcatcggncggacatgcttcacgtgtgatggttntctatggataatgagtg

SEQ ID NO: 57741 - DNA, 446 bp, Zea mays
  Clone ID: LIB3069-016-Q1-K1-A1
gacctttgggctgatttatgtgcttggaactgtaccctccgtctcccggctctcttagaactacttcttggttagtggcctccggggcatctgcctgaccgtcctattacctcccttcgtcttcgtctcccggtaccccccctatcttctttactgaaccgctaacttaggaactcctttgagacctgtccgtttatttcccctcccctaagcggactcgaatccgggagggaattttgacgtagttgtggcatggagaagtatgatagttgtcgttggggtggcatgtgtcgcattatcctggtattagtggtgttgttgctgttgttgttattgttgcgatttacttgcctgacgccactaaagctaggtcctaaacgtagtccgtcgggtaaagaagaaatccagccggaacggcatccaaagctatagtattcatagggggg

SEQ ID NO: 57742 - DNA, 425 bp, Zea mays
  Clone ID: LIB3069-016-Q1-K1-A10
cgaagatggtgtcgctgaagctgcagaagttgctcgccgcgagcgtcctcaagtgtggggggggcaaagtctggcttgaccgcaatgaagtcagcgagatctccatggctaactcccgccagaacatccggaaattggttaaggatgggtttatcatcaggaagcctcagaaggttcactctaggtcccgtgcaagaagggcacatgaggccaagcagaagggaaggcactctggatacggcaagcgcaggggtaccagggaggctaggctccccaccaagattctgtggatgaggaggatgcgtgttctgaagcgcctgctccgcaagtaccgtgaggccaagaagattgacaagcacatgtatcatgacatgtacatgaaggtcaagggtaatatgtttaagaacaggatggtacttatggag

SEQ ID NO: 57743 - DNA, 152 bp, Zea mays
  Clone ID: LIB3069-016-Q1-K1-A11
gcattgttgaaaagcatcaagttggacttaaagaagcttgaaaacaaagttaggtttatgcgctgtgttgttgataatgaaattatagttaacaaccggtaaagggcagatctatttttggagcttcggcagaagaattgtgatcctttccc

SEQ ID NO: 57744 - DNA, 430 bp, Zea mays
  Clone ID: LIB3069-016-Q1-K1-A2
aacctttgggctgatttatgtgcttgtttatgtgcttgtttatgtgcttgggtcgccggtagcctcggactaaacggcaatggttgggaataaattggcaaactcgaaagttagcgaccttattactgagagcctgagatatgaacccagcacataggcccgcccctcggagaccgaagaggggacagcgtatacagaaaaatcgcctatcgcggcccactgagaccccagccgacatcgttgaagcacaaccgcgtagactgtaagaccggccgctcgtcacgtccaccgtccacggtacgaccctctgctaagccgcatccgagctagcaccctcgtatggtcaccaactctcatacggcatctcgcctaaaaaaaaaaaaaaaagggtggttgtctcagaggacttaagtccatgcatgtgcgtacg

SEQ ID NO: 57745 - DNA, 321 bp, Zea mays
  Clone ID: LIB3069-016-Q1-K1-A3
cctgatttatgtgcttgtttatgtgttgaaaaaaaaaaaaaaaaaacacaaacccaaaaaaaaaaaaaaaaataaaaagggaatggataaaccaacacgagtttgtgccaccatattactacgtgataatacaatcaactcacagcgtaatccaaacccaacctaaccgttgatggcacataatatacagatcaatcaaatttcggtgccaactaatccaacagttcacttctatacatctcccccgttaatacgtgcaaaatttaacagcttcgcatcgactgtccactttactagccgtttagatcgaacgttcaaccg

SEQ ID NO: 57746 - DNA, 292 bp, Zea mays
  Clone ID: LIB3069-016-Q1-K1-A4
gaactttgggctgatttatgtgcttgtgaacaactctcctcctattctatcaataccagtcagtaatctccctctcttcgtaacaagggttgtctgtcttcttcttcgttagttgtagtcggctgtggtggtggtggcttcggtagtggtgtcgtcgtcgtcggtggtgggggttgggatggtgctggtggtggcgagtcgtggtgaggcgatgctgctggcggtgttgcgttctgggcatgtgacgggtagtgtggtgctgtttcttgtggtgcgtcgtagtggggcgtgt

SEQ ID NO: 57747 - DNA, 429 bp, Zea mays
  Clone ID: LIB3069-016-Q1-K1-A5
aacctttgggctgatttatgtgcttgtaaagtcccataataaagatttacccttacaaagaatattaaacaaacaagataccacttatataaaaaaccataaacaaacacgcagggctaattaaaagttcgtactctagcctcgccatgtacgcacatctcgtatcctaaaggatacgccctagagccaagatcatatcgaaaaatcgtcgcggagcactacaatactgccccgcttcacctgacgtaggcgatgaccgtactcttacttagataggacgtagtaatacaaacacatacaatgcgaaccgcggattaagttacggaactagtacaggcggatcaggttgagataatataaaagtacgtgcactaaacgccatagcaagagacgctaatacgcctagaattacgaacggcgctagaacta

SEQ ID NO: 57748 - DNA, 426 bp, Zea mays
  Clone ID: LIB3069-016-Q1-K1-A6
cttggctctggacctttgggctgatttatgtgcttgtttatgtgcttgggtgattgatgccgtcgccatctttgtgttgccggcggacgtggtttgagaggtgtttgttgatgttttggtggtgttcgtcgttgatgtgaagttcgttaaggttaacaaggttattgcgttcaagaagtgtgttagtttgatttatttgttgcatgttgagacggctctggaggtgactatgctgtctaaggagaggatggggcttagtagtcatgtgaccgttaagcctgcggaggataagtataaggttaagtctacgtttaatccttgtaagtcctcgaatgcctagtctaagaagtctgctgttggtcgtaagtcgattaaggcgcagaatctgcataagtcgctgcatgttattcagttgaactttaagtt

SEQ ID NO: 57749 - DNA, 435 bp, Zea mays
  unsure at all n locations
  Clone ID: LIB3069-016-Q1-K1-A7
tggctctggaactttgggctgatttatgtgcttgtggatgtgcgggtggccgtcccgtcgaacggtcgacttgacttggccaattctctgttagtaggcgtgcttggaatgttctttctggtgctagtcgtctgtaatgtgtctctgttactgggtcgtcggattgtcgtggtgatgtgaattgcgatgaggttgtttcgttgtattttgttgatgttagaggtctgtggtgtttctctgttgtaattgggtcgttgtattgtcgtggtgaggtgaattgggatgaggttgtttcattggttttcgtggtcgtggtggtgttgttgtcttgtggggataggcgtattcgtcttagcgtttggagtcggagtcttgatgggcagctttggatgtatatgacttggngttttgtgtttgcggcttatccgaatgata

SEQ ID NO: 57750 - DNA, 440 bp, Zea mays
  Clone ID: LIB3069-016-Q1-K1-A8
gaacctttgggctgatttatgtgcttgggcgtcttcacatagtgacgcagccccatacttaactattacgccaccatgaggggccggggaaaattcacctaaaatctacccatttcccaccccaaaactaaagtatattctataccattccccgtattaccgggagccacgaagtaccggttcgctcaaccctacgtgaaagggttcatagtcgagccggtcatgcggcacgagcagtatcttccaggcttcgaacccagtctcgtacgggagtaaacccgagcacgacttcaaaatacttgtctgctcgctttatgttaaagtataagctcaacgtctggtttcgactgcggacggctagtgacgtacgggcctgcggtggccctcagatccgtgcgatgctcctccagcataacgcctaaggtacgctcgatcccccc

SEQ ID NO: 57751 - DNA, 60 bp, Zea mays
  Clone ID: LIB3069-016-Q1-K1-A9
tcgcggacgcgtgggcggacgcgtgggcagttttagagacctgtggacctgtactggtat

SEQ ID NO: 57752 - DNA, 413 bp, Zea mays
  unsure at all n locations
  Clone ID: LIB3069-016-Q1-K1-B1
tttgggctgatttatgtgcttgacatataagtataagtgtatctcagtaacggtcctcgaggccgcttgtttcagtgatgttgagtcatcaaaggtataagttgatacacggtggtctagttctcttcattctatgttttcgctatcgaggcgtgttgcggagtccggtacttttatggtgactcattgttacggtggggtcgttctagttgtcgagtcggctatggtgtcgctctcttttcttatcaagtcgttgccttcttgttgttcgtcgtggtcttctgttgtgctgggtgcgcctattgctgataagtagagtatggaggaggagtggcattgtactagttttgcgcttcattcttcggcggatggtactttctatgaggattatacgaattatattgnctcggcgt

SEQ ID NO: 57753 - DNA, 442 bp, Zea mays
  unsure at all n locations
  Clone ID: LIB3069-016-Q1-K1-B10
caagattatagaatgacatattgtcttgttcatccatcaaggaagatgctcttgatgcctgtcgagccttttgaacctagtaaatcatgctacgtctgctctgagaccccacttgttctggaggttaatactaagacaacaaagctccgggaagtcattgaaaaagttataaaaagcaaacttggaatgaacctccctttgataatggttggtgccacgctagtttttgaggatggtgaggatttggaagaggatgagattgcaaattatgctttaaacctcgaaaaggtcttggctgaacttccagctccagttctaaatggtacaacacttacagtcgaggattttcatcangaactaaaatgcagtattaacatcaaacacagggacgagtttgattaagaaaaggagcctgacggaaatgttcttggctggtggtctg

SEQ ID NO: 57754 - DNA, 320 bp, Zea mays
  Clone ID: LIB3069-016-Q1-K1-B11
aattggtcctaaaatgacctattttactattttaaattctgaattttaagtataagactgtgttttatatatcaattcagttctaacatgtgttagtgcgtctaaactcaatatttagactgcaaattgtactatgcattgtacatacttgtctgattgtaaaatgaaaattgcagactcgtttatgaaacagcttccgcatctagctgtggaaaattactgctgtgatatgccatatcctgacttgagcttttctgaggtcacgtctgccgttgtacatgataacctgtagcctcacataccacgctggtgcccgagct

SEQ ID NO: 57755 - DNA, 444 bp, Zea mays
  unsure at all n locations
  Clone ID: LIB3069-016-Q1-K1-B12
aactccgctgggccaccagctttgaccgtttcctcccttcccctccgctactgctcctcggcaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaagttttgagtgatccagagaaacgtgagatntatgatcagtatggtgaagatgcccttaaggaaggaatgggccggtggaggacccatgttgatccatttgacatcttctcatca

SEQ ID NO: 57756 - DNA, 215 bp, Zea mays
  Clone ID: LIB3069-015-Q1-K1-H6
aaaaaaaaaaaaaaaaaaaaaaaaaaaaaataaaaaaaaaaaaaaaaaaaaaaaaagaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaataaaaaaaaaataaaaaaaaaacaaaaatttataaaacttaaaatattaaaaaa

SEQ ID NO: 57757 - DNA, 382 bp, Zea mays
  Clone ID: LIB3069-039-Q1-K1-G9
gcgtcacgcgaccccctgtacttctctctagttagtgtacagtttaaactctaggccgccgcctcgcgctctggtcgccttgccccggcgcagagatggcgctgccgaatcagcaggttgtggattaccccagcttcaagctcgtcatcgttggcgacggtggaactggtaaaaccacatttgtgaagaggcatcttactggcgagtttgagaagaaatatgagcccaccattggtgttgaagttcaccctctggattttaacactaactgtggcaaaatttcgcttctattgctgggacactgctgggcaagaaaagttctttggccctagggatcgctactacatgcatggtcagtgtgccctcattatggtttgatgtc

SEQ ID NO: 57758 - DNA, 314 bp, Zea mays
  Clone ID: LIB3069-039-Q1-K1-H1
cccacgcgtccgggggtataactgatgttcttaggctatctccagcagcctctctatccgatgctctatcttactccctattttaaattttactctataaacagtacagtctatagtgtatgacaatgttttgcatgtttatatccacactttgctggagatgggcatggtagtctgttggtgaccaaggaagctgtgatatctgtggcgaggtgccctgctagaggctcctttaatgggtgtacaattttcgaggtggaaagaagaatgttcgatcttgatctccatagcaacagtgtcatattatctatcta

SEQ ID NO: 57759 - DNA, 446 bp, Zea mays
  Clone ID: LIB3069-039-Q1-K1-H10
ggaaaatgggctgtgataagcaaggttattttaccttggtatgcattacatactgctattcaagtgttcaatgaagaacctgctttagttctaatagtaaaaatttgttctatgctttcaagtgttgactaatacatgtttttatgttatcaggatgaatggagaactggcttgaaagctcttcgagctgacagtattagtaaactgaagaaagcatttccagaactggtccaagaggttacaaggccatccaatttccaggatttctacatatatgcatttcgttattgcctcacagaggataagaagaaatgtatagaaataccagttgcttgtgagttgctgaatctagtattaggcttgcagttccgccctcaggttgacaagcttaataattacctcatgtaccaaaatgactacaaggtgataacaatggaccagtggat

SEQ ID NO: 57760 - DNA, 230 bp, Zea mays
  Clone ID: LIB3069-039-Q1-K1-H11
gttctcgacagaacggaaagctattggtttttgtgcggatagaatttaagccttttttacgtggtgcacgttgtgaagtaattgctttgagtctcttgtgagctggtttaaccgttaaaaaaaaaagactaatacataaaaaaaagaaataaaaatgaaataaaaaactggcttgaaagcatattaaagctaaaaggattagtaaactgaaagagagcgtttacagaact

SEQ ID NO: 57761 - DNA, 218 bp, Zea mays
  Clone ID: LIB3069-039-Q1-K1-H12
gccacacgtccgtagctaagctctttgcttacaatcagtgaaatccatcatgattgatctggggacatgtgtgtggaaggagttgttcttactatggaggatgctggccgtatggtgcgaagtcgcttatgctacgactctgcaatgactcatggatatgtgagtactgccatggatgatatttgatgcctctgaatgacaagatctgattattgact

SEQ ID NO: 57762 - DNA, 357 bp, Zea mays
  Clone ID: LIB3069-039-Q1-K1-H2
cccacgcgtccgcccacgcgttcgcccacgcgtccgcccacgcgtccgcccacgcgtccgcggacgcgtggggaagaacaatcagacaaaatgatccagtcattgacaaccatcaacaaattctttttctggaaccgttgtagtgtacaagagatcaagctttggttttgtacataatggtgccctggttagacctatttcctgactgtagttattggcttgaagtctagtttggggaaggttcttgttgccagctaccttgcagttgcggtatttgagcagatagtgtattctaactatgcatactaatagatgaccggcttcggtgtttttggatattttatggtttggatcaat

SEQ ID NO: 57763 - DNA, 412 bp, Zea mays
  Clone ID: LIB3069-039-Q1-K1-H3
cccacgcgtccgtgcattccgaagctgctctcggcgtcgcccaagtcctccaggaagcgtctctacggcgaccttgtcgcagccgagaagcccaagtggaatccccgagatgccgcgcagattagggctgtcaaggaggcgctgcacgtggcaacagtgccatcgtctgaattggtttgccgggataacgagctcaggcgtgtccttgagttctgcaaggtgtgcgtccaacaggagaaggctggtagtctctatgtctgcgggtgccctggcacagggaagacattatctattaacaaggtcaaggatagcttggtgtgttgggcagatgagatgggaatggagacacctgatgccttagcaatcaattgtacaaacctagcaaacacctcagagatttttggcaagatac

SEQ ID NO: 57764 - DNA, 127 bp, Zea mays
  Clone ID: LIB3069-039-Q1-K1-H5
ctgaactctatttctactgaagcagagcctgtgttgtatgtgtgttgggagaatgtgatatgtgatgtcaagctcaaacttcttctcatcctttcatgtctttaatatatatatatatatatttttt

SEQ ID NO: 57765 - DNA, 393 bp, Zea mays
  Clone ID: LIB3069-039-Q1-K1-H8
cattcccttacccctggctcacctccacactctccctcgcctgcggctctgctatgatgcttttctcatgggccaccggtcttgttgaggcccctaagaccgacctggacttctggaaagttcttttcccggttgctgtggcgcatacaattggccatgttgctgctacagtgagcatgtctaaggtggcagtgtcattcacacacataattaaaagcgcagaacctgcattcagtgttttggtgtcaaggttcttccttggggagacgtttccaattccagtatatctttctcttcttccaatcattggtggttgtgctctagctgctgtcacagagctgaacctttatatggttggatttatgggtgccatgatatccaaccttgcatttg

SEQ ID NO: 57766 - DNA, 320 bp, Zea mays
  Clone ID: LIB3069-039-Q1-K1-H9
ccgggtcgccgacgcgttcggctctctccgtcgaagaatcggcttcggctgccgcggcggcgagcgccttccctgggcaaggtccacccggcggcagagcagagcctcgttgctgaggaggggagatggcaggcatgaccgatatgccgatgaggcccgcgcggacgggcccgccgatgcagcaccggggccctccgccgatggcgcgccttcgtcccgaaccaatcgaccgcgagaagacctgccctctgctgctcagggttctcacaagggttgctggtcaccaccaaaatgaagagttctctgtgagaaggaaagaa

SEQ ID NO: 57767 - DNA, 366 bp, Zea mays
  unsure at all n locations
  Clone ID: LIB3069-040-Q1-K1-A1
cccacgcgtccgcggacgcgtgggattgtgaatcccaagggtgagatgaaaggttccgctatcactggacctatcggcaaggagtgtgctgatctttggcctaggattgctagcgcagcaaacgccatcgtttgagagcttgttggaatatgttcagacttctatatgatcatcttattatcagttgctaagagtgctattgggcttaatgggccctttatgtttgttcactcaattttgtagtaaacagaatttggtataccaaggggatctatatatcaatgtatgccataaattgtctgactaccatttctcatgaaatgcttatattgtttaaaaaaaaaaaaannnnnnnaaanancnntt

SEQ ID NO: 57768 - DNA, 437 bp, Zea mays
  Clone ID: LIB3069-040-Q1-K1-A10
gttattcaagtggaaccagaggcaagaaactcagatggatactgcacaacagaggctggcagtgctttatctgaaactgtcatgggattggagccaaataaagaaactgcggttccaatgcaagagaatattggagaagctaatgataattttaataattgcgaagcacacaataattcggagattcatgcatttgaagtgtcgatggaaacgcagtcatcagaagtcaaggaagtatcttctattcagtctggtgcagcaaatttgagcacacagacaactgcactgcctgatgtaacaagacaaaccagtatggcatcgactggagaactagtatctacaaatgaacacatacacatgcaaggcactgaaatcaattcagagcaacaaacaaagatggtttcacctgctgaatcagcacctgctaatgatgaaca

SEQ ID NO: 57769 - DNA, 343 bp, Zea mays
  Clone ID: LIB3069-040-Q1-K1-A12
cggacgcgtgggcaaacacctgggagctaatctgaaggacattctacgggtccctgatactttcttggaaccaggatccataattcttaatgggtccaaccttgccgcaaaaagaggtgaacgcctggctgttgctggcttttatggattcctgaaaaacctggccaaagccaaatggcttggtgactttagccaacaaaggactgtacttgctattgacggtggcttatccaagcactacaggaggttcagtgcctgcctataggcaaccctaacagacctgctcggcaaggaggttgcctaatgggttgttgccaagttggccaacgacggttcaggaatt

SEQ ID NO: 57770 - DNA, 284 bp, Zea mays
  unsure at all n locations
  Clone ID: LIB3069-040-Q1-K1-A2
cccagcgcgtncgcggactcgtgggattgtttatcccacgggtgagatgaaaggttccgctgtcactgtacctatccgcaaggaatgtgctgatctttggcctatgattgctagcgcagcaaacgccatcgtttgagagcttgttggaatatgttcagacttctatatgatcatcttattatcagttgctaagagtgctattgggcttaatgggccctttatgtttgatcactcaattttgtaataaacagaatttggtataccaatgagatctatatattaat

SEQ ID NO: 57771 - DNA, 350 bp, Zea mays
  unsure at all n locations
  Clone ID: LIB3069-040-Q1-K1-A3
ggagaaggcggcctacgtgctgatggtcctggcgcaccggagctacggtgaccgcgccgccatggccgaggcaggcgcctcgtccgcgctcctgaagctaacgctcgtgggcacggcgctcgcgcagaagcgcgcgtccaggatcctggagatcctccgcgccgacaagggcaagcaggtcgcggaagacgcctcgggcgtcgtggcgacggtgtcggcgccgcaggagcgcgggtgccgcggggaggagtcggtggacggngagttcgccgacgccggcatgagcgcggagaagcgcgccgtgcggcagctggttcagcagagcctgcagagcaacatgcgccgtatcg

SEQ ID NO: 57772 - DNA, 159 bp, Zea mays
  Clone ID: LIB3069-040-Q1-K1-A4
cccacgcgtccgcccacgcgtccggtttatatcatgtcaagattgaacacatcaccttttgtaaaactacttgaattgttattttccttttccacaagaggtacatggcagattcctgttgagatttgatcttttggtgcctgttaagcttcttgatgt

SEQ ID NO: 57773 - DNA, 377 bp, Zea mays
  Clone ID: LIB3069-040-Q1-K1-A5
cagacgaggagccaacccgttcgcctgtgatagcggcaggagagtatacccgacgatgacttgataaacccaactgctctccctggtttttcgtcgtcttcagctactaaggagttcagcgaagatcttccaaaggctccatgggaggaagtacaggctgccgcagcaggttccctgccaccgcctccggagaggtatggtcagagacagcagtacttcgagcaaaacgtgtattctggtgggagcaacggaggtggatatgatgaactgttgacactgactgaaaacctctccctgaaccctgagaagaatgcttcatggccgacagcatcccgccaggctaaacccgaggactcactcttcaagggacctgtcga

SEQ ID NO: 57774 - DNA, 424 bp, Zea mays
  Clone ID: LIB3069-039-Q1-K1-G8
accacgcgttcgcccacgcgtccgataatcatgactggatgctgcgaagagcaaactggtctgggggctatgtatgtgtgaaatttgagattaggattagaaaatcaaagggctatctgttgagttcatcaagcagtcagataagtcagggatccaaacccaacaattctgagatgggacttagcttcaatatgtgcaagaagattgtgcatatgatgaatggcaatatttggtcagtatcagattctaaaagcatcggagaaactatcatgctagtcctccagttccagttggaacctgtgactccggactctggagcgttctcagatttgtacagatcattcggaattcccaactttaatgggctcagagtcctccttgcggacagcgactgcaccaaccgagctgttactcacaggctcct

SEQ ID NO: 57775 - DNA, 423 bp, Zea mays
  Clone ID: LIB3069-040-Q1-K1-A6
cccacgcgtacggattgaggaatccttacttgcatctctagaaaagaggaagaccggacgtgagccaccctatggctcagactctaagaagctcaagattagaatccattgcggaagtggagcgcaaggcgtctgatctgagtgctggtgtataccattgtgctgtgccactgttgataatgtacatgtatgggctgtttgtttctccggagatctcgctgcggcgtctactgcaacaagattatggcgacacggccagaaacaacatgatgcgaaacctgaagccgactctaatagcactgtactcaatgctcgatgcacggcatgctattctattacagggccatatgacctacggaggagcgacaactggtgaatctagtggaccgagtgtatgcgctggatgcgggcgacgaggcacgt

SEQ ID NO: 57776 - DNA, 431 bp, Zea mays
  unsure at all n locations
  Clone ID: LIB3069-039-Q1-K1-F10
cccacgcgtccgcccacgcgtccgattgctttgatatggaatgtatatcgtctgataaggatgttgaaggcaaacaaaaggtgaatcatgtgactgtttttgagcgccctggtttgcatgagttcttgcggaaaactagtgaatttgcagatcttatcctttttacagcaggtttagaaggttatgctagacctttagttgaccgaatagatcttcacaatagattcagacttcgtctctatcgcccatcaactgttaccacggaatatagagaacatgtgaaagatcttactcgcgtgtcaaaagattttggcaggattgtcattgtcgacaacaatccgttcagtttcattcttcagcctttgaatggaataccttgtgttccattttcagctggacaacattctgatgatcagctcatgacggntata

SEQ ID NO: 57777 - DNA, 361 bp, Zea mays
  Clone ID: LIB3069-039-Q1-K1-F11
cccacgcgtccgttttttttttgtcgttctctgcttttcttcaggagtagagaatcaaagtgtgttacagcgtcgagttgcgtatctatacatatttgcagagcgagaagtcatcatttgtaaactcctcgatacaacaaagaacgtaaggtgaaggcgtgaagctatataggggaaggggaacccaaggaatggcgatacaacacataaggaacataaaaggcaccttcttgatgctaagttgaaaagaggagctttaggcatatctgatttgaatgttgacgaccgaactgttaacctagctgatataactaacagcacataggagaacaaaggtggaaagaatgctgctctagttgag

SEQ ID NO: 57778 - DNA, 379 bp, Zea mays
  Clone ID: LIB3069-039-Q1-K1-F12
cccacgcgtccgcttctcctaaatttctcatcttaataccgagcatgcaaaatcctgagcatttgtgagcactgaacatggcttattgctccagttacttgtacatcgtctaaagtttacgttatcttctttcacagatggacggcaaaacaataaaggctcagatctgggacacagctgggcaggaaaggtaccgtgcaattacaagtgcttactaccgtggagccgtgggagcactgcttgtgtacgacatcacaaagaggcagagcttcgacaatgttcacaggtggcttcgtgaactccgcgaccatgctgactccagtattgtgatcatgatggtcggtaacaaatctgacctaatccacctgagagctatctc

SEQ ID NO: 57779 - DNA, 256 bp, Zea mays
  Clone ID: LIB3069-039-Q1-K1-F3
cacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcattcccccagaccagcagcggctcatcttcgctggcaaacagcttgaggaccggcgcacgcttgctgactacaacattcagaaggagagcacccttc

SEQ ID NO: 57780 - DNA, 464 bp, Zea mays
  unsure at all n locations
  Clone ID: LIB3069-039-Q1-K1-F5
tgatgcattgctgggctcttttttgtgctcaatgatggctataactggttttatttttccaatcatcatcaataaccacaaaatccttttaatcccaaaccaggtgggggtaggctgaattggaacccaaccggagccacaaaataaatggtatgcatgtggatggctggtttttcattggctctattaaagcctaatctttggacatattctatcctttcatgtcttcttttattatcttttcccatgttaactntggtctttctctgcctctcttcctattactatcacattttaggatcccattatgcactggtgcctctggaggtctccattgacatgtncaaaccatctcaatctgtgttggacaaacttctttttttaatcatgtataagttaaagaaatatgctatgacaaacagacaaatgcactggcatactaatattcatgggttagatgtttg

SEQ ID NO: 57781 - DNA, 413 bp, Zea mays
  Clone ID: LIB3069-039-Q1-K1-F7
gtacacggtggcggtgcggcggatggcgttcgcggtgctggagctgatggcggaggggctgggcatcgccggcggcgccggggacgcggtgctggcgcggctggtggcgcgcgcggacagcgactgcatgctgcgggtgaaccactacccgccgcggccggcgctcaaccccagcctcacggggttcggcgagcacaccgacccgcagatcatctcggtgctccgcgccaacggcacctccggcctggagatcgcgctgcgggacggcgcctgggcctccgtcccgcccgacggggacgccttcttcgtcaacgtcagcgacaccctgcaggtgttgacaaacgggaggttcatgagcgtgaggcacagggtggtggggaacagcgagaagttccaggtgttcatggtcttct

SEQ ID NO: 57782 - DNA, 376 bp, Zea mays
  Clone ID: LIB3069-039-Q1-K1-F8
agtacttctagctctggagtatctacacatgttgggagtggtctatagagatctgaagcctgaaaatgttcttgtgcgcgatgatgggcacataatgctttcagactttgacctctcgctgagatgtgcagtctcacctacactcatcagaacatcagctttcgattctgatcccagaagagcaggtggttctttctgtgtacagcctgcttgcatagaacctacttcagcttgtatccagcctgcgtgctttctccccaaattcttcggacagaagagcaagaagaagactcgaaaggcaaggtctgagttgggacataacgccggcacccttgccgagcttgttgccgagccaacatcagctcggtcgatgtca

SEQ ID NO: 57783 - DNA, 298 bp, Zea mays
  Clone ID: LIB3069-039-Q1-K1-F9
cccacgcgtccgcccacgcgtccgctcagcataactaaacaccagcaaaaaaaatgcaattcacatcattgatttcagtgatctgtccattggggatcctatatgtgacataattccgctgcacttggatattttccggggtgatagtgaccttctcaaggaatttctacggagctatcaacttccccttctgaggggggaatcaaccaccgatgtctacagatcagtgcgaaactcgaagttcagcaaggcatcatatcgcgcgatgtgctactgtatattacacgaagacaacgtc

SEQ ID NO: 57784 - DNA, 374 bp, Zea mays
  Clone ID: LIB3069-039-Q1-K1-G1
gtaacattaatcacccactctactactcgaagttactaccagcagcttgcttcaacagtagaagagagcgagccgaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgttgcacccgtgcagccacgccgagttccccgtgtgctggtggacggggcgcctgcgcgcgcccgaagcctgccaggtggagtgtcacgtcggcgt

SEQ ID NO: 57785 - DNA, 352 bp, Zea mays
  Clone ID: LIB3069-039-Q1-K1-G11
gcttctcaggaagacgatgaagattaagaacatccactacaatctgacggaagatcaatggaaggggaagaatctgtcccaggtggtgttggcgggtcagctactgctgatgcattccatttggattaggatctgctactttaggtcttgtaagtttgattagctactgctgttcagattttagaggtgctattgcttctgctgtatgatgtttgagtttgatattcatatttcagacctgatgttgcttatatattgtctaatatctttaaaatctgattcagagaatcatatatattatatatcaagtatattatgtagtatataactatatactgtagtgtatatatat

SEQ ID NO: 57786 - DNA, 261 bp, Zea mays
  Clone ID: LIB3069-039-Q1-K1-G12
gttatcttctgtgttgctgctagcgactacgatgagttctacgaagatgcaaacggtaccattgtcaacaagatggtagagagcaggcagctgttcgagagcatcaccctccatccgacattcgagcaagcagacttccttctgctcctcaccaagttcgatctcctagagcagaagatcagcagttccccgctgacctcgtgcgactggttcagcgacttcactcccctgatcagccgcaacctcctcaacggcggcagc

SEQ ID NO: 57787 - DNA, 304 bp, Zea mays
  Clone ID: LIB3069-039-Q1-K1-G2
gacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaacaagttcggagacgacggctacgacagcgggtacaacagatcgggcaccaccaacgacgacg

SEQ ID NO: 57788 - DNA, 302 bp, Zea mays
  Clone ID: LIB3069-039-Q1-K1-G3
ggcatgtagtggatactatggttatggcaatgagagtcaggatggaacaattgagttaaacagaggtcctagatctggccggttcaagaaccagaaattgtacggtcatactgtcactattgctgtgaaagggcagtctctcccttctagtgaaagcaagaatgatagtgctgtgcctgatagagcaaagtacaatagagatgacattcctgttcagtacgatgctgcaaagatctttgtcattaaatcgtacagcgaggatgacattcacaagagcgtaaagtacaatgtgtgggcaagca

SEQ ID NO: 57789 - DNA, 396 bp, Zea mays
  unsure at all n locations
  Clone ID: LIB3069-039-Q1-K1-G4
tccacgcgttcgatccgttgctcgcaaaacgcccccacacgccgncggcgaatcggcgactccccttgcgaagggaggaagcagccacgccgccgtctcggcgacttcctgacgactgcctcttcggtctcgaacgcgatcttgcccatggtggctctggcgccggtggttcgtgagatctanggttgtcgagcgccgccggaatgggagctggatggggcgccgngaagatgttcgcagcgggggccgccgtcccggagctggtccaacgttggcgggagcgtaatccccgaactacttgcaaaacacanaatggacttggaaaatttgacgctgacaaaacattcaatcagaacattacattttttcctggtagcccatgtacaatacttgaaa

SEQ ID NO: 57790 - DNA, 399 bp, Zea mays
  unsure at all n locations
  Clone ID: LIB3069-039-Q1-K1-G5
tccacgcgttcgcccacgcgtccgcccacgcgtccgcccacgcgtccgcaatgtttgatgactttgtttttgacgctggtgaagatgttcgagaggagcaagatggtgacaatcgccacggggctggacctactcagctactcgatctgcatcttcttgtcgtcggcctctctctacatcctgcataacctncacaagggcgacgaccatgaggagtgatgagagtgtgcaatataatgccgaatctgtaactctatgacagaagagataatgtgtaggcttgggttcagctgccatgtaccttactggacccacgtttcaatgagcatgggtgtcacctgacctgacatgccctttaaagcctggtcctgaacttagaccaccatgtgctttactata

SEQ ID NO: 57791 - DNA, 333 bp, Zea mays
  Clone ID: LIB3069-039-Q1-K1-G6
gtgggttggcttctccttcccctccggttcgggttcgggttcgtgaggttctccggggtgcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttcttcacggaggaggcgatgcggaacgccatcgagggcatgaacggcaaggagctggactgccgcaacatcaccgtcaacga

SEQ ID NO: 57792 - DNA, 396 bp, Zea mays
  Clone ID: LIB3069-039-Q1-K1-G7
tccacgcgtccgcccacgcgtccggacgaccacaggatggccatggccttctcccttgcgggctgtgccgaggtccccgtcaccatccgggaccctgggtgcacccggaagacctttcccgactacttcgatgtgctgagcactttcgtcaagaattaataaagcgtgcgatactaccacgcagcttgattgaagtgataggcttgcgctgaggaaatacatttcttttgttctggttttctctttcacgggattaaattttgagtctgtaacgttagttgcttgtagcaagtttctatttcggatcttaagtttgtgcactgtgagccaaatttcatttcaagagtggttcggtgggataatcagaataataaattacgtttcagaatacaaaag

SEQ ID NO: 57793 - DNA, 418 bp, Zea mays
  Clone ID: LIB3069-039-Q1-K1-F1
ctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcg

SEQ ID NO: 57794 - DNA, 166 bp, Zea mays
  Clone ID: LIB3069-039-Q1-K1-D3
gctgtatcaatatgtgtctctagcctttttggctaacgtcttagagctgctcttacattgggtgtctacaggtgcatctggtggggtttccacgatcgatctgtctacctggactacttgagtgtccactctgctgtctgcgtctgtaggctccacctccaacttc

SEQ ID NO: 57795 - DNA, 395 bp, Zea mays
  Clone ID: LIB3069-039-Q1-K1-D4
aacgctctctaccgtccgagaccccaagcaccagcgcggcggcggtggcggtggcggcggcgaccatggctgtcggaaagaacaagaggatctccaagggaaagaaaggtggcaagaaaaagaccgtcgaccctttctctaagaaagattggtatgacatcaaagcaccgtcggtgttcagtgtgcgcaacatcgggaagactctcgtattcaggacacaaggtaccaggaatgcttctgagggtctgaagcacagagtctttgaggtttgcctagctgatcttcaaggcgacgaggatcaagcttacaggaaaatcaagcttcgtgctgaagatgtgcaaggcaagaatgtgctcacaaacttttggggcatgaattttaccactgattaactc

SEQ ID NO: 57796 - DNA, 370 bp, Zea mays
  Clone ID: LIB3069-039-Q1-K1-D5
gtttatgttcctgaagttgatatcctatcagtcttagatgttcctcatgggaaaatgggacgagttattggcagaaaggggtcaacgataatggttgtgaaagaatcttgcaatgttgaaatccatattggtggtgctaaggggcctccagatagggttttcatcattggagcagtgaatgaagtcaggaaagccgaggccatcttcagaggccgaatgctggagttctagagatgttaccctttgcgccccatgtttcgactgctttatatcttttgaacgcaaaaaagggggaaatacacaaaaggagtatgctgtgccgaggatcttttgcccatccgtgaatcatgtgaagaaagtataaatgatt

SEQ ID NO: 57797 - DNA, 369 bp, Zea mays
  Clone ID: LIB3069-039-Q1-K1-D6
gcctgctgcccgtcttcttccgccgtcgccgccgtcgtcttcgtccgtagagcagcagatcagagagcggggaggaagaaaaaccgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcgggggcaggtgcgtgtgcgcgcgcgcgacccacgccgggtcgttcaagtgccgggtccaccggaccaacttccagggccacggtcacccgcacccgttcccg

SEQ ID NO: 57798 - DNA, 408 bp, Zea mays
  Clone ID: LIB3069-039-Q1-K1-D7
cgtgagtgttttaggcacctaatggctaatttcaggaaaaaaatcaagggtgatgtgctgaagtatatgtggccttgtgcatgggcatgtacagatcatatgtatgatacactaatggagaaaattgcagcatctagtcctaaagcaattcactttctaaacaataaccacaagctaaaatggagtagatctaaattctccaaagaatgcaaggttgattatgtgaacaataacatctcagaatgcttcaacaattggattaaagattacaaagatctcccagtcgctgatctaatggataagattagggagaaaattatggagaagatttatacaaggcaagagatagccaatcgaatggaagggcgtatcctacaaagtgtgatacatgaagtgaacatgaagagc

SEQ ID NO: 57799 - DNA, 306 bp, Zea mays
  Clone ID: LIB3069-039-Q1-K1-D8
cccacgcgtccgaaaccaaaccgtgcatttcatattagaaaggcagtgcaggtcttgttgccttcgtcttccccatgaagaaaccgtactagctgtagctgctgaacgtttgagtccccctgctgccacccttatctccatttgtgtcatcgaaactccttgcttcccctgctgtgtgaatctgtacggctttgcgtgttctggacactgattgcagttgaatccagtttgtagttctatctgttcatcgaatctgcccagactcctttggtaccattcaacaggctgctgctttctggttaaaaa

SEQ ID NO: 57800 - DNA, 420 bp, Zea mays
  Clone ID: LIB3069-039-Q1-K1-E1
ggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacattcggtgtgcctattattattacattaaccaaggtgggtcggcactacatcgttgatgccaccttagaggaagaatcccagatgagttctgcaatgtcggtgtcagtcaac

SEQ ID NO: 57801 - DNA, 418 bp, Zea mays
  Clone ID: LIB3069-039-Q1-K1-E11
cggacgcgtgggtgttcaacaacattgatacagacaggagcggcacgatcacggtcgagggactcaaggacgggctggcgaagctcgcgtccaagattagcgaagcggaggttcagaagcttatggaagcagttgacgtggacaagagtggcagcattgactacaccgagttcctcactgccatgatgaacaggcgtaaactggacaaggaggaggatttgttccttgcttgtcaacacttagacaaagactatagcgggtacataacaagagacgaactggaacaagccatggcggagtatggggtgggtgatgaagcaagcattaaggaagtgctggacgaagttgataaagacaaggatgggagaatcgactacgaagagtttgtagaaatgatgaggaagggaagttatacctg

SEQ ID NO: 57802 - DNA, 287 bp, Zea mays
  Clone ID: LIB3069-039-Q1-K1-E12
gtcagattccatgaggtgcactgtttcaagtcatttgttcattcaattccatggttgcacagaaaagatgaggcgatgccaagaaaaagtcgatatgtctatgtgtttaagttaaagggccaaaatgtatttcttgtttggtatatagcagccctacaacactttggtgaacttagttactgcagactaggtaattacagttgcaccttttgtattttatagcaaacccagaaattttcattggattctacgactgcccctcttgtagtaaatgcaaggcttacctg

SEQ ID NO: 57803 - DNA, 455 bp, Zea mays
  Clone ID: LIB3069-039-Q1-K1-E2
atcgaacctatccgcaacttattcgctgctcttttccttgccagcattgggatgctaattaatgtccatttcttgtggaaccatgtggatatactccttgcagcggtaattttggtgatcaccgtaaagacatttattgttgctattgtcgtaaaagggtttgggtatagcaacaaaacatctcttcttgtcggcatgtctcttgcacaaataggagagtttgcttttgttctcctaagccgtgcttcaagtatccatctcatcgagggcaagctatacctgcttcttcttggaaccactgcactcagtttggtgacaacccctctgctattcaaaatgatcccagcagtggtccacctcggggttcttttgagatggttttctgtcgataccaatcagctgggcctaaaaaatgatgtccttcgcattgatagcggcaagcgcataaatctgat

SEQ ID NO: 57804 - DNA, 318 bp, Zea mays
  Clone ID: LIB3069-039-Q1-K1-E3
gatcgtcaagtaccttcacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgcctctcttcaggaacatccaccacagccctgactacttccaggatccacacaagttcgacccttctag

SEQ ID NO: 57805 - DNA, 473 bp, Zea mays
  unsure at all n locations
  Clone ID: LIB3069-039-Q1-K1-E4
cccacgcgtccgcccacgcgtccgcccacgcgtccgcttccttcgacgtcaagctccgggccactccatggattcgatctgggaggcgaggagctgaggccaggacagggggaggagctgctggggggcagggacaggatagcgcggctaagcggcaacggcggcagccatgagctggagacgaggcggaagcggaggcgatggcggngtctcgaggaggtgggccgtcctgctctgcgtcggcagcttctgcctcggcctgctcttcaccaacagaatgtggacgctgcctgaggcaagtgagattgctaggccgaatgcgaatgtggaggaaggcaccgtgccgattgccgcggagtgtggttctaaaaaggtccaagaaaagcaggattacagagatattntacaggttcaagatagccatcatgatgtacanacactggataagacgatagcaagcctagagacagagc

SEQ ID NO: 57806 - DNA, 448 bp, Zea mays
  Clone ID: LIB3069-039-Q1-K1-E5
cccacgcgtccgcccacgcgtccggacaagtgaagtggtcgatttcttgagagggatattcaacatgtttgacattgataacgatggagctttactacctgctgagctggaggacctattctcaacagcacctgaaaacccatggtcttgcgatccatataaagactgtgctgaaaagaatgtgttgggtggtctgtcacttgaagggtttctctcaaagtgggctcttatgacactgctagacccgacaaatagttatgccaaccttgtatacgttggctatcctggcgagttcagttctgcatttactgtcacaaggaaaagacgtgtggatcggaaaagcaacagacacagagaaacattttccagtgttttgtttcggtgccagaggctctggaaagacatcggtgctacaatcaatcatcggaaggcaaccttttgatgccct

SEQ ID NO: 57807 - DNA, 71 bp, Zea mays
  Clone ID: LIB3069-039-Q1-K1-E6
aaaaaaaaaaaaaaaaataaaaaaaaaaataaaataaaaaaaaataaaaaaaaaaaagaaggaaaaataaa

SEQ ID NO: 57808 - DNA, 334 bp, Zea mays
  Clone ID: LIB3069-039-Q1-K1-E7
gaccggctggacggacgcgttcgttcgatctcgaccgtagctcaccggtaagttactctacgacgaagcatggcgtacgtcggcgggggcgccccggtcgcggtcctgcgcccgtcggcgtctctcaagtcgtcgtcgacgtcggcggcggccttccttggccactctagccgcctcggtcgcactgctaccgcgtcgccgactaggcgcagtctaaaggcggttgccaagggcgagtggctcccgggccttccctgccgcgcctaccgtgacggcagcctgccgggcgacaatggcttcgacccgttgggcctggctgatgacccggagaacc

SEQ ID NO: 57809 - DNA, 413 bp, Zea mays
  Clone ID: LIB3069-039-Q1-K1-E8
cccacgcgtccgcccacgcgtccgcccacgcgtccgcacgcccacgcctcatcaagcgaggcaatggcgtcgcggctcctgccgttggtcgcggcgctgctcctcctcctcctcctgacggcggcgtcgtccgaggcgacgctgcacccggtggactacctggcgctgcaggcggtgcggcgggcgctgtcggacctgccgggctcccgcttcttcgcgtcgtgggacttcacgggcgacccctgctcgttcgcgggcgtgtcgtgcacggccgacggcgcccgcgtggagacgctggcgctgggggacccgcgcgcgggcgcgccgggcctcgggggcgcgttcccgtccgcgggcgtcggcaggcttgccgcgcttacgtcgctgtccctcgtgccggggcgcgtcacggg

SEQ ID NO: 57810 - DNA, 198 bp, Zea mays
  Clone ID: LIB3069-039-Q1-K1-E9
cccacgcgtccgcccacgcgtccttaaaaaaaaaaaaaaaaaaaaaaaaaaaaaaaaaaaaggaaaaaaaaaaaaaaaaaaaaaaaaaaaaaaaaaaaaaaaaaaaagaaaaaaaaaaaaaaaagaaaacaaaaaatggaggagaaaggttatggaataacaaaccaaaaaccaatgaccagaatactatacttaaaa

SEQ ID NO: 57811 - DNA, 475 bp, Zea mays
  Clone ID: LIB3069-039-Q1-K1-D2
gctaaatcagtaagtgtcgctaaactttttggctaatgtcttagagctgctcttacatttgtaatcgagaggtgcatcgtgtgtggtttccaggatggggctggggacctggactactcggcgtcgtgctcggcgtcggcgtcgggaggctccacctccaacttctccgggccgtccagcggcagcggcagcgggtctgccaacaaggtggactctccgattctcggcctcgtcaccgaggccgacagcatcacaagaacagcccggccgcagcacagccatacggcaacgggacaataacagtgtgacactcacgaatatacttgctcgcccgtcttacaccattgtttgacagtttttacaatgcttaactttttaggtgagtggttggttgctgggaatgtacagtatttgggtcaaaattcaaaatgtttcagaggcttaatccaatgaaacaggccctggttttttaaaa

SEQ ID NO: 57812 - DNA, 392 bp, Zea mays
  Clone ID: LIB3069-015-Q1-K1-G10
gagcgtgtggacagtggtggccgcgctgtgcctgctcgtgttgcctacatgtcccgggcggttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccag

SEQ ID NO: 57813 - DNA, 374 bp, Zea mays
  Clone ID: LIB3069-015-Q1-K1-G11
ggaagtacacatcccaatcacccgtgtcaggattcactctcaggagctgggtggcaggaaagtcaatagcccctgtggcaattgcaggaccagctggagcagggttgcggtgtctccacggtgctctcgccctgcccatggccaccccagactctgatctccaggaaccccatagcccctctccacctcaccccatgttgatgcccaaggtcactcttgctacccgctgggcccccaaacccccactgcctctcttacttacccccatccatcacctggttttgactaatgctgcttccctctctgggcctggctgccaggatcttgtgtccctaagtccctctctttaaagaacttctgcgggtcagactctg

SEQ ID NO: 57814 - DNA, 396 bp, Zea mays
  Clone ID: LIB3069-015-Q1-K1-G12
catcctacttgtccagaaggtaaatttacacagccagaaagaaaaggcatcggctgagctgtcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgctggccatgtggctagtgtgtggatcagaaccccacccccatgccactattataggcagccacggaggacggacagtgcctttggtttttccg

SEQ ID NO: 57815 - DNA, 428 bp, Zea mays
  Clone ID: LIB3069-015-Q1-K1-G2
cccacgcgtccggacccacgcgtccggcacatgttccaggacttaaggttctcacaccagactcttcagaagatgcccgaggcttgcttaaagctgctattagagatcctgatcctgttattttcttggaaaatgaattgctttatggagaatctttcccagtttctgctgaagtgcttgattctagtttttgcctaccgattggcaaagctaagatagaacgtgggggtaaagatgttaccattactgcattctccaagatggttggctatgctctccaggctgcagagatactgtccaaggaaggaatcagtgctgaggtgatcaaccttcgatcgatcagaccacttgatagagctgctattaatgcatctgtcaggaaaaccaaccgattggtgacttgtgaaaaagggttcctcaacatggga

SEQ ID NO: 57816 - DNA, 333 bp, Zea mays
  Clone ID: LIB3069-015-Q1-K1-G3
cggacgcgtgggctcagaacgagataagattcagcgtgatggcgatcttgaagaaccgggaggagatgttcacggtggagatcaaagaactccagaggaagagggagggcctcttgcagcagatgggcgatcccaacgcaagcaggcatgttgagcagtcactcgcggaggtggcagctcagatcgagtctgtgacagagaagatcataatggaggaggagaaggtgaagaagtggaaagcggagaacctgaggaggaagcataactacgtgcccttcctgttcaatttcctcaagattctcgaggagaagcagcagctgaagcccctgatag

SEQ ID NO: 57817 - DNA, 337 bp, Zea mays
  unsure at all n locations
  Clone ID: LIB3069-015-Q1-K1-G4
tttgtttctgcccccagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcangaggtgcatc

SEQ ID NO: 57818 - DNA, 266 bp, Zea mays
  Clone ID: LIB3069-015-Q1-K1-G5
cccacgcgtccgcccacgcgtccgtccacgtgtccgggagactcttaggacagatgttgagatcattctttaaacaatgccttgaggaaagcgtgatttatcgaaattgttcccgcaagcaagagagtgaatttgttttgagggcttaaggttgtgttgtgcgtgttggattggattgattaaaattcgtagtttcgtacagttttgtcaaaaaaaaaaaaaaaaaaaaaaaaaaaaaaaaaacagaaacggaaaaagaaatacaa

SEQ ID NO: 57819 - DNA, 455 bp, Zea mays
  Clone ID: LIB3069-015-Q1-K1-G6
gcgaccgctccttcgaatacatattatttgatttatcctagcggcgatctgagtagcgcgcgggatgaatttgtacagtgtttggtaaactatgagtggaagggagcggctgtgaattctgcgaaagctgacgagctggttttgggcttgacgaatcatgacctattcctgtactttgggcatggaagtggaacccagtgtatttctagtaaggaagtcgagtagatagataactgcgcagctgctcttcttatgggatgtatcagtggcacacttcattgcacacgaagttatgctcctcgaggggccccattatcatatttataggctggttcccctgctatcattgcgaatctctgggatgtttcagacaacgacattgacacgcttagtaaggcttttctcaattgatggctgcatgacaaatctctagatggcaacaattgttcaaaatg

SEQ ID NO: 57820 - DNA, 262 bp, Zea mays
  Clone ID: LIB3069-015-Q1-K1-G7
cccacgcgtccgcccacgcgtccgttagcactggcgctgatgtcgatggacgaggcgctgggtgcatctgccgctgacgcggtggtgacattgctgtgggtgctgcgcgtctccacgctgggggcctcgacgacggcggtgacgttctacctgaagctgcagggcgtgcacttctcactcctggtcacagactgcctaatatccatgctgctgttcaagttcaatatactttgagacgcaatcctgggagctagcttaaacc

SEQ ID NO: 57821 - DNA, 460 bp, Zea mays
  unsure at all n locations
  Clone ID: LIB3069-015-Q1-K1-G8
cccacgcgtccgctagaattcataaagcatcagatgaaaaggctggacatcagcgttttgacgaacctgacgaattggtgccagagcgtggatctgaagatgtttcatttggatatgatccagcaatggattatgatagccacatgcagactactgtgaaggtggaagatgaaaaaacagaggatgacttgccagttgctgacaatgatgtacagaaggtagagaaagagaagctaaggaatgcaaaggatggttcagataaacgaagganagatgccttattgaggaggttatcggcgccaaggaccccactgaatgatgcacanaaacgtgcacagaacctgcgtgcatataaggcagaccttcagaaactgaagaaagaacaggaagaagagcaaataaagcgattggagaggctcaaattggagcggcaaaagaggatcgccgcangaggtaatgg

SEQ ID NO: 57822 - DNA, 434 bp, Zea mays
  Clone ID: LIB3069-015-Q1-K1-G9
gggaccgcgagcacaggccgctccgtgggcgcttcggatcctcgcgggaccccacgctctgccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagccc

SEQ ID NO: 57823 - DNA, 345 bp, Zea mays
  Clone ID: LIB3069-015-Q1-K1-H1
cccacgcgtccgcggactcgtgggcggacttgtgggctggtatggtagtcacctttggggcaactgttctgactaccgaggggaagtctgttgagatgcaccacgaggcacttcatgaggctctttcgggtgacaatgttggcttcaacgtgaagaatgttgctgtcaaggatctcaagcgtgggtttgtggcctccaactccaaggatgaccctgccaaggaagctgccagcttcacctcccaggtcatcatcatgaaccaccctgggcagattggcaacggctatgccccagtgcttgactgccacaccttccacatcgctgtcaaagttgctgagctcatta

SEQ ID NO: 57824 - DNA, 129 bp, Zea mays
  Clone ID: LIB3069-015-Q1-K1-H10
cacacataaacaccatacaccggcaagttttaaacacatttgccctcacactccctactcactcaacacattacatcaacccctcatcacaaactcatcttacttcaacctcatatactatctttctcc

SEQ ID NO: 57825 - DNA, 415 bp, Zea mays
  Clone ID: LIB3069-015-Q1-K1-H11
gtgcgatcggcggcgggaggttccctgggaaccaggtggtcgaagggctgagctgggtgggcagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaacttgccctaagctcccgtgccccaagagtttgcctttgccatctgctttgatgcccctggagtgcgcccacacct

SEQ ID NO: 57826 - DNA, 354 bp, Zea mays
  Clone ID: LIB3069-015-Q1-K1-H12
cttcctcaggcggtggctggaggcttcgcatctggggctttaaacatacaaaggtgttggggggacctgcggcggcggcggcggcagcgggggctggggcgcgggggccggaccatgagccgctgagccgggcaaaccctaggccaccgagccagcggaccctcggagcgcagccctgcgccgcggagcaggctccaaccaggcggcgaggcggccacacgcaccgagccagcgacccccgggcgacgcgcggcgccagggagcgctacgatggaggcgctaatggcccgaggcgcgctcacgggtcccctgagggcgctctgtctgctgggctgcctgctgagccacgccgtc

SEQ ID NO: 57827 - DNA, 462 bp, Zea mays
  unsure at all n locations
  Clone ID: LIB3069-015-Q1-K1-H2
gggatatactggtctgtcttttacaaagcatattccagtacgtccttacagacataatgagtatgagagattcataacatcagcgtacccatactacaccgnctcattttcaacaatgggtgctttcttcgtattctcgtttgtgtacctgtaccacaaataaaggactcatgggagcgcacaagtctctggaggctgacgtgaccaagatctgtgggcactgaatgttgtgctataagccaagagttacccggcgccaattttatggaaccatgtttttgtactgccaacttagataacatttgacgaccgtgaccgcactcatgggaaatttactcgtgctaggatgttcgatctggccccacttcntttttntcttggaccctttctgatcagcacttgtcagaaacgttacagtctatagcactganacgtgattttggaagtactacacccccagta

SEQ ID NO: 57828 - DNA, 377 bp, Zea mays
  Clone ID: LIB3069-015-Q1-K1-H3
gccgacggctcgactccactagtcgctggtaccctctgcaacaaagccgcctccacctgagcacctattgagctcttccccttcctcgtgggttgtgcgagccctctaccggcgcgcagtacaggggctgattgggtgatcaaacccgcaagatttggttttgtgatttgggagcaggaggcggtggcaatatgccttgcccactccgttttttgttgagctggatggtagcttggcgttcctaattttggacctctggcttaaaagcgaaaaaaatacccctgcaggaatataaggcgagatctactggaacttcaggaacttcgtctaaaagtttccgtgatctgtacaatatgaagtactcgagctacttaaac

SEQ ID NO: 57829 - DNA, 352 bp, Zea mays
  Clone ID: LIB3069-015-Q1-K1-G1
ggacgacacgcccatccgggtgtacgagaacgccacgctgcaccaaggccacggccacgggcaccaccggcacggcggcgcggcggcggaggccaacggcaccaacaccaccaccaccacgctggctgctgccccggcgccgttccccgggccgcagccgatggccgtgtacagctccatctggaacgcggacgactgggcgacgcagggcgggcgcgtgaagacggactggtcgcacgcgccgttcgaggccacgttccgggaggtgcgcgtggacgggtgcgcctgggcgggcaacgccacggacggcgacgccgcggaggcgcgccggtgcagcgagtcctcgtggggc

SEQ ID NO: 57830 - DNA, 444 bp, Zea mays
  Clone ID: LIB3069-015-Q1-K1-E2
aacagacttcactggtggtgtggagacaattgagtactgtgtttgtttgcatgaggaggatcatgggatcctttggaaacggcaagactggagaactggtttagcagaagtaaggcggtcaaggaggctcactgtgtcatttatctgtacagttgcaaactatgagtatggtttttactggcacttctatcaggatgggaaaatagaggcagaagtaaagcttactggaattctcagtttaggggccttgatgcctgcggaatcgaggaaatatggcacaactattgcccctggtctgtatgcaccagttcatcagcattactttgttgcccgtatggacatggctagtgattgcaaacctaatgaagctcataaccaggtggttgacgttaatgttaaagtggaaagtgcatgcacacataatgtgcataataatgctttcta

SEQ ID NO: 57831 - DNA, 372 bp, Zea mays
  Clone ID: LIB3069-015-Q1-K1-E3
cggacgcgtgggctctgaaggagatagattgggtcaagacgacacaggagcactgtcccagcctgcagtactactatctcggttattatatacattcttgcaataagatgagatacaaagctgcatatcgaccatcagaacttctatgtccactccgttatgagtgggttcgctatgatttagccaagcctctactggatgccagtcaatactccgttctatctgattatgctacaatgcaaggtgaagtgccccagcctcagatttgtggtccctctgatgactcttcagcaaaagttgaccaccatgagtctcccagcgatgaggatgaggacgacgacgatgaagatttcgacaactatgaatcagata

SEQ ID NO: 57832 - DNA, 451 bp, Zea mays
  Clone ID: LIB3069-015-Q1-K1-E4
tgtgtcgttgcggaggcaggaagagagacgacggcggccatggcgacctccttccaggggacgacgaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagagggtcactgttaataacactatgtaccacaagagctgtttcaagtgct

SEQ ID NO: 57833 - DNA, 172 bp, Zea mays
  Clone ID: LIB3069-015-Q1-K1-E5
cccacgcgtccgtttttttttttttttttttttttttttttttttttttttttttgattggtttttttttatttttttttaatttatttttttttcttaatattatatttaaaatttattatttactattaaaaaatcaaaaaaaaataattaaaagtcaatccaatcttat

SEQ ID NO: 57834 - DNA, 79 bp, Zea mays
  Clone ID: LIB3069-015-Q1-K1-E6
gaataacccggaccgacccactcgtccgcccacgcatacgtacatttattattttcttttttaccctatcttcttttta

SEQ ID NO: 57835 - DNA, 407 bp, Zea mays
  Clone ID: LIB3069-015-Q1-K1-E7
cccacgcgtccgcggactcgtgggcggactcttggggtgatccggaacctccctgagaagtgcccttactagacaacactgccttatcctgcaccctatctggagcttctcctggcatttatatggtgtcttatggtttcttgtctgtcgctgacaacgttggcgcttaagatatttggaataggactacaccttccatagtttacgttgaactctgtggtgctgaagcagctgttgccattatggcggaaattgctgacgcctgattgaacatgtacagtttttattcagttaaacaactgggcaaaaaagttagatgctcatattcatcacacaaaattgtacttgtcaggttatttatatacgttacctgaatactatctatcactctaatatattaatcactc

SEQ ID NO: 57836 - DNA, 444 bp, Zea mays
  Clone ID: LIB3069-015-Q1-K1-E9
agccgcgccagggagctcgcggcgctcggcccctgtcctccggcccgagatgaatgctgcggcagaagccgagttcaacatcgctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctct

SEQ ID NO: 57837 - DNA, 369 bp, Zea mays
  Clone ID: LIB3069-015-Q1-K1-F1
cccacgcgtccgatctcaaacctgtgcgtctgcccctttccagctttcctctcaaacggagagatgtactcggatcagatctccaccgggcgcaagcgctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaaccca

SEQ ID NO: 57838 - DNA, 269 bp, Zea mays
  Clone ID: LIB3069-015-Q1-K1-F11
tattaagcaaaatgtaaagcacttttttttatagctatggttataaacaggttttagattgttcaaattacttgtccactgaatgtcacttgaccttgataagaggccgcctgcacacagagcccagttaattctccgcacctcggttgtgtgcttccgaatgggctcactcccgtggtggtgtttgagagccaacaacactacctcatagaccggtctttgggaaactttgggtctcactgttgcctggcttgagcactttggtttat

SEQ ID NO: 57839 - DNA, 348 bp, Zea mays
  Clone ID: LIB3069-015-Q1-K1-F12
cgcttaagtacaattcaatgcactccttcttatctccactcatataaactagtaagggatggttctaatacccttcccgcctgttgaaaaaccacctcaattaccctcttacaccaaacgaaacaccattcatcctccaaactctaagcatttctacaaacacaaacttttatttaactgcttgtgatagactaatcgaactctacggtttcacgtccctttacaataacacgtacaccaaatcctctctccttacccatcaatctttctagaacatgcattgcaacacaaatgctgctctcgactactatgtttcagtcaacaactactcctatgtcttcacattct

SEQ ID NO: 57840 - DNA, 338 bp, Zea mays
  Clone ID: LIB3069-015-Q1-K1-F2
gacccacgcgtacgcccaggcgtacgaccactcatcttcccactttaccttcaacacctctgctctcaatacacgacatgtaccacacaccatagctactgcccacgctaaccatgcatccaacaccagccagactcccacttaaataacacctcactcttaaaaatatcgacccactcgacaatcacaagaacgctttgacataccaacttctggacctacgagcaacaaatatttttactcggactataccacctcagattccacttacaccctgcatcttctaaccaaatctttcttgaacgatacccttcactacttgatcaacaaatttgcct

SEQ ID NO: 57841 - DNA, 213 bp, Zea mays
  Clone ID: LIB3069-015-Q1-K1-F3
ttattccatgacgtacccatacagccacacccctacagcacctacatcaaacgatcgattctaccacacctctttcaaaacgctcctacaaatacatcaaacatggacatatgaactatatactcaacatcataaaccagatttactatctacacatgcgacatacattatactgacgcattatatacaaatttatcatccacactctatcga

SEQ ID NO: 57842 - DNA, 348 bp, Zea mays
  Clone ID: LIB3069-015-Q1-K1-F4
tcgtccacgcgttcgcccacgcgtccgcccacgcgtccgcggacgcgtgggggcggctgttcgcgggggagccgacgccggcgctgctgcgcacgctcgccgcgctgcaggcgctgtccgtgggcccgctggtggacgcggccactgcggcgctgcggtcgccggcggtggccggcagcgcgctgggccgggccgccgccagggccacggcgtaccggcacttctgcgcgggcgagaccgccggcgaggccgcggcggccgtgcgccggctgtggcgcggcggcatgggcgggatcctcgactacgggatcgaggacgccgaggacggcggcgcgtgcgaccgcaacg

SEQ ID NO: 57843 - DNA, 182 bp, Zea mays
  Clone ID: LIB3069-015-Q1-K1-F5
gtcgccctcaagggcgactcgggggcgactcgctcgcaccgccgccgccaacccggaaagcagtacagcccggccgccgccgcctctcctccggctaccggcggtggcagccagcggcggcgccccaaaaagggcctgccccgcaccccttcctctcctccctctctctcccacccacccct

SEQ ID NO: 57844 - DNA, 324 bp, Zea mays
  unsure at all n locations
  Clone ID: LIB3069-015-Q1-K1-F6
gtgaactctccttttcttcggacaccattgacaaattttgcgggtacaattcaagtgatggccaacagactatgcatcaggtcaatggaaagcagggttgggaggaaagggagattgtcgatgaaaggaagcctacctcttaaaaatagcgagccatctgccaatgacaagattgatttgaaatgtgaagttctggacatacgagcaaaaaatattttgagtggccaagtagacagccagctacaagttacaggctcaattttgcgaccagatctttctggaatgatccggttgagtcatggtgaagcatatntgcctcatgat

SEQ ID NO: 57845 - DNA, 443 bp, Zea mays
  Clone ID: LIB3069-015-Q1-K1-F7
gcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctggtttcgtct

SEQ ID NO: 57846 - DNA, 454 bp, Zea mays
  Clone ID: LIB3069-015-Q1-K1-E12
aaatactccatcagcagtgacaactctgacaccactgacagtcatgcgacatctacagccggatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgccttgccgggcagaggccatcccagagcccgtggtgaggatcctcccaccactggaaggcccccctgcccaggcatccccgagcagcaccatgcttggtgagggctcccagcctgattggccagggggcagccgctatgactgggacgagattgatgcctactggctggagctcatcaactcggagcttaaggagatgg

SEQ ID NO: 57847 - DNA, 337 bp, Zea mays
  Clone ID: LIB3069-015-Q1-K1-F8
gcaccctgctgcagatgcacacacagacacttacagctagcaatgccgggggcaggcaggggcccgtacgtacgtgtctctttctctctctcatcttgtcaccgtacctatctagagtgtgtgtgttcgtactaattaaaatgttcttgtcgtcgtcgtctgtgcatgcatgtaccatgtcgtcgtgcatgtctattatgtgtgtgtcgtcgtgtcgatcggtacgtatagatgcctgttgttagcatgtgtgtcattacctagtcgtgtgtagtgtatgtatgtgcttgccgggcaaaagttgcatctagctaaacagtagtattactttttaaaa

SEQ ID NO: 57848 - DNA, 210 bp, Zea mays
  Clone ID: LIB3069-015-Q1-K1-F9
cccacgcctaccaaaaaaaaaaacttttatatcaaataataaaaaaacaaaataaacgaaaggttaaaataaacaaaatactaaccaacaaaaaaaaaaacaaaccacctcaccacttaacaaaaataaacccatctaggatctccatgcagacttgatctcaatcacatagatcccttacttataccaactcattacaacaaactcctt

SEQ ID NO: 57849 - DNA, 444 bp, Zea mays
  unsure at all n locations
  Clone ID: LIB3069-015-Q1-K1-C9
gacagggatgagctcaccccacaaggttttcctgagccccggaggcggggccacgcgctgggaagccctctcaggaaacgccgccaggacaggaagcagattggaggagaaaaaccgcaatcttcattcgcggaaaatccaggtgcttatgggagcattttcacagaataactagaataacgaggtatttgggttttttaagcaccggggtgttaagtcttccttcaagaatcacctattgctgaaaggttgttttattcggcggaagtttcaacatgtcagagcagcctgccccgtccgggacaggtttcaccgtcgggagacaacatgcctgtccttcgncctcccagccacaacgtgtccttctgtgcacgtttcagctgaaaccttgcatttagttttctaactcagagggtttgtcaatcttttacctgcgaactcctg

SEQ ID NO: 57850 - DNA, 389 bp, Zea mays
  Clone ID: LIB3069-015-Q1-K1-D1
cacgtgcataatccatattggattccccaacttatttaagaaaaagggagcaatcgaagaagtagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaaagaaattgcacgtgccgaatgcatcataaagggtagactacccctccaaacaattcgcgctaaaattgattattgctgctatccaattcgaactatc

SEQ ID NO: 57851 - DNA, 321 bp, Zea mays
  Clone ID: LIB3069-015-Q1-K1-D10
cccactcttacaccaaatatcaactttaaactcccattttattcacaaccccatccacctacacatccggcaagttcttacccaccacccgcccgcccaacaacaccaccacccctacaaccacccacaccctattcaaaaacacaacataaccaaaaccaatctaccaccaattttccaccacaaactaccatcacccctccataccaaatccccaacacttacctatccaaccctaatactacaaactcaaacatacactaaatttaccacactcactcaaccaaatcacccacacacttcacaacaacctccatacca
